United States Patent 7,612,192 (NEISSERIA GENOMIC SEQUENCES AND METHODS OF THEIR USE) - sequence listing, part 2

SEQ ID NO: 705 - DNA, 345 bp, Neisseria meningitidis
gacgtcgaggttgatggagtggctgtacccgaccagcaccagaaccggtgcggtttcaccgacgacgcgcgcgatggacaacaagatgcctgacacgatgcccggcatcgcgatcggggcgacgatccgcacgatcgtcatccatttcggaacgcctaacgcgtagctggcttctcgcagttcatcgggcaccaacctgagcatctcctcgcctgcccgaaccaccaccggcaacatcagcaggaccaacgccaacgccacggcaaaggcgctctgctgaaatcctatggtggcgatccacaggctgaagacgaataacgccgccacgatagagggcacgccggc

SEQ ID NO: 706 - DNA, 311 bp, Neisseria meningitidis
atgggcgtggctttggcgcgggcgtgccgtgccgccggtgcagaagtcagcctgattcacggacagcttcaaaccgcgctgcctttcggcatatccgatacggttcaagccgtcagtgccgaaaatatgcatcgcgcagtgcatcgtttaatcgacaaacaagatgcttttatttctgttgccgccgtctcagactatagggttaagaggaggagtactcagaaattcaggaaagatagaactgccaaaccgttatccatcgaattggctgagaaccccgagattttggcttctattgcctcattagcgaa

SEQ ID NO: 707 - DNA, 102 bp, Neisseria meningitidis
agtgggtgtcgatatttacaacttgggtaacttcacccgttccaaccagtctagcaatatcaatcatcgtcctgccgtcaaagccggcgatgttttgcaacg

SEQ ID NO: 708 - DNA, 259 bp, Neisseria meningitidis
cctgtcgtcttcggcatcgccaaagaaggctcgctcaaacgcgtcattaccggcgaagacgagggaacgctggttcactgctgattgaccatagtgtcggcagatatagtcgcatatgggcttcagacagccatttattatatggagattatagtggacatcccatggcatcgacatcacctctggtggcagcatccacgcctaccccaccgcattcgatgcccccaaaggcagcactaacatcgaggctccggcggaa

SEQ ID NO: 709 - DNA, 212 bp, Neisseria meningitidis
aaactgacgtttgtctttccaggatgaggtagaaccatgatttatctgtttacaggaaacatggggacaggcaaaacctcccgcgtcgtctctatgattttgaacaacgaacacggattgttcaaaatgaaattggcacacggcacatatgtagacagaccgctttacttctgccatatcgacggattggataaaccgcagttgaaagccca

SEQ ID NO: 710 - DNA, 497 bp, Neisseria meningitidis
  misc_feature (231)..(231): N is any nucleotide
tccatcgggtcgagcgactcgtccaactatgccgccttcctccgctacggtatccgtaccagcctgcagtccaaacatgtcttgcacaacttgcggcttccgttgcacaagccgataaccccttcagttatagtggacagcaaccgctttttgaaagacagcagtgatattgtgttggattttccgtttaaagattgtgtgttaaatggcggacaaagcaccgaggaaggcgaagaaatttattttaaacgcaataacagccagccagccagccagccagccagccagccagccagccagccagccagccagccagccagccagccagccagccagccaattatacactaaattaacccgagagagacaagaaatcttttttaatcaaacccttgcttttgatgaaattgatcggctttttgacgcacaagcattctcaaaattctctcgctataccgcagacggcaagcaagccgtttgcgcaaatcaaacgacat

SEQ ID NO: 711 - DNA, 485 bp, Neisseria meningitidis
  misc_feature (231)..(231): N is any nucleotide
cagttggcattgttagataatttgattcacaaatgggcggaaactggttcgaactggggcaaaaaatcaccaatgygactttcaaccgaytggacgcaaacggctaatgaaggtattgcactgacaccatcccaagtagcacaactaaaaaagaacgctttagtttccctttctgataaagctaaagcagctattgacgccgcccgcgaccgcattgccgtgcttgatgcntacacggggcaggattccaacacactctattacatgagcgaggaagatgcgcttaatatcgtcaaagtaaccaacgatacatacgaccatctcgccaaaaacatctaccaaaacctgttgttccaaacccgtttgcagccatatttgaatcaaatcagtttcaaaatggaaaatgatacgttcactttggattttagtggtcttgttcaagcatttaaccatgtcaaagaaagtaatccgcagtggtaccgagc

SEQ ID NO: 712 - DNA, 399 bp, Neisseria meningitidis
  misc_feature (231)..(231): N is any nucleotide
taatgcctgtaaatccatgtctttaacggcagctctggcagaagcggccacaagttcttgttcgaccgcaaagcgtttacctccgccatgcgatggaatacctgtcagtgtcccgcaggcggataaaataaaaactgaaaaaagaataggtatcagcagccgtgcttgcatagattttctcctttgatgaaaaacaaattgtatcaaaattgtaaatatagtggattatcngtcggcgtaacgctattggacggttcccgtcatgccccgaatccagtgaaggaaattgaagtggcccgcgtgttacaatatatcggactgcaaagcggttcgaccacggaggcagccgtccgttttatgctttagtgtatgcggcagcaggttttttgggacggcaac

SEQ ID NO: 713 - DNA, 1065 bp, Neisseria meningitidis
cgtacggctttctctaaaaatacctaaaccgtcattcccacgaacctacatcccgtcattcccacgaaagtgggaatccaggacgaaaaatctcaagaaacctttttacccgataagtttccgtgccgacagacctggattcccgcctgcgcgggaatgacgaagctatccatacggaaacctgcaccgcgtcattcccgcgaaagtgggaatccagaacgtaaaatctcaagaaaccgttttcccgataagtttccgtaccaacaaggctggattcccgcctgcgcgggaatgacgaagccatccgcacggaaacctgccgcgggcatttcggatatcgtggttctggcagcttggcggcaggatgcggaagacttcaacgaagcctattgccgccatgtacgccgcaaaatgaacataccggaacatttggcatattttgccggagagccgattatgatcaggcagaacgactacgcgcttgaactgttcaacggcgacatcggactgattatggaagatgtcggacggcagggcagccttgccgcctattttgccgatgcggacggatttaaaaaggtagcggtaagctgcctgcccgaatttgaacccgcattcgccatgaccgtccacaaaagccaaggttcggaataccgggaagtatggctgctgccgccttccgccgcaccttcggacgaaggggacgatgcattgtccggattgagtaaggagctgttatataccgccattacccgcgcgagagagaagttcgtattcttcggcggggaagaagccttccggcaagctgccgccaccgtcaaaacgcgtcagacggcattgggcagtatgctcgagcgggtattttcacaagaataatccgcccgaatgccgcgccgccgccccttatgcctttttcaaacggtataggaaagtggtttcccgggttcgcgcaaaagcaagcggatcgctcggattcgcggcttttttgtgcttcggcttggttttcatcatatcggcaacacgcaaacccgcctgagcaaatgccttatccatgaaaatcggatg

SEQ ID NO: 714 - DNA, 621 bp, Neisseria meningitidis
cgctgcggcataaccttccgccttgtcgacggcagtataggcagccgtgttgacaatggcgtcgggttggaaacttttgaccatgttgcagacggcatcggcatcggtaatgtctagggatgcggaatccgtcgcaatggtttcccagtcttccggaagacggtcgcgcaggcagcgtgccagttggcttttcgagcctgtcaataggattctcatgaggtatttcctttggtaaaagtgtattgtaggacttgctgtcggtattatagtgccaaaattttgccgcctgtcgggcaaccaataaatcgactttgcccagtttggcggcagcggtaacagcatgcaaagtggtatgattcaactgtttgttgtcgtgttcgacaataatcaatacactcatttcagcctcctcaaatcactttggcttcgtttttcaatttttcaaccaattcggcaacgcttgctacttttacgcctgcctgacgcgccttaggttcggcaaatttcaccgttttcaaacgaggtgaaatgtcggcaaccaaatcgtcaggagtcagtttttccaaaggttttttctttgccgccatgatattggggagtttgacaaagcgcgggtcgttc

SEQ ID NO: 715 - DNA, 176 bp, Neisseria meningitidis
gggtactaaccgatgactttgacgaacgaagcgcgttcgcccaagcgttccaatgccgtctgaatctgcgcgtaccggcggtgtccttcgatgtcgatgaagaacaggtattcccacaaaacggatttgctcggacggctctcagactaggtcatggaaatacccgactccgtcag

SEQ ID NO: 716 - DNA, 204 bp, Neisseria meningitidis
aaccgcccaagccatgattgccaaacacatcgaccgcttcccgctattgaagttggaccaggtgattgattggcagtcgatcgaacaatacctgaaccgtcaaaaaacccgttacctccgagaccaccgcggtcgtcccgatcgtccacgtggtgtccatgttcaaagccgttctgctaggacaatggcacaacctctccgatc

SEQ ID NO: 717 - DNA, 245 bp, Neisseria meningitidis
ccgcataatcgagtgtacccatttcctgcttgccatcggtttcaaacccgcaagacaagggcgaaccgctcaaagtcgccgcttcacatcttcctgcagccgcccgccgcgacatgaatgtctatctttcaggctggcaactgattgacggtatggtaaacgtctgacgcatcgtccacgaccactaaagcgaatgttgcggcttcggcggcacattctccgtcaaacaagccgatatttccggc

SEQ ID NO: 718 - DNA, 273 bp, Neisseria meningitidis
gtatgggttttccggcgcggggaaaacgtcaggcatcgcgccgtatcgaaataaccggacccgcagacccaacggcagtcctgaacgacgacctcgtccaacaaagccaggtcttcctgcaaagcgcggacattgttcagcacatgccgcccgaaatggggaatctgcgccgaaggttcgggcacagtacggtgccggtagcggtttcgcaaataagccgtatcggtattgctttcagcctcgatattcggcacagcgtgtttttgggcataa

SEQ ID NO: 719 - DNA, 154 bp, Neisseria meningitidis
attttgctcaatattaggaaggttttaagcaattgaaaatttgttggcgcatttttatgcgtcaaatttcgttaacagactagttttgcaaaggtctctatattgttcgatatttttgaagacatcgattttttagggaaacgattgtttacgg

SEQ ID NO: 720 - DNA, 362 bp, Neisseria meningitidis
cgttaaacgacgcagccggcactgcgcattaaaaacgtgccgattgtaaacgccgccaataccgccaaatcgggaatgccgtctgaagccagccacaatgcccagtaggtcggccacagtaaaagcagcgtcccaatgggcttgtccgcccgcatcaggcgcaggtacacatccaaacggtcggacaggcgtaaaaataaaggggatttaggattcatattgccgcgcagcttgaaaaaacggtattttagccgagaaaacgtttcagttcgggcagaaaatagtcggtaaacacgatttcgtcaacgtgcccgccggctcggtaatgctgcgcgtgtcatcgaaaatatccttgatcgcgc

SEQ ID NO: 721 - DNA, 274 bp, Neisseria meningitidis
cggctgcttctatctttgatgctccaccataaaggtattgcccgaaaccggcggatggaggttttgtttttctgccgccgcccgtgatcgcttcgtggttcgccaaacgcgcctgttgcagcctcatttgcgcataatcctgctccaaggcgatttcctgtattttcgccttatccaaagctgtgatattgagcctgtactggttttgctgcatcacaacggcaaaagcggcaacgcacaccgcatccagcagaaggaaattcactttgttcat

SEQ ID NO: 722 - DNA, 446 bp, Neisseria meningitidis
cccatactatatgtcttaagtgaggaatacatggttcattgatgaacccaaatttgacccttgtagcagatgctgtcagtgccccacccatatgttctttgcctgtcagacaacgatacagcccttgtcggtacgaatatcgtctatgccgccatccacaacttcggcggtatggcggggcgcaaccgcaaagttcggattccgcaacgggaatttttgacgctgacggacgacgacaaacaggctttgatggacgatgtgcaggattatttttcgggtctgataccgtgaatttataaaaccctcaaaaacgcgctttttagcgcgtttttttatgcgggtaatacaaacccctgcccaagatataaaaatcaatcctagacgcttcgaaaaagcccctgaaaacgattaattgtgtatcgcgcggacaggttttaaaaaaatgg

SEQ ID NO: 723 - DNA, 146 bp, Neisseria meningitidis
gcttcatcgtcttcatcccaatctgaccccaaacattcgccttttggtttgacgtgatgacaggtaaacatacctttaattcggtcttcacgggcttggttcgggctgtattcgacgttgaaaaagtcatttgcgatgtcaacgcg

SEQ ID NO: 724 - DNA, 303 bp, Neisseria meningitidis
caatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccaatgatcgaagttaggctggtaagagccgcgagcgatccttgaagctgtccctgatggtcgtcatctacctgcctggacagcatggcctgcaacgcgggcatcccgatgccgccggaagcgagaagaatg

SEQ ID NO: 725 - DNA, 455 bp, Neisseria meningitidis
tttaaaatggaaatttgaacttttatctcactgttgttaaaacgccgttcgtacccctttaaatacagctcaaaatgcgctttgggaatgccgtcaaacttgcgtaaatgacgttttgcccggttccaaaagttctcaattccattgatatggttttgtcgttcagcaaaataactttcatctgcttctacttcgccatcaaacatttccaaatgcggactgttttgataaataagtaatcgtaaacgatgaaaataataggctgcggtacttttattaacgcctactaactctgctgtcgttcttgcagttacacctgcgacaaacagttcaatgagtttatttgtttataccggcttagacgactttttctcataggggcaactctaacttaatttgaatttccctagttatccctaaaggggggaaacccaaaagggggccccccccccccc

SEQ ID NO: 726 - DNA, 739 bp, Neisseria meningitidis
  misc_feature (536)..(536): N is any nucleotide
  misc_feature (687)..(687): N is any nucleotide
cgaatttgtcggcggcggcgcggcaaaatcatactttgcaaaatttaacaatttgcaggggcagaaaacaggaagctttcctttttcgtcggaaaatccttatttcaccgccttgtagccggagccggtcaaaaggcaaaaaatttacccgttttttatcggtaaagaattatcagataaaacaaatattataggaaaaatacgacaggcgggttttatcgcgcattgcctgaaactgaaaaatacaaccgttgtcaagactggagaaaatgccaaaaatccactatattgtctgccttaatttatttgaaaagactgtgtcttgaatatcaagagtggaagaggaagcgatgaatacaccgactgatttgaaagtaaccaaacgagacggaagattagaagccattgatttggataagattcaccgtgtcgtcacttgggcggcggacggattggaaaatgtttccgtgtcgcaggtcgagttgaaatcgcacatccagttctacaacggcatccgcaccgacgacatccacganaccatcatcaaagccgctgccgatttaatttcggaagataccccggacggtgatgctgccaacttactgatttagtgtatgatggtgtttttgaggtgctccagtggcttctgtttctatcagctgtccctcctgttcagctactgacggngtggtgcgtaacggcaaaagcaccgccggacatcagcgctatctctgctctc

SEQ ID NO: 727 - DNA, 264 bp, Neisseria meningitidis
ctagagatccctggaaaaacacacagccggcacacagactatctcgcctaccgcgacgcgattgccaacaaactgctggaagtccgtttcgccactcggcaaatcgacagcctcagcagcagcctgcgcgggaaagtagaaaacatccgcagactcgaacgcgaaatccgcgacatctgcctcgaccgcgtccatatgggacgcgactacttcatccaaaacttcctgcccgaaatcaccaatctagaatggattgaagaagaa

SEQ ID NO: 728 - DNA, 438 bp, Neisseria meningitidis
ggtcagcccggcaagggtcgaatatctgatcgatatgccgatggaactgttgcagaaggcggagggcggcgttttgtatgtcggcgacatcgcccagtacagccgcaacatccaagccggtattgcctttattgtcggaaaggcggaacaccgccgcgtcagggtggtcgcatcgggcagcagggcggcaggttcagaccgcattgcctgcgagaaaggtggcatgattgctgtcggcatcggtcgtccgtattccgccgctgcgtatgcagcatgaagacattcccttcctgatacaggggattgcctgcaatgtggcggaaagccaaaagattgcgcctgcctcattcagtgaataggcacttgtcgcattgcacacgttcaatggctggcgttctattcgaccaactgcaaagcgtcgttgcaacgctgttgttg

SEQ ID NO: 729 - DNA, 290 bp, Neisseria meningitidis
catttccatacctatgaaatcaatagcaggatttaagttcaagttcagctccagatcttctaagctggaggacaaaaaggcgaaaagatatgtactggtttcgcctcttgtttgcttcttgctgatcaagaacctccccgatgtattcgcaaacaaatgtgccacgcagtatatgttcacaagctcgcaatccccatccctgttgatcaatcagttggatattggaattgaatcaagacaaatgggttaaagacaataactcaaaaaggatcacaccttgctttcagttc

SEQ ID NO: 730 - DNA, 429 bp, Neisseria meningitidis
aaggggatactagagcatactcagtgaagaagcaaagaaaatcaacaggtttcagtagaaaaaaatcgaaactgggatcgtaagtttaccaggaattgacgaaacccgcgaatctcgttactctcttcgaaagccccaaacacgaaacagtcttgtcagttgctcaagctccgtgtttcctgagaaaaaacccataacctaatcaacaacccaattgttaaaaatccatctttatgagaaacaaagagaagctaaatcagagaggaaagttggttcatacctctgagtctgaccagagacgacggtagcaaaaacggaaatttgatgcgagaaagccgagagggtttttcttatttattttttagtcctttaaaccgacctttgacaaaaaaaaaacgactttgtgaaaacgggccggttcatattggg

SEQ ID NO: 731 - DNA, 107 bp, Neisseria meningitidis
tcgtggtcgaaccctacatcatccgccatgacgttccgatcggtgaacgcagcaactaccacctctccagacatatgaactttatacggcttgggcggctgcggagg

SEQ ID NO: 732 - DNA, 494 bp, Neisseria meningitidis
caaaatcgaaggcgggtttgtcgtgttactcggcgtaacgcatagcgacacagaaaaagatgcacgctatatcgccgacaaaatcgcccatttgcgcgtgtttgaagacgaagcgggcaagctgaacctgtctttgaaagatgtcggcggcgcggtgctgctggtgtcgcagtttacgctttatgccgacgcggcaagcgggcggcggccttcgttttcccaagccgcacctgcagaacaggcgcagcagctttacctgcgaacggcggaactgttgcgcggacacgggattcatgtcgaaacagggcgtttccgcacgcatatgcatgtctctaacgtgctgaagcaccaagtgaatcggttccgtactatctgtactgtctgcggcttcgtcgccttgtcctgatttttgttaatccactataaagaccgttgggcatctgcagccgtcattcccgcgcaggcgggaatctagtctgttcggtttcagttat

SEQ ID NO: 733 - DNA, 916 bp, Neisseria meningitidis
tatgcttgggacaatagcggaaaaacaccgccttgcgttcggcaaaacgggaaaaccgcaaggcgatgtcctgatacggattcggtttctgctcgtgcggcaaaacgatgttcagccccaccgaaaccgacttccctgcaaacgcgcccttgtttgccgcctccataatccccggcccgccgcccgaaatgacggcaatgcccgaatccgacagccgccgcgccagacggcaggcgaacgcataatccgcatgattctgcggcgtgcgcgcgctgccgaagatactgactgccggaaacacgcccgccaatgcttcgtctgcctgcctgcgttcggcatcataacgtgcctgctccggcacacggtttgtattctccattccatcctccgttcaaaaacagcgattgtacaccgtcaaaaacgtatagtggattaacaaaaatcaggacaaggcgacgaagccgcagacagtacaaatagtacggaaccgattcacttggtgcttcagcaccttagagaatcgttctctttgagctaaggcgaggcaacgccgtactggtttttgttaatccactatcatatagatttttatgccatttggtcagaaacagcgaagacaggcagggaaacgccttcagttccatcgcgtcttcaaaatcatcccaaacatcgctcaaattctgtttggatatgccgtattcccgtccggcaaacatcacggtctttttgcttttggcggcttttttgaatgcctttctctgtttttcgggtatctgctgccatctcaactgacggtacacgtcgtagccgtcgccccaaaaagaggcataccgttgcgtgtcttcgccgaccagcggcgcggtattcccaacccgtacatatcccgtcggcacgacggcacttgccttatatatgt

SEQ ID NO: 734 - DNA, 669 bp, Neisseria meningitidis
aactacacaaccacgatttagcgaaaggtataaaaaatgcgggtcagaatttaacatcaatgcaaacgcttgatgagcataataaaccattgatgactgcgcatttaaaacgagatacacttaatgttacattatctcgtcaaacactaatcagtattattcagtcttatgtacaacaagacagcatttatttaaaacatggcgtaactaaaatagataatagtaattcaaaagtcattcttcatttcatggaacaagaaagtgaagcctttgatttatgtattggtgcagatggcatacattcaattgttagagaagctattgatagccaaagcaaggttcaatatcaaggctatacatgcttccgtgggctagtcgatgatattcatttagatgaaacggatgtagctaaagaattttggggcaaacaaggacgcgttggtattgtgccattaattgataaccaagcatattggtttatcataatcaacgctaaagaaaaagatgtcaaataccaatcatttggtaagccacatttacaagcacgatttaatcattatcccaatattgtaagacaaatattagataaacaaagtgaaacaggcattatattaaacgatatttatgatatgaaaccactaaaatctttcgttaaagagcgtactattt

SEQ ID NO: 735 - DNA, 627 bp, Neisseria meningitidis
atatgagcgtcggagttataacgaaagacatttatacaaaagaagacgaaaagatcttagttaatacaggtgtcttacctgaagatagaattattggtgtagaaacaggtggttgccctcatacagcaattcgtgaagatgcttctatgaactttgctgctattgatgagttattagaacgtaatgatgatattgaacttatctttattgaatctggtggcgacaacttagcagctacattcagtcctgaacttgtagatttttcaatctatattatcgacgttgctcaaggtgaaaaaatccctcgtaaaggtggacaaggtatgattaaatcagactttttcatcatcaataaaacggatttagcaccacatgttggcgcatcgttagaacaaatggctgaagatacaaaagtatttagaggcgacagaccattcgcgtttactaacttaaaaacagatgaaggtcttgatgaagtgattaagtggattgaacgagatactttacttaaaggattatcataatgtctcaacaagcttggacaggtcaacttgatttaaccgtatttaataatggaagtcgttccgttgcacgtgatatcttttttggaaaagcattaaaagttat

SEQ ID NO: 736 - DNA, 128 bp, Neisseria meningitidis
aacaatcattatgaacccaaaccccttccgtttccgcctgactgcccttgacgaagtacgtatgccaatcggcgacggtcaaattgtaagctttgaccggctgctgtttgaaggtaatgttctgaacc

SEQ ID NO: 737 - DNA, 480 bp, Neisseria meningitidis
gtacggcgttaccaacctgctgctgctgggcaattttgctgccgcacaaaataaaattatcagggaaagattgtaaggcagctaattcactaacggttaacgcccgattctgttcatattgaaaaactttgcgcatatctcctgtaatacaaacggctggttttgttgctgttgtcacggatgtatttacggatatcacctgttttcggacgtaatggttcatgaatatcgttacggttacctccatttttaacaaatgccattttttctaacatttgtgccgaatgattcatatcttcatgatttgcaacgtgtggattgctttcgccatcatccagttttggaaaatgtcctattgctgatccaacagtctgatgggaaatctgcaaatgttcaggaaatgaaattttgcctttatccctcctcccgataaatatcactcggctacttatcttaggaacaccgaaatcggctgcactc

SEQ ID NO: 738 - DNA, 650 bp, Neisseria meningitidis
tcgacattgccaacagcgtcccgggtgtttcggataatatgacggacaacggcagaaccgataaagcccgcgcctactggcaacaagtgccgtctgaacagcacgaagccttccgtttccaccatatttccaccgatgaagtctatggcgatttaggcggcacggacgagttgtttaccgaaaccgcgccctacgcgccgtccagcccctactctgcctctaaagcgtccagcgaccacctcgtccgcgcgtggttgcgtacttacggcttgccgaccattgtaaccaactgctccaacaactacggtccttaccattttccggaaaaactcattcctttgatgattctgaacgcgcttgacggcaaaccgctgcctgtgtacggcgacggtatgcaaatccgcgactggctgtttgtcgaagaccacgcgcgcgcactgtatcaggttgttaccgaaggtgttgtcggcgaaacctacaatatcggcggccacaatgaaaaagccaatattgaagtcgtcaaaaccatctgcgccctgctggaagaactcgctcccgaaaaaccggccggtgtggcgcgttatgaagatttgattactttcgtacaagaccgccccggccatgacgtacgctacgccgtcgacgcagcc

SEQ ID NO: 739 - DNA, 169 bp, Neisseria meningitidis
cgcgggaatgacgaatccatccgtacggtaacctgcaccacgtcattcccacgaacctgcatcccgtcattcccacgaaagtgggaatctagctttttgagtttcagtcatttccgataaattgccttagcattgcatgtctagattcccgcctgcgcgggaatgacgc

SEQ ID NO: 740 - DNA, 170 bp, Neisseria meningitidis
gcggcagacaagaatggctcgaggcgttgcgacaggccctgcttgcatctaaaatcatttcctacgcacacggctttatgctgatccgcgcagcggccgaaagctacggctgggatttggcctacggcaccactgcgctgctgtggcgcgaggggtgcatcattcgcagc

SEQ ID NO: 741 - DNA, 126 bp, Neisseria meningitidis
atccccgaggaatctaggtctgtcagtgcggaaacttatcaggtaaaacggtttcttgagattttgcgtcctggattcccactttcgtgggaatgacgcgattagagtttcaaaatttattctaaa

SEQ ID NO: 742 - DNA, 265 bp, Neisseria meningitidis
atccccaaaatttttttgagtttctcaaaagcgatatgattagactgttgagaggtgaaagtaaaacaacagactttcaatggccgcaatttgatgaatagcagcaagctgtagcctgcatgaaacctaaaatccatgcgtaaggtgtgtgcttcagcacgcacgcgttccatgatttacggctcaatgccgtctgaaaagctcacattttttcagacggcatttgttatctaagccagtattcagcttcactatataccggcca

SEQ ID NO: 743 - DNA, 375 bp, Neisseria meningitidis
gccaacctttatcgtaaacatattcaaactgatagttcccgaaactctcgatatccgaactaaaaaagaagaagagcagagtaagaggcaatagaggaacaagtaagaacaaaaatagcaaaattttcaacttagttaacaatagttacctctcctttaaattcaatcctgaaaggtaccccttacccggggcaaccaattatagttcccatatttcaaaatatggttttaacattacttttttccccccccaagggaatgcattttaaaatcaggcttttcaggtgcaaaccgatacttaccattaccatctttaaccacagatatatttccaggtatagcccaacgtgaaaaatcggagtattatatacagtt

SEQ ID NO: 744 - DNA, 375 bp, Neisseria meningitidis
cgtatcgacatttccattaatctcggattcgctcgcgggacagagcagtgacgatggaggagcgagccagatgcgcatcgtcgccaacagatctgcaacaactgcgatcgaccaaacgcgatttgtctccgccacgtcataccggctgatccaattccgaagaatacagagagcatcatcctccaccatccgcacgagtataaagcttgtgctaaggaaggaaccattgggaggatatgtaactacggcgcttaggagccattgaacctgacggtgaataaatcgagaggaagcttattagtgtttagaaagagatggtgaggttccaatctaactcaattgatgggttaatttgttgtttctattccgaagaaa

SEQ ID NO: 745 - DNA, 573 bp, Neisseria meningitidis
  misc_feature (537)..(537): N is any nucleotide
gcgaaagaacagaagtcattgatgagaacaggtttgtcgcgtgttaaaataaacgaattttatgtaataaatactggtatctacatagagtattataaaacatgcgtgtgattaatctacgtaggtaagcagcaaattcagtcaaaagaagaaacatcatcgaccatctctagtgaattactgaaaactgaagaaattatctcatccccgagtcaaagtgaaccgtggactgtacttgctcataagaagcctcagaaggactggaaagcttacaacccaaagacaatgagacctccccctctaccagagggtaccaaatgtgtgaaagttatgacttggaatgttaatggactgagaggattgttgaagtttgagagcttctctgctctgcagcttgcccaaagagaaaattttgacatcttgtgcttgcaggagactaaactccaggtcataactttagacccttcttaagttgtttctgctctatattttaaacacagccaatctagaaatctcttgtactaaagacatacgcanacttatgacaggtgaaagatgttgaggaaattaaga

SEQ ID NO: 746 - DNA, 292 bp, Neisseria meningitidis
ttgctgttcaagctgtttttcaagattctcgtaatattcgtacatataataagggtctttgtacggtttgaatgcggtctgttcatgaatggcttgagctttcaaaaaggcgcagtcgtacgcttcgggagccaaagacttggtcagcttgtgatgactctgctcaatcagttcaaacagtttggctttgtccaattcgggaaaaatgaatttcagaccgtttgccgcacgtccgaactgtttttttacccattcacagtatctgtcggctgaaatcgacttatcttcctta

SEQ ID NO: 747 - DNA, 208 bp, Neisseria meningitidis
ggtaatgatgaatgatagttttacaaaagtttcggactacaatttatacgtttataataataacaatatccatcaaaaaaatgtgatttttctttttttaaaagttgcatcttgccattcttgtaatcacattcgtaatattcagcatttttcaaatctgaatcaaatagatattgaggtaaaacattcccttccttatctagttcta

SEQ ID NO: 748 - DNA, 502 bp, Neisseria meningitidis
  misc_feature (452)..(452): N is any nucleotide
  misc_feature (483)..(483): N is any nucleotide
ggcgcgggacccatgctttggatgcggtacagccgtcgcgttatgttttggggttcggatacgaccagcctgaggggaaatggggcgcaaacattatgctgacctattccaaagggaaaaaccctgacgagcttgcttatctggcaggcgatcaaaaacgatattcgacaaaaagagcgtcgtcttcttggtcgacggcagacgtttccgcctatctgaatctgaaaaaacggctgaccttgagggcggctatctacaatatcggcaactaccgctacgttacttgggaatccttgcgccagactgcggaaagcacggcaaaccggcacggcggcgacagcaactatggaaggtatgccgcaccgggcaggaacttcagtctcgcgcttcgaaacgcggacgttgtccgcagtggagcatatggacggcataatcgtttaaaacggtttggngaaagtgtgaaaccaatacgtcgcaaggtancagcaagctgtcgcgttct

SEQ ID NO: 749 - DNA, 525 bp, Neisseria meningitidis
tatctgaaagtccgagattctacattcccgctttcgcgggaatgacgaaaagtggtgggaatgacggttcagttgctacggttactgtcaggtttcggttatgttggaatttcaggaaacttatgaatcgtcattcccgcgcaggcgggaatctggtatttcaatgcctcaagaatttatcggaacaaaccaaaacccttccgccgtcattcccacgaaagtgggaatctagaaatgaaatgcaacatgaatttatcggaaatgaccgaaactgaacggactggattcccgcttttgcgggaatgacgggattttaggtttctgattttggttttctgtttttgagggaatgacgggatgtaggttttcttaagcctgcgtcctagattcccgcttttgcgggaatgacgggatgtgggttcgtgggaatgacgttgtgcaagtttccgtgcggatggattcgtcattcacgcgcacgcgggaatccagaccttattgcaacagcattattcaaacattatctga

SEQ ID NO: 750 - DNA, 251 bp, Neisseria meningitidis
ccctgcaataaaaagattccgtttttcaaataatattcgaaactctggcgtttttttccactgtcgaaactccaatagactttttgcggaagaccgtccgcatcatagccgaccacaagactgttcgccttcatccctcggggcatcacttcccgcatactctgataatccacagaattgcgcgagtccgacgcagttcggttgctctctttgcggaagtcgcaaaccttctgctcgtcattcgcgacatc

SEQ ID NO: 751 - DNA, 603 bp, Neisseria meningitidis
caggtcaaaaaccttattgcgtctggctttccgaaatcatgctccagcaaacgcaagtcgccaccgtgttggactactatccgcgcttcttagaaaaattcccgaccgttcagacgcttgccgccgcgccgcaagacgaagtgttgtcgttgtgggcgggcttgggctattacagccgcgcgcgcaacctgcacaaagccgcgcaacaagtcgtcaggcaattcggcggcacgtttccgtcggagcgcaaagacttggaaaccctctgcggcgtaggcagaagcaccgccgccgccatttgcgccttctccttcaaccgccgcgaaaccattttggacggcaacgtcaaacgccggtagcgtccaaggcgtagtcgtccaaatgacggcaaacgctttgccttcgaaaccagccaaaccgaatgcggcggcaagcgcggcagtgtctttaaacagataggcaacgtcaatcgcgggcgagattttgtctttgtattccacttccgcttcggccagcgaagaaccgcagtccaagcagaattgaaccggtttcgcaccccggtagagatagccggatttgtagatttcgccgagcatacgcacg

SEQ ID NO: 752 - DNA, 642 bp, Neisseria meningitidis
gtcgactcatagaggatccacgaatctagaccttagaacaacagcaatattcaaagattggcggattcgcatttgaagtgcaactttccctaacagaaaaaggccagtatgcggtagcatacggcctttcctgcaagaaagattgccatgagctacacgcaactgacccaaggcgaacgataccacatccaatacctgtcccgccactgcaccgtcaccgaaatcgccaaacagctgaaccgccacaaaagcaccatcagccgcgaaatcagacggcaccgcacccaagggcagcaatacagcgccgaaaaagcccagcggcaaagccagactatcaaacagcgtaagcgacaaccctataagctcgattcgcagctgattcagcacatcgacccccttatccgccgcaaactcagtcccgaacaagtatgcgcctacctgcgcaaacaccaccagatcacgctccaccacagcaccatttaccgctaccttcgccaagacaaaagcaacggcagcacgttgtggcaacatctcagaatatgcagcaaaccctaccgcaaacgctacggcagcacatggaccagaggcaaagtacccaaccgtgtcggcatagaaaaccgacccgctatcgtcgaccagaaa

SEQ ID NO: 753 - DNA, 551 bp, Neisseria meningitidis
gcgggaatgacggcaaagtggcgggaatgacagatcgggcattccttaaattacccgtgtatcgctgtaaatcttacagatggcggcatatagtggatatccgcaaaatcggcgcggaaacaggggtaaccaaaatccacctcaacgtccacgtcaaccacgaccgtgccgacgcgcaccgcctgtatttcaaaaacggttttgaaatctgcgcataccacttccgttgcgaccccaaatgaaaacccccctccccatctgcaccctgtcggcactcgccgcctgcaccctttccggacaaggcggcagcagggtttacggcgaaatcaaagcccgagacctttgcgttaccgctcctatcctgctttctgctttctgtcttgcctgctctcgttgagccaagcgttcttgcaagctcgcttgcacgttggcaagcattgcactctatccgctttcttttcctgttgcggctggtggttcaggctcgcgttgtacgctttgcactaaagcgcaccgtgaatcgatgctcgctatttattctatcaatattt

SEQ ID NO: 754 - DNA, 780 bp, Neisseria meningitidis
ttgggaagttgtccgtgtcggacacgttttgtgtctgaccgttatgtagaagggcaaaaatgataatgaccgccccgttgcgttttggagaagagggtaaaggcagaaagcatatgccgtctgaatgatatttcagacggcattttatattgcggcggcactcagtccgtgtcgctttcaggcaactctgccgaacccatgcgtttgagcacgatattggttttgttgcggagccgtttgcttttcggatggtcggcgtagtagagcggggcggggacgcgcgccgtcagttttgccgccgttcaaaaagccaattccggccaccccggcgcgcctatgggtatggcggaaatggcggaaacattgtggacgaaattcctcaatcacaaccccgccaaccccaaattctacaaccgcgaccgcttcgtcctctccaacggccacgcgtctatgctgttgtacagcctgctgcacctgaccggctacaacctaagcattgaagacttgaaaaacttccgccaactgcacagcaaaacccccggccatcccgaatacggctacaccgacggcgtggaaaccacgaccggcccgttggggcaagggattgccaacgcggtgggtatggcattggcagaaaaaatccttgccgccgaatttaataaagacggtttgaacatcgtcgatcattacacctacgtctttatgggcgacggctgtctgatggaaggcgtatcgcacgaagcctgttcgctcgccggcaacttgggcttgggcaaactg

SEQ ID NO: 755 - DNA, 413 bp, Neisseria meningitidis
aaaagcgggagctccaccgcggtggcggccgctctagaactagtggatcccccgggctgcaggaattcggcacgagaagggacttattacattggtacagacatatttatgctttcttccatcaccaaccactaaacccctttggaggaatgaaataactgcataaactagtcaactgaacactgggccacttacctcaatgttatacaaagtcctggatgatttgattctgaaccacagcctttgcaggagttgggggaatcagatttgctcatgaagacatccctttccacttttgtcatgggcagtaaatactatagtttacaatgcctaccaattagcaaaggatcattcattcagctactcagttcctctgtaaaacaggtctatgtatgtgcaattcagctaagatc

SEQ ID NO: 756 - DNA, 532 bp, Neisseria meningitidis
tacgactcactatagggcgaattgggtaccgggccccccctcgagtttttttttttttttttttttctgtattgaaactttattacaaaattataaagcagagctctgtaacaaaataatacacatttgggtttgctttaacctccaagtaagtctgagaaaatcttaataaaagccacttgaagtaacaattcacatccaagagatttccacaaatttatacaatgtatattgagcactagttcctgtacagcttattcttattagtttggatccaactattccaatgtattatgaaccagtcagctatctgtcttttgaaacaagtcttaactgaaatctcagagtaatcagcaaaagctacggaataattctaagaattagatgtttccatatcattaaaaccaaggatccatgaggggcagaagggaggattcaaagatttaaaaaaaatcaaattttagaccttggttaaatattaactggaatgggatcttggaactcccaactttaatttggtgtaataaaaatg

SEQ ID NO: 757 - DNA, 385 bp, Neisseria meningitidis
tgtttccctcttgacaacggacgttagcacccgctgtctgtctcccgaggaaccacttgatggtattcttagtttgccatgggttggtaagttgcaataaccccctagccataacagtgctttacccccatcagtgtcttgctcgaggcactacctaaatagttttggggagaaccagctatctccgagtttgtttagcctttcacccctatccacagctcatccccgcattttgcaacatgcgtgggttcggtcctccagtacctgttacggcaccttcaacctggccatggatagatcactcggtttcgggtctacacccagcaactcatcgccctattaagactcggtttccctacgcctcccctattcggttaagctcgct

SEQ ID NO: 758 - DNA, 411 bp, Neisseria meningitidis
gctcggctcatggaaacgaaatacatcgtatctgcactcaaatatcgccccgattcttttgcctcgatggtcggtcaggaggcattgtccgctacactcaaaagctccatcgtacagcaaaagacagctcacgcctatctcttttgtggcccgcgtggggtgggaaagacctcttgtgcacgcatcttcgcccgtgccatcaactgtctggagcggttgccggatggagaagcttgtgggcgatgcgagtcgtgcaaggctttcgatgagcagcgatccatgaatatatatgaactggatgccgcttcgaacaattcggtagatgatattcgtctcttgatagagcaggccaatgtgccgccacagatcgggaaatacaaggtctacatcatctacaaggtacaaatgctc

SEQ ID NO: 759 - DNA, 486 bp, Neisseria meningitidis
gaatcaatggagaaagtttgatccgatgagataacggtcgtccaatcgaaaagtctgagcctttcataaatttcatctgtcgtcttcgcatggaaagttattacaggtttcaatatgcgcagtgctgtacgcaaccggagattagcaagatagagcatcctcttatctcctcgaaaactgaccatacgccggccgacggttacctcctcagcacccaaggctgttagttcggcagccaagacatcctccaacccataaagggtcttagctaccatagtaaattggagatcgttattcataatagtccatgattatggaacaaagataatgaaatacggccgcagtttatggctttttgagacctgtacggaagtgtgtagattccagctatcaaggctcgcatttcagccactaacgtacatctaaagctcatgatgctacgctcggttatcaaacaagtacgaatccatatatcagagattcaat

SEQ ID NO: 760 - DNA, 445 bp, Neisseria meningitidis
  misc_feature (286)..(286): N is any nucleotide
gtactgcttatagagatggcttcctgttttcgtatagccccttggatggcaacgatacggtctttaatgcttctctgcttggagcgcgtctcttgagctattgctaccattataccaaagacgaagcgtatcgcacgcttgcgcgccaaacgatctcagcttgctgtgctgcacaagccgaagatggttcgtgggtctatgggatgctacccgtgcagtcatggattgatagcttccataccggctacaatttggatgcactgattgcctatcaagagctaacggnggacatttcctttgccgagaatatagagcgtgggttgtcgtattacttagagcatttcttcgaggcagatggtatgcccaagtattatcacgatcgtacttatccaatcgacattcattgtcctggtcagctcttcgtgtcgctagctagacttcatcg

SEQ ID NO: 761 - DNA, 429 bp, Neisseria meningitidis
  misc_feature (348)..(348): N is any nucleotide
ggagcgggcgcagttcctccctgcgctggacgaaaatagcatgaacaacctctcggaaaacagcctgaacgaagagagtcgattgctttgggacggctcttcggattgggcagaggcactgaccaagaggatccgccatcaggatcgcttcccctatctgatgcttcgttttatcgaggagatggatctgctcaagggtatacgctttcgtgtcgatttgggtgaaatcgagctggattcttactccaaaaaggtaggccggaatggtgagtacgatcgcacgataacggatcatgccttggcattcggcaagctgtcagacttccagaatgaagaagaggtaagtangatgatcagtggagaagcgtcttatcccgtacgcttctctctctttgctccccgctatgccatatacgacaataagatagg

SEQ ID NO: 762 - DNA, 465 bp, Neisseria meningitidis
gaaaatacagccttttcgtttttaccggtcaaaataaaatcttctgaatactgtcccataatcatatttgttaatggtcaaatataatgaaagaatgttttgaaaaccaatatgaactgttgcatgggagtttcattgagctcttttgctgcagagcagattcttagtgtcttcgggaaaggtcaaacctccggtatatgggcacaccaagcaaacagaaattttcccaagtttccattagagaagtactcctttcctcgtcaaataggcgagaaataagaaacgattgtcagctgattcttgcttcctgcatgatgcaggacgcgattgtcagctgattcttgcttcctgcacgatgcaagacgcgattgtcagttgattcttgcttcctgcacgatgcaagacgcgattgtcagctgattcttgcttcctgcacgatgcaagacgcgattgtcagctgattct

SEQ ID NO: 763 - DNA, 1018 bp, Neisseria meningitidis
attccagagtacttaactacggttttaaatgtacctttttatttgggtggcacgtctttgttgattctagttgttgtaacgatggattttagtacacaaataaattcgtataggcttactcaacagtatgataagttaatgactcgttcagaaatgaaatcattttctcggaaatagaattatggcgaaagaagatactatccaaatgcaaggtgaaattcttgaaactttacctaatgcaacatttaaagtaaaacttgagaatgaccatattgtattgggtcatatttctgggaagatgcggatgcattacattcgtatttctccgggagataaggtcacagtagagctgacaccttatgatctaactagggctcgaatcgttttcagagcaagataaaccaataaaaggaaaataaaatgcgtgtacaaccatctgttaagaaaatttgccgaaattgcaagattattcgtcgaaatcgtgtagttcgtgtaatttgtactgatctcggtcacaaacagcgtcaaggttaatggaatatttcttgtaatgtgattctgtgatatagtgacacactttgccctaaaaaggaaaaaatatggctcgtattgcaggggtaaatatccctaataacgcacacatcgtaattggtcttcaggctatttacggtattggtgctactcgtgctaaattgatttgtgaggctgcaaatattgcgcctgatactaaagcccaacatcttttgagcaacagagcccgttgatagccacagctgtgtatggttaaaattctgcccagaatcagaaagaagagcgtacattttggagagcagtcgacctctaagattttcaggaagacgttttgttatttgttcgcaaaaacttctaacaaatggacactcccacataatatgtcaacgtgttcccatttgattcaaattaaatagggtacagtttggagaataggcctatttgaataaaaagtatgctccttagatttgggattgtgtgtcccggg

SEQ ID NO: 764 - DNA, 415 bp, Neisseria meningitidis
acactgatgttaccgggcatcttgctccagttataggtctcaccgaatgtgcctgaatagtgggtatgcgtccccgtcatatcatcgtagtagtcatattcgccggaagccttctccggccacttgtagtgacgcatgatttgtcccatggcagtggcaacacaaccggtataagcctgctgcccggaaggaagcaggggatgcaaggtgttaaatggatagccctgatcccacaagatcggatccgatgcatgttcgcccgtttccaaaataggggcaatggatgatggcaggtcccgtgtaggcttggcttcacggataggatctatcggctctgccttgccgtccattacagcaggcatttcacgttcataacctttgtgccaccctctgatattgtccggtatacgggccg

SEQ ID NO: 765 - DNA, 451 bp, Neisseria meningitidis
gaaaagagagcttcatgcgatctctctgcaaacctcaagtaatctgaaaaacacttaagaatcagctctgcggcaaaagacttcaatgaaagtcctataaaatagttgcaaatagctgatagttagcgcattgatgggagcagaatcagctgacaatcgcgtcctgcatcgtgcagggagcaagaatcagctgacaatcgcgtcctgcatcgtgcagggagcaagaatcagccgacaatcgcgtcctgcatcgtgcagggagcaagaatcagctgacaatcgcgtcctgcatcgtgcagggagcaagaatcagctgacaatcgcgtcctgcatcgtgcagggagcaagaatcagctgacaatcgcgtcctgcatcgtgcaggaagcaagaatcagctgacaatcgcgtcctgtatcgtgcaggaagcaagaatcagttgacaatcgcgtcc

SEQ ID NO: 766 - DNA, 518 bp, Neisseria meningitidis
cactttcacttatacataccccgttaaataagttaagagggaaatatgaaaagtgtagtaacaaagcaggccctcatcggcctgcttttctttagtataagtatatactcccatgcggccaaccctccggcccaacctaccgacaccatcgtatccggcaatatcgcacttgaggatatagtggtgaccggtagccgtacagcccgtctgcttaaagatgtacctgtccccacaaaggtgttcaaggccaaagatatcaaagctatagccccatcttctttcattgacgtactgcagtatattcttcccgggatcgagtttaccaagcatggttccagagatcagctcaatgctcagggatttgacgaaagttctattctcttcctcgtcgatggcgaattgatttcaacgggatctaccagtggaatagacttcgaacgaatcaatccggatgacatcgagcgaatcgaagtgcttcgtggagcttcctctgctttgtacggatctaatgccatcgg

SEQ ID NO: 767 - DNA, 561 bp, Neisseria meningitidis
gaatggagcaaatgaaaaagcgattctctggcaatgtccaaatgcatctcaatttggacgaatgcaggaatgagttacttgtacctgttttaagtgctgagatacaaatgcaggttaaagagctgtttgaattatccatgcaaaagtcgacagagggaatatccctctactcctctgctgagagctatctattggcgtgcttagggatgcaagactttgtagccaatatagatgcttacaacgtaaagacactcaaagagagcttccttgaaagtggacgcattgatgcagagtattatttgcctaagtatgaggattacatcaatgcagtatcggcatacactggcggtgtcgctcctcttggtgaggtctgcaccattaaagacagcaactatacgccagaatgtgatatgaagtatcgctacattgagttggctaatattggcaagtcgggcgacattacaggctgtttgtacgaaaatggtgaagacctgcccacacgtgcaaggcgtatcgtaacccaaggcgatgttattgtttcatctatagaggggtctttga

SEQ ID NO: 768 - DNA, 575 bp, Neisseria meningitidis
atcgagtggttgcaggtggaaatacacgtttcgcctctgttcggaatggattgcaggttgtccctgatggtgttttggttgctgttcatgacggggtacgtcctttggtcagtgctgaaactatcgatgcctgtttcgatcttgcagagttgaagggggctgtcgctccttgtcgccctatgaccgaatcgcttcgctattatgccactgatggcaattatgcagtggacaggagtcggtacgtcacggtacaaactccacagacctttcggagcgaatggcttcgagaggcctatcggcaaccctatgaagagtattttaccgatgattgttcggtatatgaacaccattttggccgaccggtggcattgattgtcggtaatatcgaaaatatcaaattgactactcctctcgatctatcccttgccaaactgttattgacatcctaatacctaaaaaacataagttacatctccacattgtggaagaatacaagacaaacttaatcgaagacctcgaaaagggctagggcaactaacgccatgccaagttttagaactaacttagctactcaa

SEQ ID NO: 769 - DNA, 600 bp, Neisseria meningitidis
ggcgtttcatcatctcatgtgccctcgatgtaagcacagtgtatataccaccctgcttattgcaaacctcccagctcgtctccagcaagagggaagggttggggcgaaaatcattcattcgatcgcaattcgtttgggaaagttttttccggtcttatcctccgaccaaccgccatacaaaggccacggctacggtcacaacgaaacctgtggcaagcggaatcaaggctgccagcagcgtccatttccggctccccgtctctttatatatgttaaacagggtggtgctgcaaggattgtggagtaggcagaacagcatgagattgatacctgtcagcatagtccaaccgccggcttcgaacagtcgtgccgtttcggctgtgccatcggcttcgaacatgacgccggcaccggttcctccatctattcccgtagtcaggacagtcagcatcagtatcgtcggtatcactatttcattggccggaatggccaatacataggccagcagaatgacaccgttgagtcccatcagccaaccgggtccgtccagcaggtcgatcagatattcggctatcccgactccaccgatttggatgttgc

SEQ ID NO: 770 - DNA, 594 bp, Neisseria meningitidis
gacggacgtatcattttcataggccccctgctaacggagcaggaagacttacccaccgattttgagaatacagtccctgccatcttggaggactggcatcgtgatgcagcaccctcgctggacttgcgatatgtgtgcggcagctggcgaactcccggttctccccctgtagtactggtggacttcgaacccctccatgcacagaaagcaacgctctactatgagatgtgggagcacttcggcatccaaagcgacaaggggtacggcgactatgacgaggcctcgctcttcggcattgccgcagcccaaacgatgcatagcctgtgtgaatacctctgccccgaagaccaaccggccataggtatattcaacgaatggatgctcggcatgggactcctctacagcaagcggaaaacacctcgtctgaaaacccttttcctcacacatgccaccaccacagggcggtctatcgccggcaataacaaagctctgtatgcctacatgccgggctacaacggcgatcaaatggctgccgaactcggtgtagaagccaaacacgggatagaaaaagcggcggctcaccaatcggacacc

SEQ ID NO: 771 - DNA, 535 bp, Neisseria meningitidis
gacttcacggttgttttcgaagaaacgcctaacggaataaataagggcggagcaagattcggtctttccacggaagccaatggcgccaaacctcaaagtgtatggatcgagcgtacggtagatttgcctgcaggcacgaagtatgttgctttccgtcactacaattgctcggatttgaactacattcttttggatgatattcagttcaccatgggtggcagccccaccccgaccgattatacctacacggtgtatcgtgatggtacgaagatcaaggaaggtttgaccgaaacgaccttcgaagaagacggcgtagctacgggcaatcatgagtattgcgtggaagtgaagtacacagccggcgtatctccgaagaaatgtgtaaacgtaactgttaattcgacacagttcaatcctgtacagaacctgacggcagaacaagctcctaacagcatggatgcaatccttaaatggaatgcaccggcatctaaacgtgcggaagttctgaacgaagacttcgaaaatggtattcctg

SEQ ID NO: 772 - DNA, 258 bp, Neisseria meningitidis
ggccgatagatttctgcggatgaataagaccgagtgcctttcgcgaatttgcggtaatgcccattcccagaatttcaccggcaccatttcggccatgtcacagcggcatccatcgattcctttgcttgcccaaaagagcagaatatctcgcatccgaatccacgtgtccggtagaggatcgaagtgtttgcttcctccattcaggtacacgatgccgtacttcaatttcaccgtttcgtaccaatcctccttatcgat

SEQ ID NO: 773 - DNA, 436 bp, Neisseria meningitidis
gagtaagaacaaccggtcgagtagctgctgcccactatccgggcggctaaaaagcagatcggtcagttcatcgccccaaagtctttcctccggtacgtagtactgcttgggtacctccctattccagaggagatcacgcgaatgatctgtcaataagggagtgagaagaacactattgagcaagtcaagaacagcatctgtccgaaaatgaggaactttttgaataagacggatttctgcctgtaccctgatccacttctcgacaaaaatggaaatggcactttgagagagagggatagcccatagtcacattgatacgtcctacagtctcggccagactgttcaatacgggcatcaacattcctgtatcgggaagaatgatagctgtttctattccttctttggtcagaatagccttcagggtataactcctcga

SEQ ID NO: 774 - DNA, 521 bp, Neisseria meningitidis
cactttcaatactcaattcattctggcctggctgttgatctttttgggtattgtcctgtttggacggttggggctgctgctgtccgccctggttattgttattcggattgttttgccgttgttttttgtcgtgattactctccttattctgatcctgattgtctcctcctccttgctgttgctgtttctgaagcaacttcatggtcaaagccagattgtaacgagtctcttcatcggtcgggttgattcggagcgaatgcttataggcctccacactctgccgatagtctttctttttcataaaggagttgccgagattgtgcatcagttcggctctacgcttaggtgtcaatgtcgggtcttgtacaagagcagcatagttttggagagcttcatcggtgcggccttgtgcatactgtgtaccggccaaaccgaatcgtgcctcggtgaaagtactgtccttggagagagctttgcgatatgcgacctcggcattggcatattgatggcgtcgatatact

SEQ ID NO: 775 - DNA, 538 bp, Neisseria meningitidis;
gggactgctttccgacttgaaaaagaaagcaaagaggatggcgatgaccaatgcataagctgcgaaaatataccataccgtgctccaagccgtatgaccggcatccgtaaagcgatctaccacccaaccgctggcaaatccgccgatgatagctccgataccattggtcattatcataaaaaggccttgagcagctgcccgaatcgatggtgtagtctctcgatcgacaaacatggaaccgctgatattgaagaaatcgaaggccataccatatacgatcatcgacagaacgaggaaaatgaagccgctacccggattgccgagaccaaagaaagcgaaacgcaacacccaagccaacatactcataagcatcacccgtttgatcccgaagcgccccatgaaaaacggaatggtcaaaatgaaaagagtctcggaaatctgcgacaaagaaagcaacacattggggtgctgaacggcaaagctctcgctataagcatccgcaaaatgagacaaaaacggattgccgaatgtattggtg

SEQ ID NO: 776 - DNA, 524 bp, Neisseria meningitidis
gtctgcggcaggtatgccaacaggattgcccgcggttctttctccatagacggcagatgctacagcctgccgatcaacaatgggccgaactctctgcatggcggcatcagcggatttaatacgaaggtctgggaggtgaaatccgccggcccctcttcgcttgtgctggaatacgtgtcggcagatggagaggaggggtatccgggcgagctggtcgttcggatcatttacagcgtcacggatgagggcgcattgcacatagactatcgtgctactgcggatgctcctacggttctgaatctgaccaatcactcctatttcaatctctcgggtgcaggcgatccctccgtgcatgatcataccctcatgatacaagcccggcattatctccccacagacgatacggccatcccttacggcgagcctgccgaggtcgaggggacgccgttcgatttcctcacgcctcacggcataggggatcggatcgacagtgcgatggatcagctcatttgggcaaagggata

SEQ ID NO: 777 - DNA, 398 bp, Neisseria meningitidis
ctctcctatcgtcagtccatgaagaataggcagcggatccactccgacaaacgaacggcaatcatcttgtaagatgggaccatccacgtagtcgttcgggttcggccgatcagtaacgatcagctttttctgctcctcggcacaagcctccatcacatagtgcagcgtactgatataagtaaagaagcgagtcccgacatcctgcatatcgaatagcagcacatcgacgtcggccaacattcgaggagtaggtttcttgtttttgccgtagagcgaaacgatagggattcccgtcctgacatcccgttcatccttgaccgttgccccggcatcggcatctccacggcagacgtgttcaggacctaggatcttgcagacattgcatcactgccgaggca

SEQ ID NO: 778 - DNA, 606 bp, Neisseria meningitidis
ccccccgctttctctacataaaattacattttgccgatatttgccgaattgtctgaaaatatgtgtaataaggggcgtataatcaaaacatttgccccggattgccatgccttatttcgccctgtttgacgatgccgtaagcggccgcgcaaaacgctatcaaaatcatgtggaaagccgttttttccgtcccgaagaactcgatgctttggacggcgcgctgcaatcgggctggcaaaaagggctgcattcggtgttgtttgcagactacggattcggtttgccgctgacgggggttgagtccgaacgcggcggcaatcttgccctgcactggtttgccaactgcgccgacatcgatgccgaaagcyggcttgcccgacactcagatagcctcatgcgtgggccatcgacatgcatgagttaagcgtatcgctagcgttcatcctgagccaggatcaaactctccactgtcatatttgtgtttgtttgcttctgtttttctcgctcagacgccgattattaccctttggataattcgatttatcaggtagtacacctcggtttctttttctctctcggtcttttcgtttttcctctttgacaaag

SEQ ID NO: 779 - DNA, 255 bp, Neisseria meningitidis
gctggttcaggctctcgcccattgaccaatattcctcactgctgcctcccgtaggagtctggtccgtgtctcagtaccagtgtgggggataaacctctcagttcccctacccatcgtcgccttggtgagccgttacctcaccaacaagctaatgggacgcatgcctatcttacagctataaatatttccttgtaatatcatgcaataatataagtgtatgcggttttagtccgtctttcagccggttatccccct

SEQ ID NO: 780 - DNA, 400 bp, Neisseria meningitidis
  misc_feature (284)..(284): N is any nucleotide
gccgactgccacggtgccggctgtcgggtgacgatcggccgggccgaagtcgggatgccagtcggcttcgtgtatcttctctgccatgccttcgaactcgcctttgcggatcttggccaggttttcacggtggggagcggtagccgatttctcatagaggaatacgggcacgccgtacttctcgcctatcgtgcggcctacctccttggcgagggtgtcggcgtcttcggcagtcacattcttgatggggataaaggggatcacgtccactgcgcccatacggnggtgctgacccgtgtgtttggtcaggtcgatcagctctacggctatgccaacggcttcgagcactgcctcccgaaggggctcgggttcgcccactacggtcacgacgagacggttg

SEQ ID NO: 781 - DNA, 433 bp, Neisseria meningitidis
cccttcgtgaggaaaagaccggtggattccactacgtattccactccgacttgatcccatttcagatcggcagggttcttctcagctgtaactcgaatggctttcccgtttactatcagctgaccatctttgacttcgactgtcccattgaaacgaccgtgtacactgtcgtacttgagcatgtacgccatatattccacatcgatcaggtcgttgatggctacaatttcaatgtcgcttctgttttgtgtttgtgctgcgcggaataccaagcggccgatacggccaaagccgttaatacctactttcgtcataactaagtgcttatattttaatgttaaccattattgttttgtccggaatactttgcttttccccccgaaaaggatccgcagagattcttcccgatagacagcgttccaatgaccttgct

SEQ ID NO: 782 - DNA, 374 bp, Neisseria meningitidis
  misc_feature (331)..(331): N is any nucleotide
taaatggatgacccggcttttttgttccggtggttgatttctcatcggtttcaaacaagaagaaagagtccgactctctatttacttgtatggattcagagaaaaatcagagaaggccttcgtcagcgaaactgaaatatgccccatcgtcaccgatgatcagatggtcgttcagtcgaaatccgagcaatgtggcagccttttgcaccctttgagtaagctgaatatcctgttcacttgggcgtaccgttcctgaaggatgattgtgtgccagaatgattgccgaggcaagatgagagacggctttgtgcatgatcagacggacatcggncgaagtctccgatacacctcctcggctaaaggttctcatgctg

SEQ ID NO: 783 - DNA, 403 bp, Neisseria meningitidis
gtacttcgaagaagcatccggcggcacgatctttctggacgaagtgggcgaactgcctttgcccacgcaggcgaggctgctgagggtgctggagacgggcgagttcatccccgtaggagccagccagtcgcagaagacggatgtccgtatcgtagcggcgacgaatgtgaacctcaaggaggcggtagcgaacgggaagttccgggaagacctcttcttccggctcaatacggtaccgatcgaggtgcctgcgctgcgtatgcgaccggacgacgtgcccttgctttttcgccgattcgccgccgacagcgccgagaagtatcggatgcctctgctgcgcctatcggacgaagccgtaccatattaatgcgttaccgctggcccggcaatgtgcgacagctgc

SEQ ID NO: 784 - DNA, 441 bp, Neisseria meningitidis
  misc_feature (290)..(290): N is any nucleotide
  misc_feature (328)..(328): N is any nucleotide
  misc_feature (345)..(345): N is any nucleotide
  misc_feature (390)..(390): N is any nucleotide
gccattgtggacgaactctaccggcttgccggtatctataatacctgtattatctgtgtactccattttgtcccgaacgggattaaactgcgtgggcatatcggttcggaacttcagcgcaagtcggcggccatcctctccatagagaaagatgagaatccggctttgtcggtcgtaaaagcacttaaagtaagggatggaagcccgttggatgtacctttgatgctgttcggatgggacagggaaaaggaaatgcacgtttaccggggagagaaatctccggaagacanagaaaaacggaaacttacggaattgggacaaatcgcanaagaagtctttcacgcncaagagcatttatcttacaacgaactggtcgaaagaatcatgcanacggtcgacgtcaaagaccgtacggccaagagttatatcagttatatgcga

SEQ ID NO: 785 - DNA, 360 bp, Neisseria meningitidis
cgtgcatatgtgtcggagaacggcttgcgtcatacccccgaacgatacagcattcttgaagtcgcatataatctgaagaagatattcacgccggacgacttgttcgatctcactcgcgagaatggcttgcctgtaagtctttctacggtctataatacccttaccttgctcgaacgctgcgggatcgttctgcgtttgccttctcccgaaaccaaatatcagtacttgatggcttcatttgcagagcagtgtccgctgcttttctgtaccgaatgtgcacaattttctacctactaccgacgaaatgtgaagtcgatactggccgacaaggatctcagaccaccacgcttctcttatagg

SEQ ID NO: 786 - DNA, 339 bp, Neisseria meningitidis
gcacacctcctgcgcgataagccttgattatcgcctgacggattttttccggatcgaacgactgcacatgaccatcacgctttacgatgcgaaggattacctcttccattgtaatacgttattgtaaaaaaatacttcctgagatctattctcttagtgccggggagactcctttcctcgaggtcttctctccatactttataggcaactcgtagaggcaggtattctggcttacttcatctcttttctgtttgtcgcgccttcccattcagctccacctctaatagtggagaatgaacagtggcatcatttggaaagcgacaagagtccgcatgtcaa

SEQ ID NO: 787 - DNA, 375 bp, Neisseria meningitidis
  misc_feature (346)..(346): N is any nucleotide
gtaggcagggggatccccctcaaatcccaaaagtcttgtattggagcgactcagctctcatactaaaaactcccccctctaagcaaacatttaggacactattgatttgatagcggtttttctatacaaacgatgatcccggccccctgcttgaaactgaattttgacacaccctcttctggtagttggggttaatttaggccttgcgtttttttctgcggaaaggttgccgtctttaaccataaagagatgagactttattgaaagagcatatcggacgagatcggcttgaacttttcttctcccttgagccgtatcattaccctgctgtagttccaataagtangccagccaccttgtatggctccgacccat

SEQ ID NO: 788 - DNA, 438 bp, Neisseria meningitidis
gtatggtttgagtgactacgaggttgaggagtgcatcaacgactccttgcttttcagtgaattccttggcttggacctcggcttcccttcccccgaccatagcacgatcagtcgtttccgtagtgaactcactcgcttggggattatggataaactccttcgggagctgaacaagcagttcaagaagcacggcatcagccgtatcgatcaaggcgccatcgttgatgcgagcattgtggatagtccttacgcccctgatggcaacgtggtcatagaagtggctgaagatcgagaggatactcgttcggaggaagctcgtacacagccaggaggcttatcattgtgaactcaagagtggcaaaccgggagtagactcggaggctcgttgggtacgcaaaggcaggcactatcggtatggatacaagaagcacgtcttga

SEQ ID NO: 789 - DNA, 272 bp, Neisseria meningitidis
gttttggaatataatatcgaagttccggacagaatagtccgttttaccttcctgtatcggcatagcatccatctctctcacccgatcgatacgtacatcgaggtactgcaagagtagcaaattgctgaatacttcacttatgggattatatatgctcgatccgataagcagaaagactaaataagtgaatagatcaattgttccttctgacaagagataagctcccattatgattacagaggcaagtcccagtttgaggattatatgtgaag

SEQ ID NO: 790 - DNA, 448 bp, Neisseria meningitidis
  misc_feature (433)..(433): N is any nucleotide
gctcacagctctatgagatggagctacagcgccgacgagctgcagaggccaaagtggaggccggcaagaaaaagatagagtggggatcgcagattcggagctatgtattcgatgatcgccgtgtgaaagaccatcgtaccaactatcagacgagcaatgtcaatgccgttatggatggcgacatagatgaatttatcaaggcttatctgatggaatttgccggtgaagaggcgtaatcgactttcgcttctgaaggaagggattcgttgatcaaaggaaatggggcaggcttgtattggcagtcggcccatttcttttttgtgggaagtccggaaatgtcgccggtttatcggctcatatacaattatacgcagggttattgtatctcatgtcctttcgggtagtaggcactatattcctgctacaggacggngaaatagccgacttt

SEQ ID NO: 791 - DNA, 391 bp, Neisseria meningitidis
  misc_feature (375)..(375): N is any nucleotide
ctcttcggattagatacggtttgtatgcttctcgataaggaattgcttgactttgcctactctcttcccttcgaataccgctacggaaagcgtatctatgatgatatttgtcgtgaactgtatggcgagaaaggcatttctttttcggacgatttgaacctgcatggcattatctcttctcctgtttaccgactcaaacgatctctaaagcctttgcttcgaccatttataccccgtccttcgatttggaaaggcgatattatcggttttgaacggatcatgcaacctgtattacgacaggtagagcaagacggacgtttccacccgacatctataaatgggttatccttctgctggtatctgcttcaaaacganaaattgattgaccgcc

SEQ ID NO: 792 - DNA, 330 bp, Neisseria meningitidis
gccaagttcttcagcaggtcaatgccttcggcaaaccatgacggggcattgaacaaactgaaaggcttgatcgtgtaagaaatgtcatcgagtacgggaacgactacgcctgccaccttctttgccgagagcttgacaccctccacactgatcaggtcgggtttgaattcgttccacaggcttaccatgcttcggtagcctacgatctcttcttccagttggcgttccaatcgctccacctcgtccttcgttcgcttcacctccagacgcaatgcgctctccttgcttttgatcgtcggtaaggtacgctctcgcatcttaagctgcttt

SEQ ID NO: 793 - DNA, 468 bp, Neisseria meningitidis
gcttatggcaatgctgcccaaggaatcatcgacttggccgaacaggcaagtgctaagatcgtcggtatgggctttatcatagagaaagcctttcagaacgggagagaggctctacaggaaagaggtataagagtggagtcgctcgcgatcatccgaagccttgacaactgctgcataactattgcagacgaaaacgaagactaaccatacaccattccaatacacatcccgtccgctggctcagtgggcgggatgttgctttttccttcccttttctccgaatataaagacgtgccacttttcgtttctcattcggaaggcatattgagccctttgaaaaaagagaaggtctctataatgcaagaatccgagtacgtgctacagatatggccgagcggcagtttagagactgtctcctctgtcctcaagataataagtgccacgcaggatttcgcgtttaacgggagg

SEQ ID NO: 794 - DNA, 373 bp, Neisseria meningitidis
  misc_feature (296)..(296): N is any nucleotide
ccactttttccgtaaggacagtatcgtacgtttccaccgctcggctttccgcctgtccctgccggtgatcggcggcataacggctataggggtagcaccctttcgccatgcaccttacgggcagtctggtcaatatcatcatgaatcgttctttcgtatcctacggcgagacagcagatgctaccgacttggccatcggagcattcgggattatcaatggctatgccatgctctttttcatgattatcatcggtgtggctcaggggatgcagccgatcgtaggtttcaactacggngctaaaaatccgggacgggtgaagtcggcctatcgctacagttgtggcgtcaatctactggtcagctttctcggttt

SEQ ID NO: 795 - DNA, 416 bp, Neisseria meningitidis
gcagatggcgaacggatttgccagcttgttatcgccagacatgaacaggccgaatgggtgcttacagacgaattggccgatacggaacgaggtgcaggcggatttggtcatacgggcaaagaataattttcaatctcccttcaactaccacagatgcggatccattctatcattctcctgctgtttcttttagttatttctcctgtagccggaagtatatccattacagacagtacagcatctaagttcgaccgatatttctatgaaggtgtccggcagcgagaacaggagaattatgctgcagctttcgacatctttcgctattgccatcggttgaatcccaacgatgcggctctgttatcggagttgggaaaactgtatattgccaatgggcgtcaggaggaaggaacccggta

SEQ ID NO: 796 - DNA, 231 bp, Neisseria meningitidis
cgattatgagcgctgtgcgtacgcctacgcgccagctctcaagccgccggacaattgaatgcgacgatagtttggattccatcaatgccactaccagcgcgattgtgaaatacgtttcccagcgtgcgggcatcggcatcaatgccggacgtatccgcggtttggacagcgaaatccggggcggcgaagcgcggcataccggctgcattcccttctttaaaatgtttcagg

SEQ ID NO: 797 - DNA, 328 bp, Neisseria meningitidis
gtccgctgatcgagaacgcgcatgaaaacggtagtctggattgtcgtcctgtttgccgccgccgtcggactggcgctggcttcgggcatttacaccggcgacgtgtatatcctactcggacagaccatgctcagaatcaacctgcacgcctttgtgttaggttcgctgattgccgtcgtggtgtggtatttcttgtttagattcattatccgcgtattcaatatccccgaaaagatgcagcgtttcggttcggcgcgtaaaggacgcaaggccgcccttgccttgaacaatgcgggtttggcgtattttgaatggcgttttgaaaaag

SEQ ID NO: 798 - DNA, 543 bp, Neisseria meningitidis
cgcgactgttgcgataagcgcggaggcgatgatttttttcatgtgtgtcctgtttgggtggaaaatcggttttattgtatcgccgtcgggaattttggcaagcattctgccggcaaatcgtgatgtttacaggggcagggtgtgcaatttgcggacaaatgcgaggctgttggcgactgggttgcctttgttttcgacttcgtgttcggtttctacggtcagcaggcggcggtttttgtgtttgttcaggctcaattcggcttgtgcgggtgtgaaaaacaggcggtgtttttcggcaaagcggcgggcgcggctgttggcggttttcaaaatctgaagcagcgatcgtccagatggaagcgtcgcacgcccaatacgagaatccgtgcggcaaaaaaatcggcggcatcggtaaactcggcggggctgctgcggctgaagtcgtgccgttcggcggctatcaaggcggcaacggtgcggatttgcggaatcatcgattcgctgataagtgtgtcgtcccgccctgcatcgagaagcatgggg

SEQ ID NO: 799 - DNA, 448 bp, Neisseria meningitidis
acttcttaaggtcaaacatctactactgattgacagcgaattagcattgcgagggaaaggtgaaaagaattttgggaggggagcgaaatagaattcgaaattcgacgtacataaatagcgggagtgtttcagcggcgcgatcgtgcattccccgcacaacgggctaatgatccatacctagcagtgagtccaattgaacaggggaggtgcagggaaattgagctccaacagggtgacgagccgtcgggcgcagatttgaaattgagcgactcacttacggttaggccgaaggcgttgcaataggcatcggaggattgaatttatgtacgccgtaaaacgtggggacgagtcgcggacaggggcgaaaggtcaaataaatctggagacagtcggcctcttttgaaaatcacccaggcagcgttctgagtaagatatcgacgggggcaaa

SEQ ID NO: 800 - DNA, 418 bp, Neisseria meningitidis
attactgcccaagtggaagtgggcaaagtgtacgaaggcactgtggtgcaaaatcctcgataacaatgtcggcgcgattgtcagcgtgatgccgggcaaagacggtttggtacacatcagccaaatcgcccacgagcgcgtacgcaatgtcggcgactacctgcaagtcggtcaggtggtgaacgtgaaagcattggaagtggacgacagaggccgtgtccgtctgtccatcaaagccctgctggacgcgcctgcccgtgaggaaaatgccgccgaataacgcttaaggtgaaagtgccgtctgaacaggtttcagacggtattttttacgggtatcgggaatgaatggggcttacagccacaggacggcaagtttccataatgcccggggatcctctagagtcgacctgcaagcatg

SEQ ID NO: 801 - DNA, 666 bp, Neisseria meningitidis
aggtgtacacggttcccgccattagtactatgtggtcgtggttccggcccccgaatgacatcctgttgacgataaacctgctggtccggcaccgtgtggtaattcgtgtgcaccctagattgataaagttgacccgtggatcggcaaatattatgttgacggcgtcgtgttgtaaattgttgttgacacctgggcagtggtttgtgccactgttggtaactccgttccggctggagtcctacgtagtagaggtagccggccggatgtactgttcgtgacgaagacacgtggaacatcggctcgtacggctagtgggctggtaataggcatgttgtgtgtactccccctgacaccgacaccccttaaattgacaccgctaatgcctggatggtggtttatggtcgttagtacacacctggtaataaacatgttccccctgttacttcgtctttaacggatcctcataccgttgctcgtactgagcccgattctggccccagtacttagacgtagccctaacctcctgttgaatatggtgcctgttctgctcgaaatgatggggctggaaacgttgttgacgaccttgtttaaattgaaaaccctaatccctatgtttaaatggcgtaacgttcgatttaagcctaaattgacaatatttggtttgaa

SEQ ID NO: 802 - DNA, 487 bp, Neisseria meningitidis
ggtaacgcctaaaggcgaaacccaactggacgccgtgaagaaaaactgctgcgcgccatcttcggtgaaaaagcatctgacgtaaaagatacttcattgcgtatgcctaccggcatgagcggtaccgttatcgacgttcaagtcttcactcgtgaaggtattcaacgcgacaaacgtgctcaatccgcccggatgggatttgatgcgttgcggggaattgatggggccggggacgaggacgttggcgcgcaggttgccgaagcgttcccattcgtcggcggcgactttgcacaggtagttcaacgcggctttggacgcgccgaagccgccccagtaggctttgggtgtttcgccgtggctttcgccgacgaagatgacggacgcgtcgggcgactgcttcagcagcgggaacagggcgcgggtcagccccataggtgcgacggtgttgatgcggtattgggtgacccattcggcgacggtttggaaa

SEQ ID NO: 803 - DNA, 595 bp, Neisseria meningitidis
gttccccttgtaggtcgcaaccgaaccctataaattgttgaatatcgttgatggatgtgtgattagtactaggaatgttgtaactgttaaggtccttgttgtttcgcttaatatgccggtaggagaaattagtagtaaaggtacctttaaatgcgtggataaagcggctgaaattatgtctagaaataatagcgtgttatttggtaggaatagatcgtttacttaacttatgtcaatgacctctttccaaaacctacgaaaccaaaactgaaagatcgcaatatggcacccctcccctatgaaatcccatcctatgcttgttatagtgcctagatggtaccccttcgccctacgttgttcgaaattgtttaaacttgtgcctcttcacacaacgctggatcccgtgttgtaccctaggacctcccaacggtacccgttctatcacccatttcgttggatgatactattgttgccccggatgacgccgtttcgacgattaaagttgttgtaaagaaaattgttggtgcggctggtgatgacccggtatttaacgttaattgggccatgggtgcactggtagaatgtgagccgttga

SEQ ID NO: 804 - DNA, 622 bp, Neisseria meningitidis
cgcgccgaagaaattcgccggggccgcggatgttgaggtcttggcgggcgatttcaaagccgtcggtgtgttcgtagatgactttcagccgcgctttggcgagttcgcccaagggtcgccgccatttcgacggggtggtgtccgtagtcgtccaccaagagcgcggtcccgccgtttggcaacttgatgtcgccgtatttttggaagcggcggccgacgccttcaaagccgagcaagcctttttggatcgcttcaaccgatgcgccgacttccagcgccacgccgatggctgccaatgcgttcagcacgttgtgtctgccgggcatattcagcacgacttcaaacgacccctgctcatgtcctttcatttgaacatggacggtgaatttcatttgcgcgccgacgttttcgatgtcggtggcgtagatgtcggcggtatcgtccaaaccgtaagtagcataaggtttgctcactttgggcaaaatcgcgcggacgtgttcgctgtcaatacacaaaaaggctttgccgtagaagggcatacggtggatgaaatcgataaacgcctgatgcagtttttcgacgctgtgcccgtaggtatccatatggtcttcgtcgatattgg

SEQ ID NO: 805 - DNA, 360 bp, Neisseria meningitidis
tttgacggtttcattatggcgcagcagcttcccgagccgctggcttcgcagtttgccgcgatgaatcggggcgacgttacccgcggggctgattgaaaacggcggcgatgctgtctaaacaaaatctccgtctgaacaaaatccccatcggataaaaaatgccgtctgaaacgtttcgggtttcagacggcattttgtcggggtacgcggcggtgcggcttatttcactttacctttcaacgcgccatatcctgccgcgtccatttgttccagcgggatgaatttcaagctcacgccgttgatgcagtacagcagtccgcctttgtcacgcgggccgtctgggaagacatgtcccaaatg

SEQ ID NO: 806 - DNA, 342 bp, Neisseria meningitidis
cccgtacagcccgtcaaaatccgtcgcgttgttgtcgggcagtaacacgcagagagacgttcagacggcgtcgcccgtttcccaaaaaacgccgtttaaagtaaaaaaatattttaaaacagacagttgatattgacaaattcaaaccgaagattttaaaatgctgccaacccaatccaaaccaaccgacaaactttgggcgtggatgccggcatccccgtattcgccctgctgcccggcagacgcgtcagcgagatcgactatatggcgccggtgttttttcagacggcattattgttgttggaacgctatcccgccgcactcttcctgctgcctgccgca

SEQ ID NO: 807 - DNA, 286 bp, Neisseria meningitidis
cacttttatataaatcattgatcccattaccccaacctccaattttttgccaaccatctattgtatattcaacacctaactttgttacatccattatcacagattgtaaaaaagtaaaatgcttctctttaaaagatccatcaaatcctttatctaaagcagatattaactgctttccattatccctttcgctaccgttcggattatttactgcttgctccgcctaaaaaacgtcgtatttaatattggagtgatttgacacatggcacgttatattggtcctaaa

SEQ ID NO: 808 - DNA, 448 bp, Neisseria meningitidis
  misc_feature (355)..(355): N is any nucleotide
  misc_feature (428)..(428): N is any nucleotide
gagtttggctgtaactggttttaccattatggcggcacgcgtaaacatttgccgaaaatacggtctgaaccgctgtaacaagcaacatacttccaattattttagatacgcgcatatcaacctcctttatcgttcatcttcaaaaaagggaaagtttttcaatagcacttcaatcaattccttcattccccggccaaaaattggacggtaattcccacccaccccctactttgatttcagaaatatctttaaacttccgcttaaaggcggacactttgtccatatcgtcatcaatttcctgtttgccgaacggtattttccgcttttccaaaacctcgtcataataacaagatanattaagcaatagcccccaagcactatttgcaattacgactaatctatgtttttccctagttaagtaatctgcnacgctatcatagattgccct

SEQ ID NO: 809 - DNA, 778 bp, Neisseria meningitidis
ccttgaaatgaagtatctctcttataaaactatcttggtagctctatagtgttcgtgacccagtggagctccaagcacatctgtggaaggtaattcttcacagacactgtgggatttcattgctgcttttgggttgtgactcagctccttcggtaaatatagcccattacatactttctccaagagctgaattatagtaattcaatttttaaactcacaaaacattttgtcacagaaattaacccaaaggctttaaattatatcatttcttgatagatcacttatatttctattttcttgatttcttactggattttaaaaatagtcccctttggtctttcacatgatcttatttaagcccctttcccctagtgtgactttctttacaataaagttattgggaaaaactcattaattcattgacagaaggtattgaactcctgggtgtttgaacagatatacaacacgctgaagctgaattgcgccgtgtatcctgctgtggacaaatcctgccgcgcgtcggcggacaaaccgtattcctacgacagcagcgaccgtttccactaccgcgaacagcacaatgttttgaatgcctcgtttgagaaatcgctgaaaaacaaatggacgaaacaccatctgactttgggcttcggttacgatgcttccaaagcgatttcccgccccgaacagctttcccacaatgcggcaaggatttcggaatccacgggattcgatgaaaacaatcaagataagtatcttttgggtaagcccgaagtcg

SEQ ID NO: 810 - DNA, 538 bp, Neisseria meningitidis
ccccaatcgaccgacccaaaacaaatcaccccctgatgtaagccgtagtaacctcgttgtacgccgttgtgctgcactggcaacgatcctcttgtttaatacatgggtaattctcctgacttgccggaccctacttaacacatcgaccctgtcgatggcccgtctctttctgtcgcgtccgtgtatttgttagcggcccctcttgtaagacgtgatccggggaaggcgggcaaccgtaagtattcgacgcccctcgtttaatgtatgcaacgttccgttgattaccctagttatctttttcttaacattggcactgattctactaaaaactaaggcgggaatccgggcacaccggtcggtaataattcgcaaggtaaggtcgacatgtgttaacctgttgttggaggtaatcccacctagtagatggggtggaccgttcccgccggtggtaatccgaaaccgaattcgtcttaaattgcgcgttgctggtgatgaaggtaataggatgacgctcaaatgtgtgttccctacggtaagg

SEQ ID NO: 811 - DNA, 636 bp, Neisseria meningitidis
  misc_feature (373)..(373): N is any nucleotide
cttcgccgccgcgtccgaacacgaaagggtctccgcctttcaaacgcaccacgcgcctgccttcgcgggccagcctgaccataagcgcattggtgtcctcttgcggggtgcgctcgccccgggcgcgcttgccgacaaaaatccgttccgcatcgcggcggacgagggacagtatgccgtctgaaaccagcgcgtcgtaaagcaccacgtctgcctgctggatttcctgcagccctttgagcgtcagcagccccgcatcgccgggacccgcgccgaccagcgagacggagccgccttgatcattttgacgactttgttccaattggcctgccaattcccgttcggcaagggtgttttgccggtttttgacganggcggcgaaacgtccgttaaactgcttttcccaaaagcggcggcgttcggtaacggatttcagtttgcccttgacggcatcgcgccaccttcctgaaatttccgccatatcgcccaaagacggcggcagcagggctttcagcctttcacgcagcagtcgggcgatgacgggcgccgccgaacattacctgcctctacatccgtcaggcggaagcactgggcttgggacacgccgtcttgtgcgcccgcgccgccatcggagac

SEQ ID NO: 812 - DNA, 412 bp, Neisseria meningitidis
  misc_feature (265)..(265): N is any nucleotide
gtccccctggaggggggcgggctcttcgttgcggcggaggttgtggtcttcttcgggctgcgcctgttttttgcggagcgctgcggccggcccgcgccgtttttcttcggcttgcgccttttttgcgtttctgggtttgccttcggcgggctgcctttccgggtccgggccttcgcgttgcggtttttgcggttcgtcctggcgggcggagggttcgctgtccggcgttttttgggtcttgcgcgcctgcttgggttcggggtgngtgcgctcggtgttggtggggccggttttttggaaggtgtcggcgtgcgcgcctgcggtgcggcgcgggccggtcggggccgcggcgaacgcgcgggtcgaacgggtcgtggtaaggctccttcgggtgttgccgcgaagtgccgtc

SEQ ID NO: 813 - DNA, 156 bp, Neisseria meningitidis
  misc_feature (67)..(67): N is any nucleotide
  misc_feature (70)..(70): N is any nucleotide
atcaaataattgattttattagaatctatttgcaaagccatttgccgttacacaagaatggcacatntcnataactgatgaggatttataccgatgaagacagacattcaaaccgaattaacccatgccctactaccacacggattatctgtgggc

SEQ ID NO: 814 - DNA, 308 bp, Neisseria meningitidis
cgtgtccgcgctttcgcccgacgatttgccgctcaaccaaaaatggtcgtgggacaaaatcctgcgttcgccctttatcaaacaggcggacgtattgcaaggcatctacttcttcagcgaccgtttcaatatcgacgaaaaacgccgcaacttcgacttctacgaaccgatgaccgtgcatgaaagctcgctgtcgccctgtattcactctattctcgccgccgaactgggcatagaagaaaaagcgtggaaatgtacagcgcacgcccgctggactggacactacacaacgacacgaagaggctgca

SEQ ID NO: 815 - DNA, 106 bp, Neisseria meningitidis
aggatccccgccgcttcggtacgcgccctggaaatgttggcatggctgccggggaaactcggtttccctgtccccgatgcgcgggcggtcatcgaaggccgtctga

SEQ ID NO: 816 - DNA, 554 bp, Neisseria meningitidis
acggacaaagcgtgatggtcgtcgggcatcagaaagggcgcgacaccaaagaaaaaatccgccgcaacttcggtatgccccgtcctgaaggctaccgcaaagccctgcgcctgatgaagacggcagaaaaattcggcttgcccgtaatgacctttatcgatacgccgggcgcgtatcccggcatcggcgcggaagaacgcgggcagtcggaagccatcggcaaaaacctgtacgaactgacgcgcctgcgcgttcctgttttgtgtaccgtcatcggcgaaggcggttcaggcggtgcgttggcggtcgccctaggcgattacgtcaatatgctgcaatactcgacctattctgttatctcccccgaaggctgcgcgtctattttgtggaaaaccgccgaaaaggcggcggatgcggctcaggctttgggcattactgctgaccgcctgcaaaagctggacttggtcgataccgtcatcaaagaccattgggcggcgcgcatcggggattcgggcaaagaccgcaaaaactcgtggacatcatcgccgctttag

SEQ ID NO: 817 - DNA, 606 bp, Neisseria meningitidis
tagcaattattgtttcgaaataaggtgatattgccatcccggctggccctggcatccctcatgcgggtgaatgcgtggaatgttaaggttgtaattttaaaattggtgagttctcgattaccgttgttgttaaaatgttcaaaccttgtgttggtaaagtcccgaaagatgtatcgcaagttgccccccacgaaaaaagttgacctcccaaagaactggtccccccactggcttataccacctcgaccctaaactggtaatatatcgtccgctatgcgtcctaaaggtacccgtgttgttgagtaggctaagtcgcctccgcgtgttgagcccgttgaaggactcaactcgccctctgtctaactcgcttaaaggtcgtctttatacatacccgtagcagctgatggtgaggtgggcaccgcccgaactcaaattgtgggtttgtaaactgccccgttaccccctggtaaatggaacacctcctatgtaagatctgataacccctcgccccgttcgtggcccggatactgtgtaccgggagagtagggtggccaaagtgagtaatgttaaaacgatttatgtttaaacgtggacggcgtggacccc

SEQ ID NO: 818 - DNA, 677 bp, Neisseria meningitidis
gcggcaaatccacctacatgcgccaagtcgcgctgattgttttattggcacacaccggctgttttgtgcctgccgttcagcatatcggaaaacttttggtattgtggcgtaagaatatcgaagcctgacagcctgaagcagttgttttgctattgttctttaacgggcgggacgccgtccttcggcgcggcatttcggcgggccgaaaccctttccggtgaaaacggattttgattgccgcccgatgctgtctgcaagttgcggcggcttccgtatggtttgaattgttgacaggatgattggagggcttatgcagtttccttaccgcaatgttccggcttcgcgtatgcgccgtatgcgcagggacgatttttcacgccgcctgatgcgcgaacacacgctgaccgccgatgatttgatttatccggtgttcgtattggaggggtcggcgcgcgaggaggatgtgccttctatgccgggtgtgaagcgtcaaagtttggacaggctgctgtttacggcggaagaggcggtaaagctcggtattccgatgttggcactgttccccgtggttacggcaaacaaaaccgagcgtgcgcaggaggcgtacaatcccgaaggactcgtgccgtcaactgtccgcgccttgcgcgagaggtttcccgaactgggcattatga

SEQ ID NO: 819 - DNA, 517 bp, Neisseria meningitidis
  misc_feature (425)..(425): N is any nucleotide
gggtatgcatgtttgattccgcttctttcagccacgtgcggaagccccagcgtttgaaatcgacaaccagctgcgcccatttcggcgtagtacggcgcaggctttcgatgccgtctgaaagctcggcgtgcaagtccacatcggttttaatcgtgaccaaatcatacgacagcggcagttggggcagcgcggcttgcaggttttcgcccactttgcccttgatttccgaagcgtgttccatcacaccagccagcgaaccgtaggcttccagccatttcaccgccgttttcgggcccgggcaatttcgagctgaacgtctatatgcccgttatcgcctacaacctcttgcaatccatccacctgttgggcgacgcgtgcaacagcttcaacgaacactgcgccatcggcatcgaactcgtgccggnaaaaatcgactatttcctgcaccattccctgatgctggttaccgcattataccgtaaaatcggttacgaaaacccgccaaagtcgccaaaac

SEQ ID NO: 820 - DNA, 489 bp, Neisseria meningitidis
aggttggcttgtgttcataaaaaacttattacatgtaacggtttgaacggacattccgtcgggtcggaatgtcaaaaaggcgcgattgtaccaaagaagttggacataattttgtttgcaggctgaagatttgcttaaaaattcattaagatgggcggaacaaatagtttgggtacagcgtgttgaaataccgcttatcccttaaaatagcgtccgaaattctgttcggacggcatcaagacacacggtaatccgtctgaaccccccatttgacatcaacaaacaagagcattgaatgaaattcatcgacgaagcaaaaatcgaagtcgccgcaggcaaaagcggtaatggcgcaaccagtttccgccgcgaaaaattcgtaccgcgcggaggtccggaccgcggcgacagcggcaaaggctgcagcgtctgggcagaagccgaagatcacaccaataccctcgtcgaataccgcttcgttaaacgcta

SEQ ID NO: 821 - DNA, 609 bp, Neisseria meningitidis
ggtaactgacggatcgggcattccttaaattacccgtgtatcgctgtaaatcttagagatggcggaatatagcggactgcatcaccgcccgccccgattcaaccatggcgcgccatgccgacatccacatcacggcgtcggtttccaaagaagcctgcccgctggggcttgccccgaccaccagcaccaccgccgtcatggctttgggcgatgcgttggcggtcgtcctgctgcgcgcacgcgcgttcacgcccgacgatttcgccttgagccatcctgccggcagcctcggcaaacgcctacttttgcgcgttgccgacattatgcacaaaggcggcggcctgcctgccgtccgactcggcacgcccttgaaagaagccatcgtcagcatgagtgaaaaagggctgggcatgttggcggtaacggacgggcaaggccgtctgaaaggcgtattcaccgacggcgatttgcgccgcctgtttcaagaatgcgacaattttaccggtctttcgatagacgaagtcatgcatacgcatcctaaaaccatctccgccgaacgtctcgccaccgaagccctgaaagtcatgcatgcaaaccatgtgaacgggc

SEQ ID NO: 822 - DNA, 289 bp, Neisseria meningitidis
tttttcacacgcagtccgaaacgtcagacggagtttgcggtcggacaggtaaaatggtggcgtgcttattgaaatttcgacaaaggtcgtctgaaaaccgaaaatatggatttcagaccacctttgttgtatttggtaagtatatgttcccgttgtataattacggaattgcaattcaatacaaaatacacaggacacgccatgacagaatccatcacatgagacagtacacaatacgatgtcatgactgtaggcgcaggcccgtcaggtttgtctgccgccatcacac

SEQ ID NO: 823 - DNA, 1143 bp, Neisseria meningitidis
acaccgtcttgttcggcggtatgaatatggacaaacagaccgccgacctgcgtgccggctgcgaaatcgtcgtcgccaccgtcggacggctgctcgaccacgtgaaacagaaaaacatccatttgaacaaagtcgaaatcgtcgttttggacgaagccgaccgtatgctggatatgggttttatcgacgacatccgcaaaatcatgcagatgctgccccgccaacgccaaaccctgctcttttccgccaccttctccgccccgatacgcaaactggcgcaagacttcatgaacgcgcccgaaaccgtcgaagtcgccgcgcaaaaccggcatcgcaactccaaagagaaagaacccaaaccgtcattcccgcgaaaaatagaaaatcaaaaaaaaaacctaaaatccgtcattcccgcgcaggcgggaatccaatccgtccggtttccgttttttttttgaatttcaggtaacttccaaaccgtcattcccgcgaaagcgggaatctagaaactcaaagctgcaagaatttatcaaaaatgactgaagctcaaaaaaccggattcctacgaaaacaggaatccggagtctcagggctggcaaaaccgttttacccgataagtttccgtaccgacagacctagattcccgccttcgcgggaatgacgaaattttagattgcaggcatttatcggataaaacagaaattaagcgtgacgaaaatttatccgaaatcacagcaacttttccgcgtcattcccgcaaaagcgggaatctagaaactcaaagctgcaagaatttatcaaaaatgactgaaactcaaaaaaccggattcccgcgaaaacaggaatccggagtctcaggtttggaaaaaccgtttttcccgataagtttccgtaccgacagacctagattcccgccttcgcgggaatgacgaaattttaggcttctgttttgattttttgtttttgcgggaatgacgaaattttagattgcaggcatttatcggataaaacagaaattaagcgtgacgaaaatttatccgaaatcacagcaacttttccgcgtcattcccgcaaaagcgggaatctagaaactcaaagctgcaagaatttatcaaaaatgactgaaactcaaataaaccg

SEQ ID NO: 824 - DNA, 465 bp, Neisseria meningitidis
gtgccaacaaaggcgaacccccggaatgaggccgataccaatattctgaaaaacgtcgaatctgccttgcaagacgcggacattaccgtcggcaacctcgaaggcacgctgtttgacgaaggcggtacgccggagaaaatgtgcaaacccccaaaatatgctatgcattccgaacgccctccgcatacgggcaataccttgccgacgcgggattcgactacctcagcttcgccaacaaccacagcaacgacttcggcgcgcaaggcatcacggcaacggcggcgagcggcagctcttttacatactcgatcgcgctaaagccgctgccgataacgatgccaaaattgcgggaaataccgccatcgcccagataaatttgtccatcatcagacctttactgttcagacgagacagcatttgccgcacgttttggggcttatctttcgatttgcgctacgtcgcgca

SEQ ID NO: 825 - DNA, 578 bp, Neisseria meningitidis
gttccgtccttgattcgattggtcgatagtctaatactacgatccttgttgaggtagatgaatgtaacgtggtagaagacgttgttacttgttgttcgcccacggactatccgaatgcggatgaagaaattgttgatgcatcggcctaggaaggccccgtaattccggaagaagctgttcacgccttcgttgttgaatcgtccgttaccgaaggacccgatgaagaaactgctgacacgtcttgtaattgtgtttgtgacgttacttcgattacggtgaccgttgttgaagaaaaatcgggtgaagcgcttgatgacacgtgtaattctgaaggtacagacgttgacacgtcttgtagttccgttgaagtacgtaccattatttgtgatgatccggtagagtccgtcgcggatgaatcgaccgaaactattggcgcaaatgaagaaattgtaaaagttgctacttcgattgtatgtgaatatcggcccattgaagataaacaaagggggcatagacgagcaatataattgcagaataacccgttgttgagtcgaaatgttttgctgaagattcgccga

SEQ ID NO: 826 - DNA, 605 bp, Neisseria meningitidis
aaaatttggacctctcctcaagtgaactccgttcctatctaagtcctccttgtactccccctagcccattgacaagcgcgaacgttcaaagttctcctccctctcagaaaggaggcgacttagttgtaggccttttcatggtcattccgccatgatcctattttagctacgaagtacattgcggcaagtggatcttccgcggccacttcattcatcctcggcactttttatctttacggcgcgatgggtggcgcgcataagatttgggaatgcacctattgtagcacgtcgattcgtgaccatcagtgaccttgatcctacgtatctgagccgtagagcgtaacttggatcatgactggccccgcgagaccggtcttgttctgtggtccggtcatttctcgcattgattaccgcacgatgcgcgaagtttcggctacaagggttacgaggatccgatgctacttttattccttcttggtccgctattggtagctctaccagagcgtttaatcgaacgacggtaatcaacgataagggccgtgtctgccgtgggatccaatttaatactctatgatatgagtcgatgatagttacgtagtattcgc

SEQ ID NO: 827 - DNA, 399 bp, Neisseria meningitidis
acactctcctaacactcctggctggtacacgttgcttgaattgggcccacaccctagatggtaccccgggaccacctggacccccgtgcatctgaaggtcggacaatgatgtcgatttcgttggacccggaagtggaccccgtgttggaccccgcgtcgttgtcgacggcacagatcctggccccggcgccgcacgcaactattgtattcctggtgatactgttgttgtgtcgcatcccggtaccattggccaagatcatggcgtcgttcgtagacgaacaagtaatgccgcccgttcgcttgtgtattgcgttcccgttgttgcttaacgctcggtcgaagtggatcggtgaattccttgtttctatggacctgttgttcccgttgttgtgcgcaata

SEQ ID NO: 828 - DNA, 923 bp, Neisseria meningitidis
ggtggcggccgctctagaactagtggatcccccgggctgcaggaattcggcacgagcccacagtgagtttcccccacactcggctccttggagccccgacagtccatagcaccccaggagatgtctaaccttagggacttggaggcctcccaggggtctaggccagctgagttgtgaagttgcatggcagggacagggcagggccgaggccagggttgctgtgattgtatccgaagtagtcctcgtgagaaaagataatgagatgacgtgagcagcctgcagacttgtgtctgccttcaagaagccasacaggaaggcctgcctgccttggctctgacctggcggccagccagccagccacaggtgggcttcttccttttgtggtgacaacgccaagaaaactgcagaggccccagggtcaggtgtaagtgggtaggtgaccgtaaaacaccaggtgctcccaggaacccgggcaaaggccatccccacctacagccagcatgcccactggcgtgatgggtgcagagggatgaggcagccaggtgttctgctgtggtttgggagcctataaagtgagactaggctgggcatggtggctcccatctgcaaaaccagcactttgggaggccaaggtgggcggatcgcctgaggtcaggagtttgagaccagcctggccaacatggtgaacccccatctcttaaaaatataaaaattagctgggcatggtggcaggtgcctgtaatcccagctactcaggaggctgaggcacgagagtcgcttgaacccgggaggtggaggttacagtaagctgagatcttcccactgcactccagcctgagcgacagagtgagactccatctcaaaaaaaaaaaaaaaaaaactcgagggggggcccggtacccaattcgccctatagtgagtcg

SEQ ID NO: 829 - DNA, 639 bp, Neisseria meningitidis
ttaatcaaactttaattcattattaaatgcctgcaaaaatatataaaagcgggtgggttttcccgacaaatagttttaattggagcagctatattttttttggtgcatgcgtaaaatcttatttcattatttattttgaaaaatgtattaaaacaataatggaattggatattgaaatatcaggtttttttgaattagattattatgaagataattataaagtaaattggaaaataaataatggaaatttgatacaaacgactaattaaatggacaaatataagttagattggacacccaaacctaaaaactgtctgaaactcaatttggttttcagtaagcgtaggttggcttaaaaacccaaccaccaaaatgccgtctgaagcggtattcagctttcagacggcattttgatgaatgaaacaggatattgagaactaagttctttaaaaatcctacacctgctccttccacggcagcaccttggtcaaaacggcagacggctacaaagccattgcccgtatccgaaccggcgaccgcgtcttcgccaaggacgaggcaagcggaaaaacgggatacaaacccgttaccgcccgattacggcaatccgtatcaagaaaccgtttacattgaaatttc

SEQ ID NO: 830 - DNA, 783 bp, Neisseria meningitidis
  misc_feature (692)..(692): N is any nucleotide
  misc_feature (702)..(702): N is any nucleotide
cccgcccatcatcgtactgcccgaaagggacgtacccggaaccagtgcaaacacttgggcaacgccgatcatcaaggcatcaatcggacgcaatgcatcaacatcggcaattttaggctctgctcggctttggcgtttctccacccacaaaataaaaaaaccgcccaaaaccagcatgactgcaacactcaaggggttaaacagatactctttgatttgtttgccgaacaacagccccatcacggcggcaggtataaaagcaatggcaagattaaggacgaagcggttggctttccggtcttttcccaagccgtgcaacacattgctgaaacgttgccggtattcaaacactaccgccaaaactgcaccgagctggatggcaatttcaaaaaccttgtgattgctgtgaaaaccaatcagattgccgagttcaggcttcatgaagcggaggtcaaaccgatcgacagggagaaggtgccggggcaggtgcgggaaaaaggaaaagttttgcagattgacggcgaaaccctgctgaaaaatcccgaattgttgtcccgcgcgatgtattccgcagtggtctcaaacaatattgccggtatccgcgttattttgccgatttacctacaacaggcgcagcaggataagatgttggcactttatgcacaagggattttggcgcaagcagacggtanggtgaaggangcgatttcccattaccgggaattgattgccgcccaacccgacgcgcccgccgtccgtatgcgtttggcggcagcattgttt

SEQ ID NO: 831 - DNA, 393 bp, Neisseria meningitidis
gcttcagacgagccatttattatatggagattatagtggattcaggaagcgcgttctttcgcgcgcgaagacggcaggcagtttgtcgatgccgacaaaattatcgccgccgcctacggtttggcgttttctttggaacacgcttcggaaacgcaggaaggcgggcgcacgttctgtatcgccgatttgaacattaccgtgccgtctgaaacgcttgccgatgccaaggcaaacagccccctgttgtacggggaaactgctttgtcggatattgtgcggcagaagacgggcggcaatgtcgagtttaaagacggcgtattgacggcagccgtccgcttcctgcccgtcaaggacggtcagacggcatttgtcgacaacacggtcggtatggcg

SEQ ID NO: 832 - DNA, 193 bp, Neisseria meningitidis
actatcttctaaaggttcacttttctccaaaatagaaaaggcagcttggatattttcaaatggcagggaaggcaaatcttcaacgagactgccacaaatagcgacaacaggaactccgacaagggttctttttgctacaccaataggcgctttccctgctaaactttgacgatctagtcttccttcaccaacg

SEQ ID NO: 833 - DNA, 474 bp, Neisseria meningitidis
tttttttttttttttttttaaaaaatatcatttattcttttataaacaatagcaataaatttattatatgttaacagcagagtgatgacatcatcacgtatcacatagcttctggaaaattccaccatacacttttgagagaaggacagataaatggtcgataacatcttagtattatcatggaaaagttttgatcttatagacccctcaacacccaaaagtcgtaatcagttctactcaagtaagatttaaatatatatctatattttctggtctgagattcttttcaactttactcagaaaacatatacctgaagggggagggggagagtgcacagatgagtctgtttgtatgtggatggtcacagaaatgacagaaaatagttatttaatctgaatctggaccctgctgaaaactgccgtgatttctcataacactctcctgccccttcagaagtgaaactggctgatagt

SEQ ID NO: 834 - DNA, 369 bp, Neisseria meningitidis
cgattattctgacaatcagcattttcagaagtatgcctaaaagtggaatcagaccggcaagtaatggcatttattaccccttgaacgaaccgaaaacgacaaaagccgacataatgataaaggcgagcagtacggcaaagcggattttttcggcgtgcacgcataacggctcatagcttgcctgatattgtctaccgaaaacatgaaaggttttcggctgcggacatacgccgttagacggtaaaaagttatgtgaagaccatgtcgtatcgtctataacctgcggtatgcttatatcgtgaaacatgccgtctgaaggtatgcccatctgctgacaggctatgatttccggaaaataatcgcacaaaa

SEQ ID NO: 835 - DNA, 186 bp, Neisseria meningitidis
cgacgttgagtgcccccttaacttaaactcccccgtgatagggtgccgaaaaacgtaactggtgaatgcttgttggaaatcgttaatattgtattgtttcctctgcttagcgtgtttcgtaaagtacttggtatcgtgctagttaaagatcgtgttgtggctcgttgtacccctgcgcctgcgtta

SEQ ID NO: 836 - DNA, 394 bp, Neisseria meningitidis
gcgcccgccaaacgcggcaagcggcataccggcgccgatgactttgcccatcgtggtcaggtcgggcgtgatgccgtgcaaagattgcgcgccgccgagcgcgacgcggaagccggtcatcacttcgtcgtaaatcaacaccgcgccgtatttttcggtcaatccgcgcaaggctttgacaaaggcttcggtcgggcggacgaagttcatattgccgaagaagggttcgacaatcattcaagccatttcatttccactgtataaagtccggtcattacctgtgctttgcacctcttggaaaccgggcaacggctcagtggcagggttggcaaccaaagtaaccgtatcgccgactttcgcctgtcccaattcttttacgccggtattcaaaaag

SEQ ID NO: 837 - DNA, 781 bp, Neisseria meningitidis
  misc_feature (16)..(16): N is any nucleotide
  misc_feature (676)..(676): N is any nucleotide
  misc_feature (727)..(727): N is any nucleotide
  misc_feature (748)..(748): N is any nucleotide
  misc_feature (765)..(765): N is any nucleotide
gtccgatttgccgacnaaaccgggcctgaaagtggacctagagggaagaacgcgttaagaggacaacttcgagctgttaaagacacctgcctagggggtaaatgagtggtgaaaccggtatggggtgttaaaagacaaaacctactggccagaggggtaaagcctacccaacctaaagtggtaatcacatgcttataaagactcataataccaatgttcataccccggtgggggctgatattaagacctctgggtttgctgaaatgggcatcagtgacgtggttggtattaatcagaattaacgtaatagtgcatatgggtggagtaaacgtaagtaacgttacctaccgcgtaaggttacagatcagatggcttgcactaaacctctataaattattactcagcttgttattactgttgctgttgggaacggggaagcggctaccccacatgggggtagaaaaagtggcgaggcttgcagtgatccttgtaaatagacgacaagttaatttgggggctggcttaaatcgagaccgtctattggccgcgttatagaacccatgtataatagtgctgaaaagatcaagcgcaatagtggtaccaagggtagactcaggggtgcggcaaatacaactgaccgggacgaaccaggcattctaaatcccgaaactagggntagttgtagtagaaaaggcagaattgaaattactactaagttttagattgntagtaggatgccttcgattcntaatcttaagagacagngtgggaagggtggcat

SEQ ID NO: 838 - DNA, 447 bp, Neisseria meningitidis
aagaaaacaaacctcgcccccccttctacgccccagggagcgaccataaaacgaaactgtcgacgcgaccacactggacgtcgcctaagtgattcgaaaacagaatcccccctaggtcgttcccgcagccaatggcagaaacccagataaactttgaccgtgtatccccaatatactccctccaccgtggacagaacatcaagcaacgacaaagacgtcaccgccaccccaaggatgccagaccgaccacgaacaatttatagcaagagaatttaccataccacgaatgttgtataatctgattacattgttaaagccccggtcgaaacgtcgatccctaaatagttcgttgacgttgcttctcttgttcacccgtgtgaatataaaaagtctggtagctaagactgttatgcaaactgttgcaaattgttcccgttgtgtcgtgtt

SEQ ID NO: 839 - DNA, 543 bp, Neisseria meningitidis
ttgcaccgggtaaacacattcttgacaccacgctcgaaaatggacaccttacagagtaaagtggcccggaatatcgttaacacgttgatgatggtagtggccctgcgcgtaaagcctttgaaggatgtcaccctgtcacgggtgataattgtgataatagcgttgacctgtgtcatcggggacccgcggacgataagtcggccgctggtaaggtaacgcctaccccgacgaatcctggtgaccctggtaggcttggcatggtaacttgccaggttaggaagttaagaacgttgctcgaaaacagccctagatggtacccgtcaccttctatccccataggtgagctcaatgccgctggaccccttcattcactagcttaacacatgtaggccccgtatggtgaatcgttaacaccgtttcgacgaaactaacgcgaagatcgttgccctagtgaattgaggcaaaccgttgaaagtgctagtgttattttcgtttatcgtatgttcctaactggcccgtttaatttgaaacaactgacgaata

SEQ ID NO: 840 - DNA, 602 bp, Neisseria meningitidis
tttgcgggtcccgctcccggtaagtagtctgctgtggggtgtgacgccgatgacacctttccgtcggtgtacactgaggccgtgtgttcgtacaattaaacttaaagttcgactttaaggtatacttccgagggagagggctaccccgttgccgatggagctgtcggtaataacgcctaccttggacctccccgttaaaactcgtaggacggcgtggaccctgatactccggaagctaagggagaccccttggttcgcgaaggccccgggtgtaccgcctatgttgttcgatctgaggccccgcccccctggtaggatccggaaggcaaagcacttgggtgtggtggacccgccgatgagcctttagccgttggtcgccgcgacaactagtcgggcgctgtcaccgaggtgccctagtgcaattccccgaattggcgccccaaagctcgttatacttaaatcgtgccggagtgcggctggtaaggcacggccccctagtgcaatgacgacgcggttgcgtcgccggtcgacgcagggtcgtttggtaaagtttaacgtagttaacctgacaacgttggtacccccgttgctcccgtggaaac

SEQ ID NO: 841 - DNA, 601 bp, Neisseria meningitidis
gttccccctaacacaatcccgacaagaaggcacggtaacgatgtcgacaacgttgagcactgtgatgatcactactactctaactaacgcaaatttcccccgccttaccccaccatctactaccaccgtccatacaagaccgaaggatgattatggcaccggtacctccattttaagttccggtagcaatttgacaaatacccctcttgcctcctatgtttaaacacctgacaacacaatgcggtaccccgtcgatgtcctctgcgttccctccacaccttactttccctccgctaacgtataggctggcagaacccgtagggtaagaatgtcctattgttctaatggcgggtccgttccgtattatgacaccgctaaaagttctcctaccactaccacccgcttgtatacctatcgtggtatatagattccccttatagcccctgtcaaacgcaattccatcgcttgcactacaccttaaacttaaaattcgaagcctgttcctttgtaaagttgttctggttaaagataaagttaacccttcgctcgacctgccggtatcgacttgtcgtctggcaccgcaagatcgtgtggtagccat

SEQ ID NO: 842 - DNA, 622 bp, Neisseria meningitidis
gggcctaaggtgcgacccctctggatgacccgatcacggagggtgtgcgtggggtaggtggtactaaagaatgtgtttgtacccttcccgaggtaggccgtgatactgcttctgctcgtaattgctttgattccgcggacgaatcgtgtgaagacccttgtaccttcgataactttatcccggtgtaatgccggtaacacacggttaatatgtctggtagcgttgttgtgtaagttgcgacgtagatggtggacccttaagtggtgtaagttcccgccgttggttccgttctgttgtaggatatggtgggtggtgcgaaagctggtgaagttccccaaattggtcgtgccctaataactcgttgaccctactaattgcccgctagggaaaggtaacgacccccctggctaggcagaaagccactccaccgaaccatccaaagacaacgacgaccactaatatcgcacctaaatataatgccccaaacttgtttgatatgtggtaaaaaggtaaaatggcacaggtatgttgtatcccccgtgtcacaactatgttccatccaacctggaacgcagtgtaatttggcagtgtatcctgcctgggatgaaaggggtggaggcct

SEQ ID NO: 843 - DNA, 452 bp, Neisseria meningitidis
ttccgcctccttatgtcccttatccttaaacttgacattgttgcgttaagtatgggactttagcctattaactgcccgttgcggcaaactaagttccgtctacataggtgtctgaatatcctggccatggccctggtgtgtatgctgcttactgcgaaacatctgtctgcttagctggtagagtagtttatgtggtgtacccgccgggcaactgcgttgctggaaatcctcccttacctttatatccctcttaaaaaccccctgtgatttaagctacggtgggatatgccccgtgtagtaagtcgatgtctaattataactcgtgcggtcacgtttgtgcggctcgcgttgggaacttaggtggcgccgtagttccctacgtggcagcagtgggctagattgcttacaacggcccggccgaaggtacgatttacgcgtagtgcgttggccat

SEQ ID NO: 844 - DNA, 621 bp, Neisseria meningitidis
tagccgataaatggtcgccgcccgcctgttacaagttgtaacactaagccacagtggaccaaacccaaactaggataaggtaatgaagttgtagatagcataaacagcatggtaaggtgagacaatgttgcatcggcccaaacccaacttatcacatagacaaataacgttgctcgaatgtaacgcgcctagatggtacccatccacttataggcccgcctaagttccagaccccgttcgtgaagcaccttaaagcgtggatgagccggtaggcgcaggataccctgccgctgcattaggtaatggcccctattaaccgcccgttgtttatggctactatgtgggcccgggctgtactgaagagtgagttgcacctgacgttgataatgctggaagaaatgacccgactcctgccgcagttgcaagacctgtcggtggtggtccctactgtggtgccgaccctcctcccggccatagggtgcctgaggacggaaattaacctggctagtgagttgtcggtaatagggatgtgccgggtggagttgctgagcccgttgcctaacctggggacaattagattgacggttccggtggtattggcgtcgccgggtatgacgccga

SEQ ID NO: 845 - DNA, 449 bp, Neisseria meningitidis
aaaatttcggtgccatttaatccaactgttccgtagtatactttttccctgttaagtcggtggcaacagtgaaagaggtttgtattgactgtttcctttaatagccgtgtagttcgaacggtgaacggtgttcgacgtggcacccctcttccatgtactcgcgtggcaccctatattgtacacggcgtatctctagcataactcgtctcgacgttgtacagccaagttagttttcaatttgttaatatttgccgatgtgtttcgatgggtccgctcgtctttggtacttgtccatagataagtcgcgattgctcttgggagtcgtacgcgctagaggcccctattgctactattgaaatgtgtgagcatgaaagggttctgcgacatgttcacccccacaggccaacgctacgacaacaacggccctccagatgctaggcggtatcccc

SEQ ID NO: 846 - DNA, 700 bp, Neisseria meningitidis
  misc_feature (16)..(16): N is any nucleotide
ttcgtcaaaccaaagnacaactacagacacggcagggcaaccagagaaatattccacaccgacgcagccgtactcgacgccaaaaacaaacttacaagaccaagtccggcccgcggcacctacctacacgtcttacgcgttaaccccacaaaacccgtaaaaaaattcgccaaaacccacccccacaactaattctaaggagaccccacagacaacgcaacacccgaaaccaacgacggaaataaaagcccgcatccgccagacaagcacaaaatacccccctccaccgaaaatagcgcccgcactgcaccaaccaccccacacccaaaacccaacccgtccccacacaggatccatcctaacgagccggaacagccccggcaaccccacgagtgtatgtctacttgtgccagtagaacccggaaacacggccgtcaacccagccctcgtaaaaaacgagaaagacactctgaaatgcaacgaacaccataaataagtcggccacagcgtaccaccagtacccggcaacccggtcagcaacaccgtattaggcagcatgctactgtacaccgcaaatggaataaacgttctcgcgaccgtaagttgctctctcggaaacacactcctagtcacctaggagtacaaagacggcaaagccaacactaattgcccctaaaacaccccaatggacccacaccta

SEQ ID NO: 847 - DNA, 567 bp, Neisseria meningitidis
aaatataatccgtttaaactgaagaggcccggtcggtccgttaagaagaaccggaatagaccgaaatcgaaactgagaaatagcccgttgagtgacaaagaagtgtgggtagggcgtccactcccgttcgttaacaatggcacaacctgggtgccactattggtccccattggcacaaatactagatcccccgttgatccgggctcttcgctttcccttggtgtggtggtgtaagttcatgcacattaccgtaatctaaacggtaaaagtgcacacatactagttttagtaggaccgcgtcttgacgtggacccattcaaaactagtagttactagggaggtggacattgttcgaaaaccaaaaaatctagccaagaagttaaaacatatacagaaagcaaaaagaaaaataaaaaattcgttgggcaaaaagaataagtaggtcgttaaagttttgaaagaaaactaaaagtaattaattgaaaagaaaagtttgcaaaatgttaagaaagtaccataaaaaacattaaaaaactaaacgaccacttgaaaactaagtataccacg

SEQ ID NO: 848 - DNA, 646 bp, Neisseria meningitidis
ccacggccctcaaccttagcgacaccactaatcccacctagacgggcaccctaaaactaatccgtcgcactcgctacaccaattcctaccgccccccacatacacgggcatcccctcccacccaacctactcgaaagagctggcagcccccggcacccggcaactttaattacaacgcccaccggatcgctcgaacggcccactcacaaactcagtgcgtacagcccaggcgaaaacgcaatcttatgccttaaccgaagaaaaagaccgctcgaaaatcaaacccaaccctagacgattccagacctggaccctaagcgtaatatcagcgcaccagcggccggaatagacctaagaacaaaatatccggtgccctgcagttaagcgccccctccggctggcggcctaatctactccgaatttcgtgcactctttgactatcgacgccatggaaactggcccgcccggggaagcaccgttggacgagcttgccggcgcctctacctagtttccctctttaagaacggccagggtgataaaaacaagctcttgtccctaacgtcccggccaccccggcgcgccggcagaatctcccgttgccacttacggcaacggcgcgtatttcgctcccacgcgttccccaacg

SEQ ID NO: 849 - DNA, 602 bp, Neisseria meningitidis
  misc_feature (7)..(7): N is any nucleotide
gcgtggnccccacggtaccccaccgaaggtgcgcctgacccgagcgaaaaacgcgcccagccccaccctagttcccgttcgaccctactagaaatggcaacccatttgggtagcacagttgtgtggaccatttggtacagagcttgaatgttaacacccccgaccgagtagaccggtcgtggtaaaggcaatgccaatacccccacggccttagttaagtacggtactaatctgggtaaagttcggaagtgcagctatcctcccaccctccgagccgcaattgcagtgcccgttcgcattggccatgttgaccctgttgcagaggcccctggctggggcacaatggaaaaataggccgttggcaatgccgtcggcaccacctaaacggacgtttatctggctgggacccctcccgctcctaatgatccctgttcgtactatgtttaatgaattgtgtagacagagccccccggggacgacccgtttgacggtggataaccttatgttgtgtgactggcgcccgttgtcaattgtacaaacacaagggccgccccccggactggggtggcagtggacaccgaagtgcctgacccggcaggtag

SEQ ID NO: 850 - DNA, 684 bp, Neisseria meningitidis
ttgcctttgttgcgtgtgcctgtttgcttgttttgtatctgttgccctttcgacctcgtcgggcaccgttaaaaaacggcggtcggtggggacgtcggtggaaaatcgggcgctgtttgcacccgaaaactttgtttaacctgatggtcggggtgcaccgggtggtgcgcatggtcacattccttaatctcccccagatccccttggacaccttgacccggccactggtacggtgacgtcgtcgggtcccaggtcgtttaaaaaccctcttgtattgtcctgcgtcccaaatacttgtgtaccccgggataaacggtatactagttcccttattcggacatgtgatcatactcatacttttccgggtggtagtaaaaaaggtcccccatggatatagtctaattcgacggtggtaacggcgtctctaggtactcggtatggtcatggtcggaatccttctacccggggtgtgtcgtatggtatggtatcggcgtcgtctaatatgggtgattgtcaccctggatgtgatgtgtcacgttgctcgaaacatcctgtgttgtctctacggtctaccattccttaccctgctcgttccagtcccgctgctcctaacattgtaaactttgatgacgctagtgtagcccctagcgtttctcccgttaacgttaatggtcggaacgtgtt

SEQ ID NO: 851 - DNA, 562 bp, Neisseria meningitidis
  misc_feature (517)..(517): N is any nucleotide
gtgcagttcctgacacgcatggtactacgcctaataattacttggatccgtgttgtacttcgattgaccatggtcctgctggatacttgccttgtaaagatcctttgacccttggtcacgcggaaacgtgccatgatgaagagtaaaaatgtgcgacccattaattcgccattaccgagttgtgtgagactatgttgtgcactgcttgcgaggagaatcatggcggttaacaaaccaagaaatcatattactaatcctggtttgtaatatttcgtggtgtatggtgcaccgtgcacgaccccggagtcggatggtgaataaactgcttgcgttgatttgtacactggttctccgtattgaggcatttgaaaaatcggtggaaattaaaattcactcgtaagtttcgtttcacacggattgtccggatcacgcccttacgacggctaacgagtaggtgcaccgcccggtagcagaaaaatccgctggcactgacgcgtttacttgtgtttaacatacntgtgcgacgcccgttgaagcaatgtgtacttctaactatccgacg

SEQ ID NO: 852 - DNA, 558 bp, Neisseria meningitidis
tccactcggataatacttgtactacttctatgtgtattagttactttgttaatactggtctcgttgtgtgtgtgacgaaaataacgggctcgtataaatcgattactgctgttttaaactcgacggtaatgttgacgatggaaaatttgtttgcgcccgatttggagtacttctaactgcccaaaccattggaagaaagtcctacttctgtccttggtgtggtagatgccctggaaaacgttattaccgttgtcctcccggatgaagtttccgttgatattattactgttcgtgtttcgattagttgatgatgtgaaaccatcgtgttggcgtaaattttgtgtgacccggcacttgaaccatcgtagattgtaaattgaggtgagaaagcggtatcggcccctggtaatgagatccctggtccgagtactgaagaagcttaagttcgtaattgatcgacgattactaatggtaactttgatcaccctctgtctaattctgtttaagttgcgtaagctgcgcgtcatgaaactcctagttaaattggcctgtttacga

SEQ ID NO: 853 - DNA, 448 bp, Neisseria meningitidis
ctggcctttgcctgttgcggtgggggtgcccgatgatgatgtgcccccccgtcgcccggtgcgtggcacgtaggagcgttgtcctactccgtgtcctgttgatgagttggcggaagcaggctaccctccccccaatggtggtatccccgtggtgcctgggacatacggggctgagacagatgacgctgggcccgttccgcgcccggataagcgtgggtacccgcctggtggtgccgttgaaacggaggccgacgcgtgtggtggcgccccgtgccctgggaccgaggagggtgtggtggacgttgctcgaaagtaggtaggtgatggtgggacgccgtctgaaggtggcaatggttagtttgagtgaggtgaggatgaagtcgctgtgttttaacttcgtggccgtgccttaaatggcggggcgtgtggcgcggccgatggtcccggt

SEQ ID NO: 854 - DNA, 627 bp, Neisseria meningitidis
ctggctttcgtagcgttaaacttaaagttcgcgtgtcgagattgttggccgtggtagaattggtactgtgggcccgtagggaacgggcaactgctgaaaacaattggtaggccgttgtaagctcgccctactatgttgaaattgagtacactgataatgaggccgctgcagttgaagtcgtcgttgtgcctgtacaaaactagccctttgccgttggtcctgcggaacccccttataacgccccctacccgagaggggtcgaggaatcgaggccccccgacgccgatgatgccgttagcccccgttacggtaattatcaaactggctcgttgtgtaagaaaggtgggaagtcggacgatactgtatatcctggtgatgggccggtatcgacggggcctgcgcatgctggcaacgatggggacgttgaatctcgtcccgatccccctaaaaactcccaagttcctccttaagttcatgttgtgacaagaacggacggaggaatggcccgttccgctgaaagaggtcccaaagacacagggaacattgagcccctgggcaatcctgatgcaacgtgtgtaggcccggagggcggaacttaagtcccttaaaatgccgacgttgttgaac

SEQ ID NO: 855 - DNA, 526 bp, Neisseria meningitidis
tatttagatacaatggctgtgccctactccaactagtattatggtgtatacaactaaggtcatgttcgttagtacccggccggctgacgtctgaataaaggttagagtgagccgacgttgtttaatgggctggctatgtttgcgcagaggaagcagttttataacgttatggtgaagaaggctgtaactaggccggtggggacggagctggcgccgttgaaaggcccgcagaagacgtcgtttaagctccgaactacaaaatgcgtgatgtgtgcattggtactgatggtggctaggacgaataaggtcctaaataatagggtgaagcgacattagaatgttactactgttctgtttggaactaggtggtctacaacgcgtgttacattgatcgtgagggcgggtgtattgctggtatgggaaaggacggcgcccctgttgatcctcccagtagcgcgtaatagggccgtggtactgatagggaaccgtagtccggcggcaactatcctggtggtggcaccggtac

SEQ ID NO: 856 - DNA, 635 bp, Neisseria meningitidis
actgaacttagtttgtaggtgatgtggcaagtacggtgtatagctcttcgtacacttagtgtgcatagacatggatggaccctcctaactggtaaatcgcggcaactggtaagttactggacgaccctccttgaactattgatgtagcaaagtctggcgtggccgtaggcagaaaggaccattgttcttgccgttgtaccgtcctgggtaagaccgtggatggtcccaggtagggtggtggtggtaaatgttagtcccctttgcacgtccaaaggcgtggcccgacgaccgagcttgatagtggcaagccgtacgaaaaaactggcaaagacgaacacagattgccaccacagttcaatcgtccttccaaaatatggataaaaaatcgtattcttgattgtaaaaacgttgctcgaaggcgtagcccttgcccgcttggtggccgttgctgggtagttgggtggcccaacttatcctgtttgtgcaccgcctggtagctagtagatcgctgcaactggtaatgcccgttggcccgagcccgaagaattagttcgtattgcaaggactgtcgccggtagcccttggagtgtccggtaaactcctgccgatggtaatgatcctgttcgtaactggcg

SEQ ID NO: 857 - DNA, 692 bp, Neisseria meningitidis
tctggcctttggtgccgggtactactaacctgctgaaactgcgtaacctgcgggtggtggctgttacccggatgccgcccctgatgagcatcctggtggcgtggctgacgagcctgggggtaactagtggtctgctatttcgcatgcctataataactaaacgtggtggtagtcctagtgtgatagaggtcctggtaaggtgtgctgcgttgtccctgcgttggcccgaagctacgatgatcctgacattgcgtgttcgataggttgctcgaacactgggacggctggcggtaatgatgatgtgtgtggtcccatcccccgttgttcgcctggtaatgtgtatgattactggcccgttgcggacgcttgttaaggtccccttgggtaggtgtgatgaacttagttgtgttggaactaacatgatgaacctggctacgtcccgagccttctcctgtctaatgtctgtgtcctgccccttagtacacagggaacgttgctcccaactggacaggtaagtcctgttcgatggtcttataaccttcgcccgcttcgacgacaccttagttcgttcccggcaatggggtagatgaggacgctcaagaaccccccccttacagggccgtccctgggcccgacggcctaactaactggacgtttctcctaacaccctagatggtcactacccaccctcg

SEQ ID NO: 858 - DNA, 634 bp, Neisseria meningitidis
  misc_feature (584)..(584): N is any nucleotide
ctagtctgcttccgcctacacatcgtatactgcatttgatgtgtttcgctgaaaaaacaagtgcagggcccgcaagccgctcgacgttggacacgtggtagtccgttgctgccaactaatcggctggacatacttcgtttgatagatccaactttgcatacaaaactgtgtactgctctcccttgaacgatgaatctgaccgtgggtctgctttgacgaaataccccactgatttggatgtctaagttgcacctccttgaaagtctttgccgtaatctgcgtacagtgggtgacgtagctcgcccgaggaaccccaaaacacttcgtcttcgtgctcggtctaccactcgtattagttgcctcccttatccgttgtttgcttaaaacatatcggcagggccaatttgggctctaaaacaccctccacttgtatctaagttcccttataggtcgaaatataccactagtactagtagggtaaatggtagggaaataactagggctacagatcgtaggccgttgagcttgcttgagtgtactagtaaaatggtaatggtagatactagtatgttttatacaattgntcgttattgcggtgtgtctaagttcccgctttgagaggcaacaccgccta

SEQ ID NO: 859 - DNA, 579 bp, Neisseria meningitidis
gctaacgtccgacccctggccctatctacaccccccttcccgctggcaagggacaaggacgtggcgtgggtcaaaacttgtatccgtttgtacacacagcggaccaataaaaattagcatggtgccgttctgttccagtctaaagagaatgacctctcaaggcgtcgaagtattaagcgagctggccttgcatcacccgcatcgctcgtggtcctgttgctccgcttcgacccccgccaacttatcacaaaaacaacaaagaactacaaatgaaacccaccactatacacccccggaaaaaacactacccgtgcgacgcccccaagtaggcaccccatcacctcccatagaactgggaccccactaaacgggcctggtagctggtggataattgtctaaaaaacacccccgttggatattaagggcccgcctacatcgttgaattcgttggccccgtacttcgaccgggcgcactgttccccgcttcccacaacgttgttatccacacccgttatccctttgacgaagttgcccgttgaaaacactttttatagttcctgtggtaatcgtcgtgatgaa

SEQ ID NO: 860 - DNA, 638 bp, Neisseria meningitidis
cccattcgaacgaactgcattaaaaccggcatccaacttcgaccctttactgtcgttcacaggacatcttaaaactaataataggacccttctccgtcttcccagaaacaatcggacaagtattcgaacgcaccttgcctaataacctccgaggaccaacgccccgacccaaagcatctccattcctaacgcagccctcacgcttcgaaacacgccctttccgagtcttactacgaaccccagctttaacagaccccgtcccaaaactaataccgtgggcccgaaataccctcttactcatagatcgagacaactccgaagtagcgccacgtccgcaggagctcgagaaacttttatcaattgtagttccttttggccccgttgttcccgctaggcccccgatcccggtaaatggtaggatgccgattagggtcctgatggccctggtggtaccggggccccttcgtacttatcggctaatggtcctgtttgtgtcgacaaaggggccgagtgtgttggtggtgatgttgccgacaaatcttacgtcgccgttttaatggctgagtccggtaccgcgtctgaataccccctcgccggtcctactggtgtggctggagaaaccgtcgttgaggccgtcg

SEQ ID NO: 861 - DNA, 122 bp, Neisseria meningitidis
aactaggatggacggcctacatggtacggtccaccttgccctttaaaccctgcgtggaacgaaatctctggttctgcaccgttaaagtaccgcgcttaaccttcgaagtcgtttgaatgaac

SEQ ID NO: 862 - DNA, 566 bp, Neisseria meningitidis
ccgtgtttagcagcgggcgaggcagaaaggtcgttgtggccgctgagcctgttggtcccatgcccaggtgacccgctgcctaatagtagccccctggcggtcgtacttaaagcgctggtgaggatccgggtcccggtaccgttggccccccgtgttaaacgcctaaatgacctggtgagcgtgaggaacctgtttagtgagctttagtgtaaacggcccctcctgaggaaccgccgaatacgccctggcgtagaattgcttgtgttggccctaaatacattgttgttgcctactaacggaatgacagatagtacccctgtgtccgcgttgagccttaaaaccgggaataagctggctaggcagctgtgtaagataccattggccatggagacggcgctcctgttgccccctagatgatttaagtcgaatccggtggtcctcctaggagtgaggatgtggacgctgaggttaccggcacttagcctggtaaggcaggtcccaattccggtgagtaggtctccgctgcgtggatggcccctgctgagttagaatatggtaggtgcgcc

SEQ ID NO: 863 - DNA, 627 bp, Neisseria meningitidis
taccccgccaacttatcacaccctaaacctttctctccctactaccacccaaacgtcactaccaacacaaccaataaaaccctacccttacatattgacgcagaagaacaataaaccaactcacccacaaatcttgacctccttctactgggccacatctactagaaacatctatcgaaacacacgttccccatacggaaaactatcagatagccgaaaagtaactagctagccttcgccaaaaatgtgcgcagaacccttgtcccactctaactggatatggccctaacacgctccttttcctaaacattaactgctaaattcggcttagttgaccaattcacacttcgattgccgttggtgtgatcgctggccctggtgtgatgcggtgccctttgcacccggctggcgaaaatggcggcgtgtgcacgcgcccccacctcgcactgtgacgtcggccactggtactttgacgaccccggcggaaaacgctactggatggtgtaaaggtgcgaatgtgtcggacgtgcctggtggtttgacgaatggtaaatttaccgttaaaacccggaaatcggctggtcggacgggtcgtctggtgtgcctggtactacggtccaccatacg

SEQ ID NO: 864 - DNA, 595 bp, Neisseria meningitidis
ccccggaaaattgaccctttcgtaaagtcgtcgctcgttgctgaaatgtgccgaagcatggcgtggtgtaattgaatggggttcgcacctgataagtcgggtaatagcgtggtgacctaggaaacgaattgcgaggcaggggtcgtggcgaaacgcgttctctttgcatccccgatgggtgaggtgggcctgttgcccgaaatggcggtatgtcacccttacaaaaatggcatgttgcgggctagtttggtaagggctgaacactcgactgacacgttgacggaatcgccgtagaaggtggagggtggtgccccgcacgctggtgatactgtttagcatagttgtaatacttaagttggcaccgttcccaccgctggaaaggtggaatattgttgtgctagggcggctgtactgggtagtagggtggtaggcctagatggtaccgttcgtgaggaaaagtcggtggaatcgtcgctggaactggctgcttgcaccttgttgtcgtgcacgtagtacgaagatacctttccttcgacataggggaccgttcgtaacgcggtggaaagttaaaagaccgtgttcgttctacctagcg

SEQ ID NO: 865 - DNA, 686 bp, Neisseria meningitidis
ctggcattttgctgcggtccccgtgggccccactggcaacgcccctagatggttcgcttagacaccttgctaaaaattgtgtttacctgttgctcgaaaatgttatactgcctagttgtcgtaatcgtgtgtgtaggccccttagtagttcgtcccggtcgcctaaacttccgtggcacctgcaatttcgacctcgtaaactggtgaccaatcttgtccttaattggccccttgaccggcagtcgtttgatcgcctgacccccctacaccggctgagtatgacgaaacctggtgccctagtgacgggcccggccctgaggcctacggtccactctcccgcctactactccgaaaaaaaccacagccacttagtaagcgccgtaaaagtaacccgatagccctccgcctccgcggcgccggtctggtaaacgttctaccagacaacgcagaacgatccgcaaagccaacaacatgccgaaaacagccctgctcgtcgctcctgggtaaaacactagattcccgtccacagttcaaaaaaccagtcgcccccctacataggccctctagtaatacaaaacgaaattgcctcattcgtcgacctctgacagtccccctaacaatcttccccaagcgaaggcgacacgaaaaatccccaccggaactattccgccccctaagaacactaa

SEQ ID NO: 866 - DNA, 599 bp, Neisseria meningitidis
gggtccccgcctcccacgataatcgttactcgctgggtcttgagctgcttccgatgcttgaagagccgtaccatggcgccgcgtagaagccccagaatgggagattccagcttcgtgcaactcggggtacatcctagacaagtaagggaaaattcatagtagtctgctagacatctgcagaatcctaagtacctgcgtccgatccgtcaatatcttcttcgcgttccctactactggctgctgcgtgggcagcttgcttctctctggcacttactgggttaaaaccgtcttctagatctgcataatccgtactattaaattcaggaatatccgagtcaattacttgcgagtcaagcttacttacttcctatggtcgatcctccgtagcgatatgcttatctaaattctcttcgtcaggctattggtttactggggcttcccctgcaggcttcctctcaggggcgcgggcttcaatcttggcttctgcaaagatctctaaagagtcctaatttatattaaatttagtatcctcactactcctaccctagtagtcccagctccctctaaccagatcactctcaattaaaatctagcattac

SEQ ID NO: 867 - DNA, 589 bp, Neisseria meningitidis
  misc_feature (549)..(549): N is any nucleotide
tccttaatgcgttcttcgagttactagaagtgtcccaaattcctaagaatcctaaaccgactcgagttgcaggcaaatttctttatatgggcttctacttcacagataggcttcttcagcttcttaagatccctctcttctgtagtttgcttcagttcttcatgatcctcactcgcttcaaacgtttgggcgctcaagtggttctatccctgggcaaaatagccccaaaatctaagcttcgtgcaactagtgcctcctcctgtgtcttgcaaacagcaaaaatcccaaataggcttttgttaagtccggaaaagaacctgtcaaaataaattcaggtgattcttccaaattcaggagcaaaaataaaattaaacgtgcccattgttttatttcttggggttatgcctgctggcttctcgattgctttgggagcgccgagactctcaaacttcctcctcagagctgctaagcctatatctctcgtccctgcggtcgttggggttgctgtcgagggtcttgtgctgcccctagggcccctactcagattcnttcgggggcttcgggtcgttaacctgccctacctagatct

SEQ ID NO: 868 - DNA, 666 bp, Neisseria meningitidis
  misc_feature (584)..(584): N is any nucleotide
tcggcttaaatatcttcttggtcgcggtcctcctcggtttaggggtgatattttggccctccatggtttctggcatcctaattctaaaactccttgctggcggtttgtatgcgttcttccggtccatcctcgggtttgggttcggtttgaggagggtaattggctttttaagtgtcagcttatcggtctctttactcgcagtcctcaatctcctctccgtgggcatccctaccgatctgattgctccttccaggagcttccttacgttcattgcattgcctgcttctatcataacaaaactcctaccaagaattctgagtacctcaaagcctactagtcctatcatagggttcatatctggtacctcccgcgtcagggtaattaacgtgttcatactcctgatgattctcatggggatcctaataaacaaagtcttcctaatcgtaattgtaattcttcgcgagcctgccaggagcctcctaccctcctccctcctacttgcaagcttccttgggtccggtgcaaagattacatctgcctaaattaaactcctgataaacataaattcgagctttgtagcttcncttgggtccgtcacgcctcgaaaaatattcctaccctctaaagtcctcgcgttctataagggatttcaggtacttatcatac

SEQ ID NO: 869 - DNA, 583 bp, Neisseria meningitidis
tggaactcgtccatagggttcctcctcctgcgcttcgtgcaaatctttcctcccccagctcctgctcggggttagtcagaactagaggggttccatctcggtcccctcccggggtttccctccttcttcagggcgggctctggagagacgccaggaataaaaagtaccataacctcatcaacttctacatacgataaagacgatccaattcaggtatggccgctggtactattggacacaagtcggtgtgggcactgaacctcacctaatcttcgatgccgggggcggaagttatgagaaaaaatatgctactaaagtcgggaaaaataactcgttgggggtccgtccctccaagatcctacccgtccgggttactaccttgggggcttggcttcgggtcagggctcttagcaggggcctatgtccgatctttcgctctgttgctaatagtctcctcccgatcttcgtccgtacctctaccctcggtagtagcaaggtcaatcctaaagtggtcctactcatccggggctcggtcatcctggtatgtccggcctgggctaggaacctcaccgacgtcggcccc

SEQ ID NO: 870 - DNA, 582 bp, Neisseria meningitidis
gccctcaaacctatccgaaaacaagtcttgagggccctactggtcttagggattagagtaactgtcctaatccctctcgtcgtaaaacttaacgttttcttttggatgccgagcgctctaataggatattcttcatggcccatcaaattcgtgagagtactgccttccaaaattaattcatgttcggcggttcggcagggaaccccaagctaagcaattggaagaaatgcaaaaataaatgcggttcttcgatcccctactcgctccgcaggcttcgattcgagagggcctggggccgctgctggtgcaggttcggtcttagtcgctgcaaaagtactgggcttcaataacaaagtcttagtttcttcgggatgttgggaatcatcagtcagcaccagggcccgtcgtgcaagaggctgcgtactgattaaaaggagctacatagtggttaaaagggggccacgatctgtaagctcggtcctcatccgcaaaatactaagagtgagtgcagcatggaggccgtggtaaggaacatgctctgcatgatcatccgaagggcgtgctgccgtccggagttcattc

SEQ ID NO: 871 - DNA, 628 bp, Neisseria meningitidis
taaacttggcaaatactttctctctttcagccggcttagtcggcttcctactaaacgcgttattaactgcattagttgtcaagtctgcctccataaacgtcattaatgtagtcgtcctcctccgagtctaaatattggttgcggcctccaacctaaacttagtcctaaagtgggcctccaatatcagggccgccaacaagttaaaaaaggagcctcaaaagcctcctaaaaccgtgcgcttctgcttcattcagcgtcgtcggcttaaacttgggcttcttcagctccaactgcgccgcaaacataggcttcttcagctccaactgcgccgcaaacataggcttcatcggcttcaacatcacagcaggggccatagtccgttcaaagttctgcttctctggcttcagggctggaaacttcttccgatccgtcgggccaatcccttccgtcctcgcggtcacgggcattaaggtctacctccgatcaaactttggcttcaacttaggctttaaactaaactcggtgtcaggctccctcctcctcatatctgcctcctcaggcttaaaggtcctcggattcaataaagtcctgatagtggtattcctcctcctctcggttggcacggtgg

SEQ ID NO: 872 - DNA, 605 bp, Neisseria meningitidis
tccggtcgttataaagaaaactccgggtagcctcacgatctccctcagggtcatctcttcttcggtcttcttccatactcatcctctcccctgctcctcgaacgcgttcagaggcaccgtcctcactacgggggtcagggtttgcgtcagggcagggggagtgggccggtgcagggttaacagcctctccagcggggcggtcatccgtaggggctccaagagtcacctggttgctcctaccgacttcatattcacctccctctcggtcgcgagccctaccgcctctaaggtggcgttcgtgacccggatctgcttgctcgtcctcctcagcacgttcataagtagcgacaactgccgccggggatttctattcggccctttcactacgttcagcatggtcttctgggtcagggtcacccacaactggggaatcatggcctcggggggcaaatggggggctaccggggcaataataacctcctgcatcgggctatgtagaaagagtgtggtaagagtggtccgtcctagagcttcgttcaattcccgggagagggtacatcctaggggcccaggaggtccagggggctcgatgtcaacctgccaga

SEQ ID NO: 873 - DNA, 625 bp, Neisseria meningitidis
  misc_feature (10)..(10): N is any nucleotide
  misc_feature (13)..(13): N is any nucleotide
  misc_feature (16)..(16): N is any nucleotide
  misc_feature (575)..(575): N is any nucleotide
aggcctctcnaanaanaaagttgtctgggtccttctactagtaattacttgcttttctgtcatagttctcgtaatatgggcaaacctaaatctcagaaacgctgcttctgcggctaacttcaaacgcttcagctacacctaatcttggaggtcttggcccctagttcttgcaaaaataaaagtctctggaataaatatcaatgcgggggacatcctatatgccaacgttaacatcaacctacttactgctggcttggaggccgccctctaaaatcacctcaaagtaggcgtcagggtgcgcttccgcttcctccgaaaattggcctgcgtccgctctaaagcctcaataaacctacaagtgatcttggtcagagtcttcaaaaatcttggcttaattgtaaattctcgagcatttctcttccatgcattaagagttattttcaatctagtcctactcaatatcagctttcgagtctttcatgcctacctaaacttcattcgcgcggccgccatctctttgctgttccgggccctatgggatcttctaagtttcattgtaaagattcttaagttcntcaaattcgtcttaattggggccaatactaatatactagttgtcagcttc

SEQ ID NO: 874 - DNA, 492 bp, Neisseria meningitidis
  misc_feature (416)..(416): N is any nucleotide
attattctccttcgatgcttgagttttgctgcgttagcggtaaacttcgttgctgtccataagcctatacttgtgttcagtttcaatgtcaatatacttgtaggatttctagtcagggtaattgcggggcttcggggcatcaatgcactagttttcaggatactattggagcttctgattctaattcctgcctctaacataagatttgcgtgcaatgcggccaatgcaggaattcttaatgcattcaaaaaccgggaaaaagacacaaactaggtctgcttcgtcggcatcttattaggaggtacattcgtcctactaaatactcgtaccttagacaacggcatcaacaaccataaagtactccgtaaattatattcacgaaccatactcagctttcggccagaaacaaaaatccntgtgataaatgtccggataaataatagatttcgattcagctacaaactgagagtcacaaatgctataggatttttc

SEQ ID NO: 875 - DNA, 579 bp, Neisseria meningitidis
ctcctcctaacttctaaaagttttcatacttcttgtaaccttcctcattgtcgaggtggtaatattcctcctctatattctgatgtatatcgtccatgtgatagtcctaatcctcaaggtagttagctttttactactcctaaaattagtaaaattcaaaaatgtgttatattcggggatcttaaaaatgattgtcctctatagatgggggggatacaagcacttctttcttctcttctcttccaagtctcctaaaagcttcttggaggttctgcgggtccgtactcagcacaatatcgtcaaagaacgtcccaaccggggcgcccgctagggtccagtcggcagcatcatcccgatctttaatactcaaattactcacaaatatagtcttagctccgccgtcgtcgatcgcgtcagcatcctcgtcccgcgtactcgggtccctccccgcagcgcaaggctggtcctggtggtcatcatggggcttttcacgggctctaatgtcgggcttaggctcctcagctccgtccgggtgggcatctcttatcaattcagcggctctactcgcttacgggcttt

SEQ ID NO: 876 - DNA, 582 bp, Neisseria meningitidis
aaattctgttcttcgtaggtttctctacctcccaagtgacataggtaagctgaacctaagggagtcccaagcatgcaaatgtaaaaaatgacaggtttatgggtcgcccaagcatccaagcgaccggtcgcccaagcatcccagctaccgggttcgagccagccaggtcgtaggtttcactacatcccagtgacataggtaagctgaacctaagggagtcccaagcatgcaaatgtaaaaaatgacaggtttatgggtcgcccaagcatcccagagaccgggttagctccatctcggtccaggtatcatgctctccaaagcatcccaggggccgcgaggtttgaaaaaaagaaaaaaatagggctaatgggcggaaaaagaaacctgcgcggggaatcagcgcggcagagggaaggtgacaaaccgactgagggaagacggattggggtggagggaaaaagactgggtgtaaaggttagcaatcttgtaagatcagagctacagctgtgagtcaaaggaacgggtaataggggcgggaggaaataggggaggggacttagggggtaagagatttttaaagag

SEQ ID NO: 877 - DNA, 505 bp, Neisseria meningitidis
gcctaaaaaccagctcgggctacagttgggcgtcccgtcccaacccgcggggctactccaggggcttgagaagcacacccaatctaaatttcgagtcctccagcttcttcagatcccggggataggagtcagcttcgtgcaaaccccggggagttcggtacctagatccctctcaactccaccagccgcgtctctaccatcagcacgggcttcgcaaacaaagctcgccaattcctcagccgaagcatccctaaagtggctccggttctttagggtacgctgggtttcagggtcatcatggtcgtggttctcttcgcgagtagtactcggggcctaatcggcccaatcctccatccggttccatccgtccgagacgcctacatgcttctcttcagcactactaagaaagtcccgcgctctctggcgctcctaaagcgcctcatagaattcttcaaccacaacttccagaacctaaaggtccccctggtccccgcggccctctccc

SEQ ID NO: 878 - DNA, 666 bp, Neisseria meningitidis
  misc_feature (645)..(645): N is any nucleotide
cttggggttcatagcttggttcttataactctcggcgacttcttggtcatacaacttcgttaattgggccggggcgactcggttctatccggggtagtaggcagctccgcgggcaaatcggccgaggctaattacttcgtgtaaagatctatttcgggcgggagtctctaatgcagcttatctactagaaatatttttcttagaattagataaagtatgcttgcttctattcttgggcttcggcatgcagctcgctgccttcctttgcttctttagtatcttcaggcttacgtcctgcttggtaggggcttcgataaatattgtcttcttcagggctatcttgggctcttatttcgatctacttctcttcttttcgagaggggcagctcattccttcttcagcaactctacttataagggggcatcccatccagtcctcctagatatcgtcgtcttttgcgtcctcctatctactttaaataaacgagggcttctagaacttgcggccctagagaaaattctggttcttgtccccagacttaaatctgctatctttaactaaaagttcttggtctaggctggcactaagaaggtcgatacgtttgcttccgaaggggcgggaaatctaaatcaattccaagttcntcgggggcttctaagtacggg

SEQ ID NO: 879 - DNA, 533 bp, Neisseria meningitidis
atatacgagcatatagaaactcgtaagtcgcgcggctttgcggggccaacccaggcaattggttaaaagaacggggcaggtgattcttttcacccatacagcgttaacgcctccccggtaattcagaaccaaaggggaagtaaagacaagtaacttgcgggaaaggggcgaaagctcctagggtacatcctaggggagcttggctttgttagcttcgcagcggtcagcctaaaattctggtcctccgacctccgaaactcggtctctctcgtcctcactgtggttaactgcggcttcatcagggttaaaatctctctccctaacattccactccgcggttaaaaattcgtccataccggtaaaatccgtagcttggtcccaaggtcccctacaggcttcttctacctaactaccatccagccggtacatcctagcctggtggttcgggtttaaagggtcgctccaagcaaatgtgtccttgtcgaggcttaaactaggggcgttaaggttgcaactgctttcaatcaagtcca

SEQ ID NO: 880 - DNA, 661 bp, Neisseria meningitidis
  misc_feature (12)..(12): N is any nucleotide
ggggctgctttntcggggtagggccggaactcaattagttagagggacaataaatggaaacggtttagggggagtaaaaattgtgaaagcagggggagcggccttagtgaaagaaaattgagtattccgggggaagaatttggccgggtgggggattaacaacatacatgctttggctgctcgtccaactcggcgtggggtgcaaagggcacttactgcggggttaaaaccaggagggggtagcgagcgatgtagaggtccgatactattgggaggacccagagaaccatcagggggggtgaaaatggttggcattggggcgcttctggttttgggaggactctcaggtactgtgcggttcatcataagagtaagaatcctgggcctagtcggttaagttaagcgggtcgtcaagaaccgccgtaccggcgtcctgaaaggagaattggtcgtgggtaatcgtgcggggaaagtgtgaatcggcaggggtttcggggggaagttggggtgcctgattggagaaattatggggctactacggataatactgggaattctaggaggggtgattctcggggcgctccgggcgctactacgaggcatagtgttgtttcggatcttgctaatgcgattgcttctaacgggcctagacctccgaagg

SEQ ID NO: 881 - DNA, 625 bp, Neisseria meningitidis
cgatctatcctccgaatcaagttcctcacctctatctgcgtggctcctggtacatccgtgaagggccgtccgctcagggcctccatggtggccctagatcccttcaatcccgccttccataccgaaaacttcagcatccggggggtggtcctcacgggggttcaggtctgttatagtcctctcgtcagcacttctattccggtcagcctcgtggttagtagcgtcaaaactttctttgcaggcctcggcctcctgggggccgtcctcggcgttagactcaccgtcagcggtcttaacactagcctctccggcccggtcagctgcgtcaatctcttcttctcgagtacccttgtcacccgctcctccggtagcgcggtgggcttcatctctgtctacaacgttaatacattccgaaatggcttcttctgggcttctctcctccgcagccaggtcatcctcctggtctttcgcttgggaagtctcttcactctcgactccaggggtagcgttccagatcctcgcaactccgacgtccaggtcggcagcgtccctcctaccaatgtaagcttcggcctctcctacgtcggcgacaaagctggcactgccgtccgcggcgttaaggtcc

SEQ ID NO: 882 - DNA, 675 bp, Neisseria meningitidis
aatactctcctctggctaaaagagccccaacactggcagcttcggccgcaatagagtaggaaacttctgtacctacatctgggcgtctctaagatcttactccggctccagaagcctgggaaaatccgtacaaactgccgtcgcggtcgcgggggtcttctgcgaaaatcttatctgggtcctcgccgtctctatctccagcacccaagaatccgacgtcttcggcacgggggtcggggtagaaggcgaatcaagtaaacccggcttgagttatagcctcagaaaccgtcttaaaagtataaagagagacataaattaaatcagcttcgctccaagcgtcaacttcaatatccgtaccagcttacttaacttttctaaaataatcctaaaggttacacaacgaatcattcaaggcattagcttctctataaaggtcagccgtcaactcagaaaggttgctctcgttgcggccagatctgccgtcagcggcgttcctctcgcctcctctagggctacctccgacgacgggggcgtcctaacttactcgctgcgtactatggtcggcacttctgttcattagggaagtcttaacttggcagtcaacaacgtcggcatcatcggcggaaatctttcgagtactattatctttctcggtaggctactaaataggtaaaa

SEQ ID NO: 883 - DNA, 497 bp, Neisseria meningitidis
cgcctgggatggattgggtgacgtagcagggagtgtggccggggggtgctttaaaaaggactataacgtttggtgcggcgcacaaatgggcctaaaaagagactacagccgggcggctgcggcgggagggaccaggccccagagagagttgccggcaaaataatacggggcagagctgagccatgcgcggccctgaccaaaaaagggagcaaaaacaacgagtgctaaacatgcttagcgctacgtggggggcggcttccgtgggggcgcgtgcagcttcgtgcaactacgtgtgctatcattgggcgctcaagagggctgatatggcctaagttcgttaggggggtgtatctggagctgcattgagattttctttcagctttcattgtttcttaaaatttatcaaaacttcgcctgctgctgcggcagcctcgggcttgccggcgcctttcctcgcggggtttatcagggcgccaagttgcatcaattgcttcgtg

SEQ ID NO: 884 - DNA, 656 bp, Neisseria meningitidis
ggggaaatagagggagggggtcgggaatacaagagagtcaggagagtacatcactgggcaggcttcccggggctgaggggggcggcgaagaagtaaaggctatcggcatgagcgtgggtgtccgaaaaagagaatccactaggcggggaacttgggtagaatcggtaggaaggttgatctgagtaccgacttaaccccaactgggaagggtaaaaacgggttaagggccaattaggaacaaagtaagaagccgattcaggttaagcataatagagtggccgagcgttagtccagaaccagagggggggtgaattgtcaggaaagtaggtgttaatggttaagaggtggtagtagtttatattttcgtagtagattagggcttaagaaagcaaggggtcgtagattttgtaaaataacgaagagggtggtgcaacggggggaatgtatatagaagatatagaagaaggaagtgttaagatcagggaccgggggagtaaagcgattcgggtggcgggtggggtgcgaagcggaggtagtcgacgaaccggtgcggcaagaaggcgtgggctttttcctaagcagacgaataaggggtttggggctggtttaactggcgatgttgagggtagtaaatgtagacatagagcgtccagaac

SEQ ID NO: 885 - DNA, 535 bp, Neisseria meningitidis
cgtgccaggtttcttgctctcccaagcatcccgggtaacaggctacgcggcgtcccaagcatcccgggtaacaggctccgcggcgtcccaagcatcaagttagttagatccaaattgctattatcgtaggtttatccaacgcccaagtgacaagtttccccgggtacgtagggttcagacaggtttcttctcgtcccccgtgacaggtttcttgctctcccaagcatcccgggtcacaggctccgcggcgtccaatctaatgcaattcgtaggtttatcatacgcccaagtgacaagtgtcccccggtacgtagggttcagacaggtttcttctcgtacccccgtgacaggtttcttgctctcccaagcagcccgggtaacaggctccgaggcgtcccaagcatcaagttagttagatccaaattgctattatcgtaggtttatcaaacgcccaagtgacaagtttccccgggtacgtagggttcagacaggtttcttctcgtacccacgtgccaggtttcttgctctcccaagc

SEQ ID NO: 886 - DNA, 631 bp, Neisseria meningitidis
gcttaatattcttccaagtcttatcaataaatttcttcttcgtcttattacgcttgtcttaagtcccttcctaattcttctaagatgtagtgctttctgggctttcagaggcagtaccctcgccgaaagtttttaaattcgcttcaatactttcagaaatcctctccgtctcttcagccacctaactctccgtagtttcgaagtaaattcctctagaagtgctcttagatgcagctccagggcaagcattaaagatgtcggtaatcctaaacttgctcttacggtccatctggtcgggtcctccgacggctccgaacatgctaagcttgtggctcttacgggccataaacctctagtcatcctctctatgggggtcattctcgtcggtactcataaacgagtctctagagcttcgggcatcctcctaggtttgggctctctttcagatactggcagctactctaacataattaaatattatcggatcagatgtagtaatactagtaatataaatatattaagtaccatcccagtctttcaggtaaatatgaagggtaaaggtagaagcaggttaatatgcaaaaaattaagtaaatagttaactgcttctaaattctgctcctaattcttg

SEQ ID NO: 887 - DNA, 533 bp, Neisseria meningitidis
gagggcatggtcattcttagtgttagcgggggtaggtggccactggttgcggtggggacctccataacaaggagcaatttaaattttggttcgggttcttgcaggatttggcatcaacgaacgagcttaagtcctaatccgtacaggcgacctgggcactccggggccgggcataatccggggctccatccgggcccggtgcttctgggtccagaatacttgctggtttctgggtaaagtggttctgggaagttagggcttcgttcaagaaaatccagccagctccggccaaagtaccagggcctgcggcttcagcttcgtgcaaacttccagagtctggtacatcctaggggcaggcttcccggggctgaggggggcggcgaagaagtaaagtctatcggcatgagcgtgggtgtccgaaaaagagaatccactagtcggcgcaagtgggtagaatccgtagcaaggtttatatgagtacctaattaaccccaactgggaagggtaaaaacgggttaagggccaattaggga

SEQ ID NO: 888 - DNA, 571 bp, Neisseria meningitidis
ggctaccctcctcggcaccttcatcctcatccggggcttcggcgtgggctcctctacccgtacgcgcttcggcagggtcttgatattaaaccagaacaccgcctcctccctaaactcgtttgctaggttcagcttcttaaacttccgggtccccctgctcttccgcaccacggccatcatccatctccggatcttcattcgcttggtcgtctctctctttgctagaaacctggtcagcttcttctcggtccctactgtggtcttcgaaacgctgggtacattgggcagaattagtaccgatctctttctcatccgtccctaccaagcgttctatacctctatcctagtcctcgactccgaacgcaccagcttcggggtccttctcttcaccaaggtccttaagctcgtggccatccgaagccgtcccctggccggcaacaagcagcccaaagcggtggcgcgtagagccgggcgttgggtcccctcctccttcggtacatcctagttcgtaggggggcgcggggaaaatcacagacaccaaaatcacgttcttcctaaaggtgatgatgat

SEQ ID NO: 889 - DNA, 592 bp, Neisseria meningitidis
ataaaatagctacaggggcctaaacgccttcgaggcagccctccgggggttactcaatcacaaagtgtctgccatactcctattcttaggggcaagctgggaaaaactaaacctagacatctagatcttggtcagttgaaacaaattttaggcgtgcaaggcaacctataaccggggtacatcctaggtaatagttggtatccgatggatcctcaacatcccctccggtacccgctaggccaatgcggccctaggtttgagattcctactccgcgtcttctagttcttagtcctagccataaagattctgctaaatgcagggcctacctaggcccaggctttcggtttcacggtcttcgttgctatcatcatatgcagggtcagcttcgtcaacaaaaagcccttgcttcagcgggcgcaaattcctccttcaacctactactcgacctcgccgaaaacgtaaaccaaaaccttcgtgcaaaactcgggatcaacaaggcaaatattggtaccctcaaagtaggcttcaatcggggagtcctcctcctcaagaggttgcttttcgttgcaatcctaaaccctgctttcctag

SEQ ID NO: 890 - DNA, 588 bp, Neisseria meningitidis
gttcttctaatggtccgagcttttcgttgcaacctgattctaaactttgctcttgcagcaacgatcctacaaaaaggtcctggctttcgaagcattgggagtcagatcttccctctcgagtttcctagtcctctccaacaatctccctacgtccaacttagtcctaaaaattgcgatcaatgcatctcttgctctcggttgcggggcgcgattcgtagtcctcaacctccggtaactccgctcggcctccgtctttgacctcaggatcgtaagagctgctaagatgtcattgaggtgcggagtgtttttcaacctgctctcgtgaggggcgccaaaattcttcaaaacctcctccagctcctgtaactgggccctaggatgctgcattcttgctaaaactgccatggccgtcagattcgtagtaaacaattaggccctcctctctagtcccagggtccctaaattagcaaaaatcgaaaacttcggggccaaaaataatgctatcaactctaaactagtttctggcttcagggctggggctcttcggggcattctaggagcctggatcctaaaagggtccaataagaa

SEQ ID NO: 891 - DNA, 513 bp, Neisseria meningitidis
agcgaaaccgatggaccaaagcagaaaataaaagacggggcggttcgagttgcaactaagctggttgaaaccagggaaagagttctaaacggagggaaaaggactgtaagttatgtagcttaggaatgatcagcaataagaggtggggttggccgccgggcaaaagctacaaactaagagagtacaacgaaggcatagggaggggcaaagaatgcctaggttaaattgaggattggggctgacaaattaacacgccctgcttgcggggcagagggtacagcaagtaccgaagttgaaaaggagacgacggaagggacagaagatagaagaggatcacatggggcaaaaggggcagatggcctgaaaacaactgcaaaagcagccggccgactaattcgaccgtccaggtgtcaagttcatagggggtaatactcctagggtccaaatcagacatctcgtaaagagggggcgtccagataaagagttcattgatagtgtgctctactaaatggg

SEQ ID NO: 892 - DNA, 408 bp, Neisseria meningitidis
cggcggggtaggagggggttggagtgcatcccaggtcccgggcgggcccaccctctcctggttctggttccctcctctctcccagcgcttgagagcgctccggtcctcggtccctccagagcaactatctttgaccagggcgtaggaagggggcttggccgtgtcctggtggttaagtatcaaactatttcttaacctaaatatgcgcttcttcctaacccacctcctccggctccccgacttctgttagatcaccaacatcctaaaaactacgagtaccagcctctgcagcaacttcgatacggctttctcttgcggcaaccgggccgtggcttcgagccgggtcgcttccatcctggcggtgggggttcttaggcttagaagctccgtgcttttcggctgcaaaaa

SEQ ID NO: 893 - DNA, 482 bp, Neisseria meningitidis
  misc_feature (437)..(437): N is any nucleotide
aactgatgccggagagacagacagttacgatgcaggagaggcgtgtaacaaatggaaaaggtacatagggagaggaaggaacaccggggactaacacgcttcgtaaaagagaccctctagtagtcaaggtctcaaacataaatctgatcagcaatcgggtaaccagggcaaaaaacaagttagacctgagtgcaattcctagtttccgggccgcgttcatgattgcaacctcctaagtaactgcgtccggtacaaaaattaatagtactatcttgaaaattcgaggtataattgctgttggggtaaaatagggctagggaaaacttcggagaagcttcgtgcaatagtgctttcattataggagatcgcaagcgtcctacaggcggggtggggcgaaatggagaggaaaagttatggattcaggtatcttagcttcnttagtttgcttttagtgctattagttcactatatgcgtctagccc

SEQ ID NO: 894 - DNA, 556 bp, Neisseria meningitidis
atcattctcagatcctcatcctcgctcctgtcaacgtcttcatattgcgtttcttgatagttctcatgggtgctgtctctaaggtaaatgcattcttcttcaatgtgagtaccgtaaacctttccgtaattgtcgctcttgtaatcttcgttttcattgacgtaattcttttcagggcaaagggtttatatatatcttccctacatgcaaacttggccctaaaattctcgttagaggtcagggccgctcttaagtctttagttgctgctattattttgattaagtcggtcattttcggcgtcaaagcagctctcaacttcttcttcattttcttcgctggcttcgtaaaagcatcagggattctattcctatctcggttcaatgtcgttctctttgcagcaacctcctatgtcttcctaaataacgaattcgtcgtcgtcaatgcagcctctcggggcatcaacttaataatcgtaatgccctcaactactgtcaacacctccctctctatcgtcgcgatcctcgcggtcctgataaacgttatcttaaaagccta

SEQ ID NO: 895 - DNA, 512 bp, Neisseria meningitidis
cgctgggtcatgagtgcttgcagctgcgtctgcggcggtagcaacaaagtggttcgcttcgcttctctgggcactacagtccgtactttgggggtcctaattgcccgaggcctaggcgtgggcaggggcatccgcagccacggccgcgcctgtgtcttgcgcagggccgctagtattcgtcgagaccctcattaaactagtactatcgtccaaggcttcaaactcggggtcgtggggggtagtatcttcagcatccgtaacccctcggggtgcaataaaagccggggatttaatccagttcacgttctaaacacgggcgtgggcataggggccgtcagcatcatcattgctctcgcggtgggtatagtcggggtcgtaaatacttcctttcggggtactggtacgttctctatcgtcaaagaggcggtctttatcttcgaaactcacctccgtaccgtccgcggctccgaacgtactcgcttcatctgtcaacgtagccctcgcctccaact

SEQ ID NO: 896 - DNA, 666 bp, Neisseria meningitidis
  misc_feature (649)..(649): N is any nucleotide
tccgtaagttaacctcataggtggacatttgcgcgcgaaagtaccccgagggggctcgccaaagtcgtaaatctggccagcaacctggcattaagtaaagattacagaaataaatgtctaggaattataggggaaaaaagtaacgggggccaacgatgcttatcgagcgaccgactgggcattcagagggctagaaaaatgttgggctgccgcaaaccaaggaggggcttaaggggaaaagagggtgcctattaaagacgataagcataaacataagtagcttaagcaggaaagtaccagactgacaagcacgtaagaatcgtaagctgtttcttctgagtatattcagaggcagcagaagcgtaggccagcgaaaaagtagctgcctgggcagagccagggtgggaggggcagggggctgtacgacagagaactatacttacgggctaagtaagcttaaaaagcttcgcttaagtagtacggcagaaggccctactgctgtactattcagaaaatcttgaagtatggtgagtattttaaagaatcttaagaggagtgctcggagttttcttaaaaagcttatatcggggggagatcttactcgtagattaagcctgcagactcttaagagagacataaactgcgttcntactagagtgacatgag

SEQ ID NO: 897 - DNA, 633 bp, Neisseria meningitidis
gtatagcttcagcgtcctgggtgcgggccggggccgaagttcggggtgaatgggcctagaagtcggtacgggcatcctcctaaccggccccctcaaccacatcaacttccagtggatcttcgggggtggtaccagcctccgggtaaattgcggggtcagctttcaagagggcagcggtaaggtcgtaaccggtctttgggagcttcgggttctattctaaattcttccccgtaactttgtcctctagttgcttccaatccaagttttcgctgcttcaggcatccggtaaattttctctttcgggtaaagattcctcagcgccatccataccagctcttgcatcaaaacatacttcagattcgggttaggagtcctcgccctcataggagctgtcctactaaggagttccgtcaggattgctttcagattaagaggtgcaaaaatcgtcaagtgcttggctaacatctccataggattcgtcctaattgtcaacctatctgcgggcatcaacctccgatcttcaaaaagcgctaaatttttaaaagagctgagctaggttcaatctttggtctagatccctaagattggcttcatctcccaggtcatgattgtactggtcttaataattatact

SEQ ID NO: 898 - DNA, 624 bp, Neisseria meningitidis
  misc_feature (550)..(550): N is any nucleotide
cgtaagaaaaaatactcgtactcctggcaggggccctgcgcctctctcggtgcttaaaactctctcggttactggcaaagcggtcctaattctttctgctagtagtctagttgctattcgggctcaagaccaagaacccggcagcatcctatttcggggtaatgttaacttcggctggaatattattatccggggaggtaggggcgtcaggggtaaagttcaaagacttccagccagggctcttaaagtggtcttggggcttacgggcaatcgtgctgggggcgttggggtcgggaaggtaaagggtctggtgggcttcgttcatcatattacggggattcttctagttagcttctttgctagggtggttgcaaatatctctatcttgggcattactttcgtcggaaatctcgtgatgcttcgtaaatccgaaactaacggcgaagaggtagtcggaaagcggctattcgactctaaaagagaggctccggggaactcgggcagaggcttttatcggggtctctgagtgtcccgtcccaagggagctccngtcgttataagtagaaatccctctatcctacttaagctagtaatcccaggcgtaaataaagttggtaagcttgg

SEQ ID NO: 899 - DNA, 473 bp, Neisseria meningitidis
gacagacaggctcttaaatccaaagtctccctagtcatccctactttcacgcttaaaggcctggtaattcgagttagattggccgtggctacagcagacctctccaggggcggaagtactttcagcttcccgttggttgcatctacagacatcagcagcttctcttttgtgcgtgcgattctttgtagccttctggtaacggcaccgttctacgtctaggggtgtcacaatactctagtcattcgtacctaggtccacgccagctctcgtacaattccaggcttcgtgcaaaaaggattcatccgtactctcatcgcggttgctttcgggcttgtggtaaacatcgctagtcgaaagatcttttaggtccgtcctacctcctaccagcttatagccggtaatagggtacatagtggtatgtttagtggggttcctacatagatttaatactacgggtaaaccgggccataaac

SEQ ID NO: 900 - DNA, 598 bp, Neisseria meningitidis
ccttgtgtcccaacctgcattctcggctactggctacaataaccggagtacaggctatggggtcagaaacctgcttcttcccctcaatatcttcttcttgagcggcttcttcttagctgtctcttgctcctccaactccgtcaacttatctttcaacgccgtacctgccctacctacactagtttctgggcctctcctagttcagcttcgtgcaatatctatatcagcagctaccaaaatcctacttgcaggcgcgcctatccctaccataacttaggagttactcacggtcgttcttagtgtaaatctcctcctcgactccagcatcaaagtcgttcggcctctcttcatcatagtcttcaatctcaattctaatgtcctccatcgggggtacatcctagtgattgcttcattcaaccttactgtcatccctcctaaagaggcgtgctatggcttcatctgggccatcaatgcaatcgttttgcttaggcccaatatcaagctcgttttcaaccttgctaactttaagatcatgcctgcagtcatgcttctcctgatcctctaaaaattctcgccaattaagtttttcactatatta

SEQ ID NO: 901 - DNA, 631 bp, Neisseria meningitidis
ttcctgggcccgcggctgctcggggttttgcttttgctggttcctagtaggcttcataaagttcttttgaaaaattaataacttcggaggtggtacatactaaatccgggcttctaacgtaagaggtaaatgttcgtagtttaacctcgggtgcggaattcaggtaactacggtcagcggcagcaaaaacctcgaagatgaaataatacttctactaagatctaaatctaatgtccgccagccaggtaacctaagttttagtgcctatctcctcaactctcccgaaggcgcaattacaggcatactacgaagttggtcggcggcaatccggagagtcaacgtcctcctaaatctcttcaacgacgtcggcttaagttcgtccctagttcgcgcaagcctcctccaggcaggaagcttctggtccggatctgcatggtccctcggttgcggggcaagaatcctaagtgcatccctgggcagcgggtggtcccgaaacgtcgcaggccccctaaaccgggccagattgtgcagcttcaggatatttcgagttggacgtcgctgctgcaaagtaagctccctcgggccccgaaacagcgtaaccgccgggtcccgaacaataaaggccaggggc

SEQ ID NO: 902 - DNA, 449 bp, Neisseria meningitidis
ttactggtgcgatcatcctggctacagcggctactataccccctaccagctcctccctaggctaatcctccaacctccgattggttagagctataaacctaaacctagccgctctcaacgcggttctatatctaagagctctcagggcattcctaatcttcctagtccttatcgttcggagttgatgctccctaatctacctactactctccacctctacttgggtgatcgtactgtcttcggtcctagtcggggcctctataatcctaattgtattaatatgcttcaatgcgagcaaaatcgcgcgaataaatattgctcttatcgtaatattactgttcaggttcaacgtggctgtaatcgaggtctctatcaaggatcttctcaacgtgtgaaaaatcttcatttccattcctgtaagcttcataagaggggtaatcttcggcttt

SEQ ID NO: 903 - DNA, 570 bp, Neisseria meningitidis
gcaaaaccttcgcttcagaacttaacgcgcggggggctcgggctctgtcgtggcctccagccggcacctaagcattcgggttaatagtcaaaagcttcaacgtactcgcctcaaaatcattactactagaaagattctaaataaaattcgattcaatcctagtggtagaaatatgctccctaagatcagaaaaagtaagtttccttttgcctgtccggtaaaattcaacctcaatattcctccaaaaagtattaccttcctaactactcaaattaacaccggtagttatagaagtcgagccttccaatccaatagagttgcagtggggtttaaagagcaactcgaccgaagtagcctccaaatcttcagctgtaacctaaaaaatcttgccttgaaacttcgaagtagtcgagtcctgggaaacgatcattaaggtccgggcactaccaaacatatctttgttaggctatttcctactcgtactcaatccaggcttactctaagaaacaccagaaatacttttcctagtacagaatccgggcttggggtaagcttcgtgcaaagcttctt

SEQ ID NO: 904 - DNA, 643 bp, Neisseria meningitidis
ttgggaatcgcttggtcaatatccgggtcttcgtctctaatactaagattcttggcttcgccgtctccggcctacttgcagaggttcttataaacctctaaagttcgtttctctagaggctaataatattctcgttacggttattaatactcgggttactactatcctcctagtcctaggcttttcttctcagcttcgtgcaaatactcaggctatccaactcctaggggtgatggttggccctaccataaaaggcagcttcagattcattatcctaattcggggcttctttcgttgcattcgggtaagtacaagcttctttaagggcgtctcgttcataattaaagtaggcccttatggaagtgctatagttaaattgaaatctcataacctctcttcatatcttatgcttctaatacctcatactcaatttaatgtagatgctccttccgtaaatatttacttaaaatgcaatagtacatatgtctttaaatccgctcattatggttcttttgcttctttttgctttggatgggctaccgcccgtatctagagccggggcgctcttggcgttcctctaagttctcttaaggttacgagtgtcgtcggctgccatctctatgtcgctggtaagcttcgtgca

SEQ ID NO: 905 - DNA, 409 bp, Neisseria meningitidis
ctcccgggtctcttaaatcacagacgtctctacccctcctagacctcccggcagctacgccccctacagcttccgccgcgtggtcgtcgtctgcgtcagcgccgacctcggccccgtcaactccagggctgctagcatcctggctcttaagcttgctcttgcaataatcgtcaaaggcaagggggtcaccagggtcggtaatacctccagggtcttattctgaaaggttctatgcgcgggcaccagcacctcggcagaagtggtcggcggcaggggacctaagaaagtccggggtacccgtagcaggggagcgtccccctccaagcctgcaactcgcaaggagactccagagcctcctcctgcggctaaactggccaggcccgagtcgttgtaaaatgggagacgccag

SEQ ID NO: 906 - DNA, 308 bp, Neisseria meningitidis
gttgtccagtggggggggggggctttccacatccagcgcgtctttcaaaatcgcagcggtatcgtggtattcaaaacctttcaggtcaaacaggttgcccaatacgcgcaacactttccacagcggacgcgaatcgccgaagccttgtaccacgccgtggaaggattgcagacggccttccatattgatgaagctgcctgaggtttcggtaaaacggtgcaaccggcagcaaaacgtcgaaaacgtcaagcacggtttcgctgaaaaacggcgtaaacgcaatcagccttttggccggtttcaacgcg

SEQ ID NO: 907 - DNA, 536 bp, Neisseria meningitidis
gacgaatcggtgtggactgagatggcaaagatcgtgttgacccttaaaaggtcgcttagtggcccggcccctagcctactaacgatatcggtggtgcgtgttagcttgtccgtcctaactactaggtggctgggtccggtgctgtgtagtacccctcgtatggccatgtttacccgtgggttggtggcgtaatataaatagttgatggtgaccctcgttatagggacgttgccgctgtctaacattgtgttgctaacgttgaccctgttgaatctgccgatgacgacgatttaccccctgcctgggctcccccgtgttactaggtccccgagtgtggcggccccgttcgccgttagaaaattcgaaactaggcggatcccggcccaccctaccctcacgcgacgctttatcccaaaacccgaagacagggcgccccaaacgaccaaacaacgccaaaagcgacggtagtcgccactacgcctcctactaaccgataaccggcttagtaaacctgacacactggtcgatactgttgg

SEQ ID NO: 908 - DNA, 584 bp, Neisseria meningitidis
gcgtgtgcgaaacggtgtaggacccggccgaccacgttgacgaaatggcgttgattcgtcggcgccgggcatgtatggatgcattgggtcgacgtattccccaacgggtagccccgttgaaatggcaacgtgttaaagttattcgttgtccccgaccacttgtcagtacaagttgaagaggtgcagaaacccctagcccgaaggttccaaacgcgaccccctacacccaaggtcccccaacccactcgcccccaatgggagggtagcacgttcgaccatacttgtactctgtgtgttgctgatagttcgtgtgacactaaaactattttctacccttcgttgtacatggatggcctgcgttccaccgaacgtggtaacattaaagcgacccgcattgtccttacagacgaaaatgccttgttgccctcgtgtggcaaaaattaaggtcgggcaatggtggaacatgggacgtcgttcgttctaatcgtcctttggacgtcttgtgaagtcctggtgggtaaatagcttgggtgtatataagaaacttaatgcccgactgggtgcctttcgtgtgtggctgcgga

SEQ ID NO: 909 - DNA, 435 bp, Neisseria meningitidis
cctgggtaaagtaaacccccctggtaaagtaaaaattttgaacaactgggggcccctcgaacgggcgcccggtagcgattcatccctgtacggaagaattatatcactactggtgtcgagctgccctatggcttcgcctgggacgggaaggtgcgggattaatctgtcacggttgttaaatccaaatcgccataaactggcaaagttccaactaacacacctggcaacgatcgaactagctagcaagtccccactctccgaagcctcctaaacgacagagctaagttctatgagtaaccagcacgggccagtcctatgtgccattgtgtccctatattttattcactaatgcttcggctctgaatgatctcccagcgtggccaaattgtaagggaagctctactcctaggtgagccctgtgtccagacgtcccta

SEQ ID NO: 910 - DNA, 598 bp, Neisseria meningitidis
ttgcgctaggacgctcgttcgacatagttatgttaaaaacgtggttgtgtttgtattgcgcgtgataatggtgatgcacccgttgtgcacgtgcctaaacgttgctcgaagtttcgttcgttaccttttcacgtcccgattggttgatgtcctggatactcgtatgatgggacaatcgactgtttaatggctcacttatactcgacttctcttggtactgtgcactagttaaagtgctaaactcctgagcctaaaatttcgtacattgttttgttcaccctagtaggctttggagggcaaaggtgacgagtagtgaagtgggcatgtctaacacggtgtagatggctaggtaggtaaaaacacctattatttgttgctagttcccttaatttaaatacccggatgtaactagtaggtagggtaggtaaactagtagttatattaatgtttacactgggcccgttccggctggtgtaagttagttccgtacttgtgataatacaaacactgtttatattaatacgggtaggacaaatgtagtgatgatttacgttgtgttcaccttcgcccccttgcttataccttaactacacccatt

SEQ ID NO: 911 - DNA, 255 bp, Neisseria meningitidis
taggcgtggctcctcgtggtgggtcggcaaataaggccgagttgtttgcctgccccggctgcactccctccgttaaattaattgccgcaggtaaccctccccccgtcacttaagtcgccgccaccgttggccgcagtaacactcccaccgttcgcaacggcaatggcggacctcccgctccgaccgcggccgataactactgctttcctactggcaccccgaacatggcggaattaaagttaacgtttgcccaaa

SEQ ID NO: 912 - DNA, 513 bp, Neisseria meningitidis
tttcagaacgggtgctattcataccgtgccaggtttcttgctctcccaagcatcaggtcccgagggtgcatccggtccctaggtttcataaccgccaggggtaaccgcggcgagacccgcgaccaccaggtcgaaaaccgcacggagacccgccgcaaacaaagctcgccaattcctcagccgaagcatccctaaagtggctccggttctttagggtacgctgggtttcagggtcatcatggtcgtggttctcttcgcgagtagtactcggggcctaatcggcccaatcctccatccggttccatccgtccgagacgcctacatgcttctcttcagcactactaagaaagtcccgcgctctctggcgctcctaaagcgcctcatagaattcttcaaacacaacttccagaacctaaaggtccccctggtccccgcggccctctccctagaagtcagcatcctcacctacgtggctcgggtcttctcgttcgaagtagcgcgcttgttctgctt

SEQ ID NO: 913 - DNA, 474 bp, Neisseria meningitidis
cgtcgtgcaaactcctggttggccgccggaaatttagggtaagtctccgggccctaactgccgccgctactgtctcttatgtctctagttctaccgctcataccaaagaggcctcccattatgctattactgctggcggccataacttgggagtctcggtctctgccaactgcgtttaaagcggtacagacctaaccaaagtccatgctggcgtccgaaaatctgtcgctcttggcctgcaactagtctctctggtgactccttctgtctctcccgtggcaagtcatactctccatctaagtattaagagggttcctagctacgtctcgggtggtcttcttactaaaagctctctcaggggtcccgtcagcccgacctctctgagtgcggtcttcacgggccgtaactccgaatctcgcggccgattcagagcatttcaatgcggggctaccttcgtgcaaataggccttccag

SEQ ID NO: 914 - DNA, 509 bp, Neisseria meningitidis
tgagataattcccgccttggatagcatggaaaacatgaccgaagagctgcaacactgctttgaagcacctttttacacgctcggcccgctcgttaccgacatcgcacccggctacgaccacatcacctcgggcataggcgcggccaatatcggctggtacggcacggcgatgctttgttacgttaccccgaaagagcatttggggctgcccgacaaagaagacgtgcgcaccggcatcatcacctacaaactcgccgcccacgccgccgatctcgccaaaggctggccgggcgcacaattacgtgacaacgccctgagcaaagcgcgtttcgagttccgctggcgcgaccaatttcgcttaagcctcgaccctgaacgtgccgagagcttccacgacgatactctgcctggccgaaggcgcgaaaatcgcccacttctgctcgatgtgcggccccaaattctgctcgatgaaaatcacgcaggaagtgcgcgactacgccgacaagcat

SEQ ID NO: 915 - DNA, 453 bp, Neisseria meningitidis
tcctaccttttcttatatgctccagtgcaaaagtaaaaataccacttgggatatggagagggtttaaactttgtattgggttggcacgacgaccatcaaaacctgcccgtcatcgccaaaatcgccgaagattgcggcatcgccgcccttgccgtccacggacgcacgcgtacgcaaatgtacaaaggcgaagcgcgttacgaactcatcgccgaaaccaaatgccgtctgaacatcccggtctgggtcaacggcgacattacttcgccgcaaaaagcccaagccgtcctcaaacaaaccgccgccgacggcattatgatagggcgcggcgcgcaaggcaagccgtggttcttccgcgatttgaaacattatgccgaacacggtgttttgccgcctgccttgagtttggcagaatgcgccgccgctattttgaaccacatccgcgccatacac

SEQ ID NO: 916 - DNA, 509 bp, Neisseria meningitidis
aagttggcaacgtcgtttgctcgtacttagcccgaccgtttgcttgtcgtggccgagggtggcaatggctaaccttgtacacctgaacgcccccctccgcctgcgaaacgttgctaggcaaggcgtaacaaaaatggtggataatagtagatagtccacggtggtaaattacatttagtgacaacacagcggaccaaacccaaattagcatagtgccgttctgttccagtctaaagagaatgacctctcaaggcgtcgaagtattaagcgaactggccttgcatcacccgcatcgctcgtggtcctgctgttccgcttcgacccaaacccaacttatcacaccctatgtccattttccgccctctaaacgttgctcgaaacaagtggtccaacacaccgcccatagcaccgggaagtacaatagataaaacgttgctcgaaacacccctagatgggaccctccacttgaaatggaccacccccgtgccctaattgtccctaacgtatgt

SEQ ID NO: 917 - DNA, 438 bp, Neisseria meningitidis
ggctagggagagggcggcaaaccgtaggtttgcttgagcggtattttcaacatacaggctgcttttcaattcgttgaaaccgcactttagcttcgcagaaaccccccgcttccttcggaagctccgttttcagacgactccctactttttccccgccgcaacgggttctgcctttttaaacgccgccttcaactgctccgccgcttgatcaaactgcgtccgatgttgcctktcatcaggcgcagaccgccgtcgggggagaacgggttgtcagctttgcgcaggatgtcgtcgttgccgctggtttcgggggcttcgcgccattcgagtttcccgtcgttaaggatggcggcggtacggtcgatgatgaaaatccaatcggggtttttctctttgatgtattcgaaggaaacaggctgcccgtgcccctgcgttgcg

SEQ ID NO: 918 - DNA, 538 bp, Neisseria meningitidis
acttcatgttacgttcaaaaatttaatgcactcaatatatttttttaaggagaagcaggtgagtcaaaccgatacgcaacgggacggacgatttttacgcacagtcgaatggctgggcaatatgttgccgcatccggttacgctttttattattttcattgtgttattgctgattgcctctgccgtcggtgcgtatttcggactatccgtccccgatccgcgccctgttggtgcgaaaggacgtgccgatgggcggcgcatgaagcggtgtgcgccttcgacgccgctgtcgctccattcgagggactgttcgggcggtgcggcgaacatcataaacaggcgggcggtgtccgcgccgtaggcgttaatcagttcttgcggatcgacgccgttgtttttggacttggacattttttccgtgccgctgatgacgacgggcagcccgtcggctttgaagacggcggaaatggggcggcctttgtcgtcgaacgtcagctcgacatccggggggttgatccaatctttgccgcctttgtcg

SEQ ID NO: 919 - DNA, 485 bp, Neisseria meningitidis
gcgggttcggaaattgtgctgaaccggattatctgctgggaattgctttgcctgtttggagcgtggcgtattttctggcggttgtcctgacggtttggtgggcgtgggcaagggctaaataaatcaatgccgtctgaaaggttcagacggcattttattgtatgtctgctgtgctgcgtatcagtccagattcaatacggcggaagtgtaaacgtcttgcacgtcgtccaagtcttccagcgcgtcaatcagtttttgcattttgacggcatcgtcgccggagagttcggtttcgttttgggcgcgcatcgtaacgtcgccgtcaacggatttgtaacctgccgcctccaaagcggattttacgcccgcccaatcgtttggcgcggtaatgacttcgatggaaccgtcgtcgttggtaaccacgtcttccgcaccggcttccaaagccgcttccatcagcgcgtcttcgtcaacgccgggttcga

SEQ ID NO: 920 - DNA, 119 bp, Neisseria meningitidis
tattcctgacgattcaggtattcctgacgattcaggtattcctgacgattcaggtattcctgacgattcaggtattcctgacgattcaggtattcctgacgattcaggtattcctgacg

SEQ ID NO: 921 - DNA, 114 bp, Neisseria meningitidis
cgaaatttcatgccttcggcttctttggtgagcttgacgcagaataccatgcgtgccaaaacggattcctttgctgtgttcaaaaataacggggtgattttaaccgattaagga

SEQ ID NO: 922 - DNA, 487 bp, Neisseria meningitidis
cacctcctccacccgaagaaaaaaattgatccgggtggaatggggtcggcggctggccccgttaatagtagtcccgaatcgtctgtgggtactggtgcgcccgttgtaccgggtcccacggtgtaggtgggtggcaaggtggctaatgaggccgttctaggtggtactggcccggtgcccactgttcccttgattaccactaattaggtattgacgggtcggtcgactggtacaccgccccctggcctgtcggcgcctgttggtgccatgctgacgacccttacttccgaagcgaccgcggtggtgacctaggataagtcgaatactgggtgtgctaatgttatgtcgtcggctcgtaccttgacgggtaccgcccttatgtcgtcgcctggcatggtgatggtgtcgttggccccggatgcgacggataaacctgctaatattcatgggaccgccgttgttggtcccgcccacgccgttgttacta

SEQ ID NO: 923 - DNA, 404 bp, Neisseria meningitidis
ggatggataaaggcagccggcatttctacgcgtctgttttaatacattgcgggatttgctgcctgactgccttagcccttgctttgcgcgaaacaaagacccgtaaaccgtctatattcaaacggtttacgggtcttttttctctcttgccgttttcttcagtttgccgatccgaccacgccaccgccgattccttcaaacggtttcccgcgttcttcccacttaacgaacattaagttctgctactgctttcagcccaatgtggaaacttgcgccctgtccgaatgttgctgcgcgctttgctgaacttcctgcccttggctttcttctttgtatgggttaaacagcaagccgttttttacatagtccttgcacatcaaatccgtcacttctttcactgccgt

SEQ ID NO: 924 - DNA, 438 bp, Neisseria meningitidis
acgccgtatattgactgcattaggcttgatggcggtaacctattcaggggtggatagattggtagcccattttcagcaggcgataaccaatagcataacgggcgcgcctcaagcgatgttgcagcttttttatataagcggcggtggaatcgttcttaatatcctgtttggcgcgatcgcctttattctgtcattcatacacctgacaaaactagcaacctcaatcgggaagaaaaaataaatggtaaagatatgtttgataaccggcacgcccggttcagggaaaacattatgaatggtttccatgatggcgaatgatgaaatgtttaagcctgatgaaaacggcatacgccgtaaagtatttacgaacataaaaggcttgagaataccgcacacctacatacaaacggacgcagaaaagctgccgatatcgacaga

SEQ ID NO: 925 - DNA, 143 bp, Neisseria meningitidis
ttacaacacggtttctttagattttacgttctagacactagtatgaatccctgcaccgcgcaacatcgcatctgctagatccgccgcctatcataccactagcggttgcagcaatcgtacttcctgttgaatcacattgccct

SEQ ID NO: 926 - DNA, 522 bp, Neisseria meningitidis
gcttcggctttttggcgagcggtgttggcatcgccgttttttaagatgctcaatacttgagtggcgttttgacggatttggcttaccgcgtcggcaggggcggcaaatgccatgccgatgctcaaaataccgatgcccaatgcgctgatgagggaggattttttcatgattaagtgtcctagtttgaatatgatggcatacgtttattcggcggctttttccgcattcctttgcgcttgcgcgccgcctcggcctttttggggtaagcgtcgggtgtccaaataccgtcctctttgagccgcagctcggtttgcgtaccatccatgcgggatagcataaaccgccgccccatcagaaaaaacaccgcatcgataccgtgctcgtcgtcgatcacatgcacacgcaggccaggttgccacaatacgccgtcgcgggttttatggccgcccacggttatcgtgagtgtaaatccctccagccgccagtcggccagctgctttttagcctgcttttgcaatgcgg

SEQ ID NO: 927 - DNA, 452 bp, Neisseria meningitidis
gtcgtaaaatagccctcgaaaatcaaatgccgtctgaacatttcccgtttcagacggcatttttcaaaccggactgacgcatcgggagcaaccgcccgcaccggataaatttctgccgcagacagtttcagacggcatttgccgcctgtacaatatagtggattaacaaaaattaggacaaggcggcgagccgcagacagtacaaatagtacggaaccgattcacttggtgcttcagcaccttagagaatcgttctctttgagctaaggcgaggcagcgccgtccctcgcaatatccgtcccgcccgctgcggcggcggatacgtctgcctgcgccaaaacgggcgcgtcgttgatgccgtcgcctatcatcagcacttttttcccttctttttgcaaggctttgacgtattccagtttgtcctcgggcatggcttgggcgcggtaatgcgc

SEQ ID NO: 928 - DNA, 609 bp, Neisseria meningitidis
gggtagtgaggcccaaaaaaagttttgttccattttgaataggctgcccttgtacttggtaaggctccgacgatgaaagatgacaccccggtaggctagctcgtacggtagatcattggtggcacggaagctggcctgaccccgggctatggcgtacactaggtcttggatcggatggtggatcggtcgtactgcgagccggccgttcggccggacccgattgtgtaatagatccatggtaaaaaacctgatgaggccctttttgaggaataagttgctccgaaaatatgttcggttgatgaacattgtaactaaagttgtgcgaaggaagatggtagtgctgctactagtgacatgtgtgcgaaagttactgaaagtacttcgttccatcattatggcgcgcatagtgatgacttcaagccttaaattatctgtgaatatcccgtaacgaaaaataacataccgttaagttaagaagtgtgcgaaaaatcgcctaatcctcctcctcggatcctccggctcgtcctgattaattgcttcgatgagaaccccatccatattaataatcggttgtatgaattcccgactaataatgcagtgattatcgaa

SEQ ID NO: 929 - DNA, 543 bp, Neisseria meningitidis
ccaacaggtgcaaaatggtattggtgctgccgcccatcgcaatatccatcgtcatagcgttttcaaacgcttttttggtggcaatgctgcgcggtaacacggtttcatcgttttgctcgtaatagcgtttggtgatttcgacaatcatacggccggcttcgaggaacaattctttgcggccggcgtgggtcgccaaatacgaaccgttgccgggcagggaaaggccgagtgcttcggtcaggcagttcatcgagtttgccgtaaacatacccgagcgtggtcggcacgcttgccatgtttcttatcggcggcgtactggtcgcccacaacctcggccttctgcacgatttcctgcacgcgcaacactgggacgctggctgggcggagtacttcgccaacttcgttgtcgggctgctttccggttcgattgcctgcgcttccgccttgccgctgatgaatcgtttcggcaggcattgattcctttttcacataccgatgccgtttgaaagatgttcagacggtatcttccgaaccagacagatg

SEQ ID NO: 930 - DNA, 103 bp, Neisseria meningitidis
ctactagatgaaaacatagaggtagaatttcatgacatcagcatgggcaattatattttacacatgaccctaaaagcacaggcaacaaaagcaaaaatagaca

SEQ ID NO: 931 - DNA, 389 bp, Neisseria meningitidis
gctcggtacaccaggaatggtcagcaacttcacagaactcctagtgccaccttcctttttgaacttttatgacttctggacagcgtcatgatgattgtcaagtgtcatgacaccagtggaagtgtctttttttcacatcccctttaaccaatgccactgcgctgcctgcgataatctgcgagtaggctatgactttttggcgttcttggggtgacagtttgcctacatcgcgtccgtccaacagggtttctcccaccatctcgccgactgccgcgccgattgcgccgtctcgacatttgcctttatttgctaccgccgatgcacagcctgctacggcatgcgctatcttgtgggcaatgtagtcttcgctgagattaagtttgattttg

SEQ ID NO: 932 - DNA, 417 bp, Neisseria meningitidis
atcgcccgtctcaataaccaataagcctttgctctcgatccgaccaccattggagataaatgtgcctgccgctcctttttcggtggtttcgatggagagataagtcggtgaagcttcggtgccgtcggcagtggaggcgatgcggccgctgttttcaatgcggactgacgaagtcacaagcaattgcttggccgcttcgagtgtgacggcatttttgacgcctacgcctttttcattggcagtcagtgtgatgctgtcggcgtacatagcgcccagtgcggcagtatcaaaggcaatagtcggtttcgtacccgctgcagtacctgcactgatttcgccgctggcgtaatctactttctgaggaccggtagaaaccgccaggtttttaccctgtaatttcccctgcagagcaactgc

SEQ ID NO: 933 - DNA, 548 bp, Neisseria meningitidis
caactctgcggatggggcaggtaactatgttgcccctatttaaaaatttgttgtgttgtgtgagcagctattggcaacggcgcctgtgtttcgctttactagcctggccattaataactttgcttttaccctccctagtaggctggaccgtgccctgcgtgcacggcctaaacataggccgcgtgtgttgttggtgccgtttgcggctcgtacattgagcccgtgtgtgtcgcaatcgtcgaggaaacagttcctgataacgttgccccgaactatgaagtgtggcgtggcggtaatgttccttgtactaaaacagtcgtcgtggaaagagtgggggacgcgtggcctcctgtgtaggccgaggaaactgggtaggatccccccgttgacgtcgctgactaggaaatcgtcccggtggcagagtgtgttgttggagagcgtgttgatgaggcgcttgacaagattgtttgaaatggcggcactgaagaggatggggcagtcgttcgctgggacgtcgtggtcgttgagctggtgtaaagcctggtggg

SEQ ID NO: 934 - DNA, 238 bp, Neisseria meningitidis
tttcgatgctgccttcaaacgcgccgataacacggctggcgaggaaggcggtgcagaggttgacggcgagccacatccagcggtttttcaccgaatcccacacgggggcgaacaggtcttcctcttcctgcaaacccgccatattcagcatatccgcttccgattcttcgcggatcacgtccaccagctcctcccggtaaagtcgccgtattcggtcttttgaagcgaaatggtaagg

SEQ ID NO: 935 - DNA, 437 bp, Neisseria meningitidis
tattttatcagaatgccgatgcttgttctgtttcaaattaatttcttttcaaataaattacttattcggatttgccggggctttcggataaattccttgccaaggtgcggcattgcctgcataattcgctttctttgccgggatagctcagttggtagagcacctgacttgtaatcaatcaacaattccggcgtttccacgtcatgtccggcaatatgggtggcaaagttgccgccgctgtaggagatgaagcggtcgcggtaaagttcgacggcgcgagtaacgtgcggcccctgcccgaatacgacatccgcgccggaatcgacggcaagccgcgcaaactcaacgacgttgcccctgttttccccatagaagatttcggtatcgaacggcaggtgttccgcctgtttcccttccgcgccgccgtggaacatcac

SEQ ID NO: 936 - DNA, 602 bp, Neisseria meningitidis
cgaaaatgaaacgggtaaaacacaaataaggcctgtatgcaggcaaggtttatttgtgtttgacccggaaacgggttcagacggcacgaaccgggatgccgtgccgtctgaaaggggtttatcgggtggcgcggtaatctgcgtcggctttttcaaagcgttcttgggtttcgcgcgaaggttctttgttgaacagggaaaccaacacggcaacgatcaagcaaacaataaagcccggcacgatttcgtacatcgtcaacaagccgctttctcctgccgcttgagccggttttttcacccattccgcccatacgactacggttaacgcacctgcaaccatacccgacaacgcgccgtaggcagtgatgcgtttccacaatacggacagaatcacaatcgggccgaatgccgcgccgaaacctgcccacgcgtaagacaccagtcccaatactttgctgttcggatcggaagcatcaggatggaaatcacggcaatcgccaagaccatcaggcggccgacccataccaattccgactgatgcgcgttaatacgcaaaaagtctttgtagaagtcttcggtaatcgcgctggagcaaaccaaaa

SEQ ID NO: 937 - DNA, 593 bp, Neisseria meningitidis
  misc_feature (514)..(514): N is any nucleotide
gcttgccgcctatttttctacgcgcaatttcgacgattatattttgggcgggcgcagcctaggcccgtttgttaccgcgatgtcggcaggcgcgtccgatatgtccggctggcttttgatgggtctgccgggcgcgatttatttgagcggtttgaatgaggcttggattgccatcggcctcttggtcggcgcgtatttcaactggcttttggtggcgggccgtctgcgcgtacataccgaatacgccaacaacgcgctgacgctgccggattatttcttccaccgctttggcgcgggcggacacttgatgaaagtggtttccgcactgattatcctgtttttcttcacgatttattgcgcctcgggcattgtggcgggcgcaaccctgttccaaagcctgtttgaaggtatgacttacaatcaggcaatgtggctgggcgcgggcgcgaccatcgcctataccttcttgggcggctttttggcggtaagctggacggatacgctgcaggcttcnttgatgattttcgcgctgattttaacgcctgtgatggtctatctgggcttgggcggcgcggaacagatgtctgccgcga

SEQ ID NO: 938 - DNA, 270 bp, Neisseria meningitidis
cctaaggcacatgtcattatccccattcgataggtgaggacactgaggttcagggaggggagacatcttgctcctggacacctcagctggggaggaaggcagtggcgatcattcttaggaatctccgaccgccatgggctcctgctctgtgcaccctcaggagcttacggtctggttacaaaaatgccatctgcctatgctgaattctaggcttatgaagatccaagacatattcctgaaaatccatattttcatgcattgtactatctt

SEQ ID NO: 939 - DNA, 389 bp, Neisseria meningitidis
gaacataccaattcgaaaacatcaataactcaaaaaagatttctttttatgatcaagaatataccgaaggttacctagttggcttcgcccgaggtttaggggttgcaaaaagaaatggggagcagctgttacaacagccagttttgcgccgtatttacggcaggtgttaataaatttcatgatattttccttcaaaaagtgtttggcggtaatggatggagcgtttttcagacgaccgccgaacatccgaaaatcagtctttcaaaaatccgaatacgacaaattcgtattggttgccgatttcttccaaacctgcgttaatcgcttcttcgaagtcgtagaaataatcggcattggtgattaatttggtatgtccgatgtcgcccgtt

SEQ ID NO: 940 - DNA, 413 bp, Neisseria meningitidis
cagcatcatcgacaataatgctacaagtgtgcagggtttcgttttgtgcggcggtttggggcattgcattcatggtcattttcctgattctgtcgtgtgttgccgaatcgggcgacctgtgtgaaggtaacaaaaaagccgccccgttttcgagcggcctgttttgcgtatgggatggatttcaagcaagcgcaaaaaagtaccgcacgtctgtgtggtaccaatagcaataagcggttgtaaattttttgccttgcatgatgaaatgccgtctgaagataaaaatattggggagattctaaatcaaaacgctgccgcgcctcaagcattttatcgaaatttttttgatttttcatctatccgattgaaaatatttcggtttatttttaccgctgcccgatattgtcggcaat

SEQ ID NO: 941 - DNA, 664 bp, Neisseria meningitidis
  misc_feature (29)..(29): N is any nucleotide
cggattcccgcctgcgcgggaatgacganctcttccgcatctgattttggacctcttgacgcgatttgctgcattttgaagtgtccaccaagataatcatagtaaaaaaatcgtccatcagctgttggctgatgttgagaatattgatttggttttccgccaaaattttggaaacatcgtacacgatgccgacgcggtctttaccgatgacggtgatgactgaattgttcacaggcttactccttgcagatatccgttaaagtccgaaattataccaccgttggattttgaagaaatattgtcaacaatatatacatacaaaatgccgtctgaaactatttcagacagcatcaagattcagggttcgattaaataaccatccttatcccactgggttttcctgaccaacttgtcatcctgataaacagcttcgctctttttagaaccatcttcataccactccaaaaccaccccgttgcgttgatggtggcggatagacagttccgagagtaatcggccgctttcatcccaagtcagaattttggcaggctcatcgttgaccataaccatttccgtcttgatactgccgtcggcataccattgctttcatacgccgtttgccttattttgcttaaactggatttcgctttccttgccgccgtta

SEQ ID NO: 942 - DNA, 519 bp, Neisseria meningitidis
cctacaaacccggccgccattcactcgcagacttggctaagtcggatattgaaaatcgacagccgaatttcacagggccgcgtgggacgaaggtttgaaaggctatgcccgcctgcgcttcatcgtcaacgccttcacgcggatgcgcgccctgacctttaaaaacgaactggatttcgactacaaatccacagtgaagaaaaatgccgccttacctgcgcccgtggttcaaagcccccgaccggcaaaacctcgaccgcaccatcatcttcggacactggtcctcgctgggctacacgaatgccgacaacgtcatctcgctggacaccggcgcgcggcaaatgcttccgaaacagctgttaaaaataatgcattagatattatttgggatattggcaacctcgtatgggacggcggtaaatggatttacgccaaatctattggcgataagcagatggctcgagaagcggcgattgattttggtgtggatgccgccgcagctgccgttccctttgttcc

SEQ ID NO: 943 - DNA, 628 bp, Neisseria meningitidis
agcgggaaggtttaaatagttaggacgccggtccagaagtagttactacccaaagaaagtgcaacagtctatcggctgagctgcttcgtgtggaagacgcaatggggtctaaactcacaattgaagtcgtggacgttggcccattggtacggcaggggagtgcctcgcaggtcgacgaaggcgtaccgcaaagcgcgtcggaggcactagaagcgtgaacgccgatacgagcagtgacaaagtgggcgaaaagtttgtctgttgaaagtttaaggcccttcgtgtaatgcctactggtgcakggcgagctggttttcaaggtgaggtagaaacgtgcagctgacgggaaataggccaacaccttcgcatccgacctaaacgtgacgcggggatggagaaggccaggccggtaagtcgccggaacagtccgcccaagttggcaggcggaagatccaggtaaacttgggctcctccaatattgagaagcgatgatgagcgctcatggatatgaagtaattgacattatgtccttaggaaaagttatcaagtcctagcccgaactgaattgcattgtarattgatataggcgggtaggacgagaacctcaaggtgtccgagagaatctagg

SEQ ID NO: 944 - DNA, 642 bp, Neisseria meningitidis
  misc_feature (627)..(627): N is any nucleotide
ctatccgaaccgctgccgccctccaagtaatcattaccggcaccgccgatcagagtgtcgttaccgtcttcgccggctgatgtgtaccaaaccgtctttgcccggcatcacgctgacaatcgcgccgacattgttatcgaggattttcaccacagtgccttcgtacactttgcccacttccacttcggcagtaatctgctcgatgcgttttttcgccgcatcgccggcttcttgagtggttgcggcaatggtaatcgtaccgtcttcggcaatattgatttccgtaccggtttcagcggtaatcgaacggatggtttcaccgcccttaccgataacttcgcggattttgtcttggttgattttcatcgtgaacaagcgtggcgcgtgtgcggacagctcttgcgggcccgcaacggcggctttcatctgatccaagatgtgcagacgcgcttctttggcctgtgccaaagcgatttgcataatttctttggtaatgccttggattttgatgtccatttgcagcgcggtaacgccttcggtcgtaccggccagtttaaagtccatatcgcccaagtggtcttcgtcgcccaaaatgtcagtcaggacggcaaatttgttgccttccanaatcagacccatcgc

SEQ ID NO: 945 - DNA, 230 bp, Neisseria meningitidis
gcctcgccttgccgtactatttgtactgtctgcggcttcgtcgccttgtcctgatttttgttaatccactataaaagagggcgtctgaaaaacatttttcagacgggcttgtttattcaatcaaattagtctttcaactttggcaactgattttaaacttttgccattttgccttccaattccgccaaatcgggtttgcctttttcccccaaattcccagggggtttttc

SEQ ID NO: 946 - DNA, 584 bp, Neisseria meningitidis
  misc_feature (490)..(490): N is any nucleotide
aaacgtcctacacatccttttagtgcaatttcgcttaaatttgttaaacttggtagggcccttatcttcgaaaaattacctcttgttaatatgttgtgtattgttgtgtttcgactgaaattgcgccttagtaacaaaaaattgttccttgttaaatggctgggtgtgttccgtgttaaggcgtggacgtagtccaggttgctcgaaaagctggctagtgtgacccgtggtctaaattgtaaactgttccgtaataaacgcccactgttgcccctgacacagggtgggccggatatgacgacgctttaccctttcctagatggtacactggcgctgaattatgaattgcgcgtaaacctgatttgtgtgtttaaacttgttgtacccccttgtgttgccctaagggtgggtgggtcgacgctggacgtgtgtataaatgtactggggtgcctgagtgtgatggccatgggaattgtgttgtcgtttgctnttaaactttatatgtgtttgcccctgggtaggtgtgttaacatggtcctgattaaacgcctggccctggggtgtggaactagtatgtctggacc

SEQ ID NO: 947 - DNA, 620 bp, Neisseria meningitidis
gggtgcatgcttaagaaaattattgttactagtgtgattaagattaggtcgaacccgctgacgggggtgatccgtgaggtgccgtttagccgtagggtcccaaaacaggtgagttaagacgtgttggcagtaagattggacaggacgaggaacgcttagccgtgttttgcaaagttgcctatatttcgttacccgttggcgcaggccaaaaataacaataaagtggtaaggacgattaaggcgtggacaaaggcggtgaaactggaactcacatttcgcaaatttaccccggtgaaaacagtggctaacgaggtgaagttcgttgacgttaacgtttaaaatagttacgtgccgtcgtttacgcccctcttccggaccgcgaataacacgaatggcacccccgccgtcgtgctaaaaaccctatcgtgggcccggcgtggacaatgccacaacacgttcgacaccacccctaacttattcgcccgctgttcgacgtccctagatggtacgctttcttctaccctcaaaggaaagctacgagtcctaaaattgacgttgaaactgttaaacttcttattacgtgtttgaccggtgaaacccgttgttaagtccggctcgaa

SEQ ID NO: 948 - DNA, 525 bp, Neisseria meningitidis
gctgtaaatgttcaaacactacgccgtccacgattttgccgagtttttggagctgtacggcatgcccatccgtatcggcaaatacggcgcgggcgcaaccaaagaggaaaaaaacaccctgcttcgagcggtggcggaaatcggtgcgcgggcgtgggcggtcaggctttcgccgtgtgccagcacgctggcggtttcgcctaatttttgcgcgccctgttccgaaacctgaatcaggctggagcgtttttggaaatcatatgtccccaaaggcgaggaaaagcgggcggttcggctggtgggcaacacatggtttggaccggcgcagtagtcgccgaggctttcgccggtgtagcgtcccatgaaaatcgcaccggcgtggcggatttttttcgcccattcctgcgggttttcgactgacagttccaagtgttcgggggaaatgtagttggcgatttcgcaagcttcgtccaagtctttggcgagtatcatcgcgcccctgttgccgagcgaggcttcgatgat

SEQ ID NO: 949 - DNA, 315 bp, Neisseria meningitidis
acaagaagctggtagctccaccgcggtggcggccgctctagaactagtggatcccccgggctgcatgaattggcacgagctcgtgccgaattcggcacgagcgactgcattgggaagatcagttttcctgccatccaggctgctccctccttcagcaactcattcccacagatcttccgagacaggacggatatccagtgccttatcccatgtgccattgaccaggatccttactttagaatgacaagggacgtcgcccccaggatcggctatcctaaaccagccctgttgcactccaccttcatcccagccctg

SEQ ID NO: 950 - DNA, 397 bp, Neisseria meningitidis
tgggtacccggccccccctcgaagaagaaggtcaggtacatgaaagacacgtccacatcacagttgcccccaaactgcctgtgctcctcgatggtgtctctccctccagaaaacgcatgcttattgaccttggttttgatctgcttggccgtgtcggtgaggaagatggcggagttggggtcgctgggactcattttggtctgggcgacctgcatggctgggaagaaggtggagtgcaacacggctggtttacgatacccgatcctgtgggcgacgtcgcttgtcattctaaagttaagatcctggtcaatggcacatgggataaggcactggatatccgtcctgtctcggaagatctgtgggaatagattgctgaatgatggagcatcctgtatgg

SEQ ID NO: 951 - DNA, 563 bp, Neisseria meningitidis
cttgcccgcaaaaacgtggcgtgtgcacccgtgtatacacaactaccccgtaaaaaacctagtgagttagcatcatattgctgccatttttcacggtctttccctaaataagcagtaaaggctttttctccccacggcacgaggcttggcgataaaataggcgaaaaggcagaaacactttgataacgttcctgattccgcagcgccaataccaatgcgccgtgtccgcccattgaatgtcccataatggaacgtttgccgttggtaggaaagtgtttctcaatcagacggggtagctcgttcaaaatgtaatcatacatttgataattcgccgcccaaggctgttcggtcgcattcaaataaaagcctgcactctgtcctaaatcgtaagcatcatcgttcggcacttgctctccgcgagggctcgtatccggggccatcacaattacttgatgttctgccgcataacgctgaaagctgacttggtaatgcaattttgttccgtacacgtcaagccggaaagccaataaatcacaccaagcggtcgattttctggattatct

SEQ ID NO: 952 - DNA, 212 bp, Neisseria meningitidis
ggctgaaaatcatgcaggacgggtaatcggcggctttgacggcttctgcccaagccaccaaggattcatcggtgtcgcacagccgccatacgtccatattcggaatcaggcgcagggtagcggtttgctcaatcggttgatgggtcgggccgtcttcgcccaaaccgatggaatcgtgggtaaacacaaatacagggttgattttcatcaac

SEQ ID NO: 953 - DNA, 625 bp, Neisseria meningitidis
ctgtggtgtgggtgggacgttcgttccccttggacccagaggcaaatgaccctgttatcttgtttcccgtccctggtatccgtttattagataaacgtgggtagtatgcttttgcagtccccgtgcctgtccccggtcctgtttggacgggacccgacgtgccgtggggaaccgacggggttggggatgaggatgccggtgtgtaggccgttgaagtgcctttacctgctggtggtgatcccgtataggcagcctaatgtggtcccggatgtgttgaagttgttttagcaggtcccgggcgccctgttgcggtccctgttgatgaagacgatggatgtgctgggtgatcgtcctagtagtgggaatagggtgtgggctagttttacaggcgtgatggcgccgacgtggcaccggccgatttacctggtgatggcccggaaacttagtggtgagagggtgcaaaaacagttggtgtagcggatgacgttgcttagcccgttccgtgcggtcctggtaacggcggtggtgaaacgcctaaacctccccctccttgtgtcaacaaggctaaagtagacggtgaacggcctggggcacttggtcctgataactgtgctacatatccccc

SEQ ID NO: 954 - DNA, 616 bp, Neisseria meningitidis
tttgataaggaaccctgtcattccaggattgccacagccatggttgttgcccatcggggtcctgacttgacgtctctatactcctaaccaattccttagtattgggtaggtgctatatttcacatgcttatccctgcgccagtagagcgtcgcgcccccaacaaatagctgtagttattcacctctcgtgatttcttggggtccatggagtaagcttccaattccagagggtacattcctctttgaagccatggcactaacccgttgagccttcctcttcgagcctctctaagtgttccagaacctctacttcgtttattcgcgctggcccgtggcatggcctgacctaaatcgaagtccagcggtccccttcggaagtgcggcactggccgtcctgcgcttgcagatatctgctgctatcctctggcgccaagaagatttggacccgttcaagctccttattcattggtccaaataagtcaccttaatagtccgttaattcaattcctcttgcttttatactgtacccgaactaagcataggaacaccaattcgcccttactgatcatgtaccctcgttctgttccaggggttgatctatttcatgttgacgaat

SEQ ID NO: 955 - DNA, 609 bp, Neisseria meningitidis
cgtgtgttgctggcttgacctcgttggaatataagttgtaccattcgacgggtgcaggtatgttggaagattctgcgcatggtgcggtatatggtactgacacgcctgatcgtgcgacgtttatttgtaacgtatgtaatggtcggtcgcccatttgccctggtgacccgaaaactaaaaatgttaaatataagtctgataagtgcttgacagatgaaagtcgtattcgtcatgttcgttaaaatcctagttgtgttcattcgtattactcgtattgtattggtgaaactccgggtgtatagccgaatattacttataactcgtaccctcattaagctaccacggtggaaacgtgtgaagttgctgaataaggtaaacccgttgatcggtaggtgtgaccttatgaaaattgtgtatgtggtatagatcgacctttcgtaacgttgctcgaagttgtcctagatggtaccccgttgtcccatttcatttgtatcaccccctagaaattgactacgtccttacctcccttagaatttctttcccttcacatgtaataaaattgcattgttgccccgtcgccgaattctggtatgtttgatgtgttgattg

SEQ ID NO: 956 - DNA, 450 bp, Neisseria meningitidis
aggatccccacgaacacaaaatgaccgtacagaccaagacaaaaggtttggcgtggcaagaaaaaccgctatccgacaacgaacgtctgaaaaccgaaagcaattttttacgcggcacgattttggacgatttgaaagacccgctcacgggcggcttcaaaggcgacaacttccaactcatccgcttccacggtatgtatgagcaggacgaccgcgacatccgcgccgaacgcgccgaggcaaaactcgagcccttgaaatttatgcttttgcgctgccggctgccgggcgggatcatcaaaccgtcccaatggatagaactggacaaatttgcccgggaaaacagtcattaccgctccatccggctgaccaaccggcaaaccttccaatttcacggggtgccgaaagccaagttgcagacgatgcaacgcctcctgcacaaactgggtt

SEQ ID NO: 957 - DNA, 441 bp, Neisseria meningitidis
cctactctccctaagcaacgagatgaaacagcgtatcgactccctgccggttgaattttccgaaaaaacgcgacgtaaccagcatcaacatatataagaacagcacaactagcatcaatacatcaggcaacgaaaatgcagaataatgcacttaatggtgtttggatatctgttgttttgtgctgttagtaattcatctttctgtgtttacagtttagcagttgtacagttttatagtaatgtttaaacaatgactgatttattttaaatgcagatattgtcgaggataaacatggccaaagccctttcagtaacatttctgattttttagcgagccttctcatttccccagcgagatcggtactggtacctgtactttggccgccgatatgcttaagttcagtaaccttagcgcgcaaatccagtaaccttacgttacgt

SEQ ID NO: 958 - DNA, 655 bp, Neisseria meningitidis
  misc_feature (436)..(436): N is any nucleotide
caccaacctatgtgtcgtcctgatctgggaggagttgtccctcccaaacaaatctgattctaccgccccgaagagcggggtttcaaccgacaaggaagattgatgaacaatatgtttgccgcaaaattgtccaaactggtttataccgcttccgaccatcctgattccctgtcggagatggaggagtttgaccgcctgattctgctgatacgcaaactgtatcaaatattggacgggcaacatatcctctccagagtaacggtttgccttcaccaccaaaaccggcgcgacctgattgccttggataaagcggctgccggttgcgattcggcaatgttgcgcgcccaacgttggctcggacgacatggtcgccgccataaattcggcggggtagtgcgctttaagccatgcggtctggtaggaaatcagggcgtangcggcggcgtgggatttgttgaaaccgtagccggcgaatttttccatgtagttgaagatttcgtcggatttttcgcgcgaaatgccttgttttgccgcgccttcggcgaagatttcgcggtgtttcaccatttcttcgggttttttcttacccatggcgcgacgcagcaggtccgcgcccgccgaacgagtaaccgccggataatttgcgccgcctgca

SEQ ID NO: 959 - DNA, 644 bp, Neisseria meningitidis
tatcgcattgtaaaatagtaaacaaagtaaagtttgggcggtggaaccggcagatgtgtcagtcctaggcgtcagcacttctatgggcgcggaagcctgagctcctctttgggtattaaactaaacgtcccgtcccaccctaacacccagaccgtttgggcggtggaaccggcagatgtgttagtcctaggcgtcggcacttctacgggcgcggaagcctgagctcctctttgggtattaaacaacaaaccactttgaccgggacaacccttgttaccagagaggcggacgagcggcccaagctgtatgttcggaaagtgcgcacatgcgaacagtgcactgagggcctgaactttccttctctcgttaaacataaactttaaatccccatggcccgggaccccccaccacctaaataacaaccctaccgggaaaatttgccaccgctcacaactgctactaattgtccataatcacttgccattgccccccgcggcacgccccgtggcacgccccatttctccttctagttcgcaaggatctaaaaggtgcaccttcctaaatggtaccgcctgatacgtcgttgggaagttgaatttgacattgaaatgtgatggggtgacacattgtcggaaaaacggtgg

SEQ ID NO: 960 - DNA, 386 bp, Neisseria meningitidis
catgttggtgttctcattcagccctttctcccaagaatggtaaggacgacaggcaacggacggtaaacgaagagcttgaagagttcgttcaactcaatcgaatccgcccccgttttcaacacccaaccctgtctgccggaatagatgtagccgtgccgcgccagcttttccaaaagctcgcccaactcgtcgtagcccatattgatatgccgtctgaactcctgaacaggcaaggctttgccttctttttgcgccgcatccagaagcagcaggattttcaacacgtcgtcaaaccgtccgcgcgagtcgaagcccctgcggaacgcttctccctgccagtaggagagtgaagaagtcagcaccgcgccgcccaagaccagcgtcca

SEQ ID NO: 961 - DNA, 659 bp, Neisseria meningitidis
taaggcaaaaacaagcgttttcgtcattttgaggcgtgtggattattccttaggtattttcgggccggagaccaacgaggtggcgggtgtcgtcggtacgtccggagaccaaaataactttgccagggatgttggtttcggcggtcaaaaaaagtagcgtcttaatgttttccatttaaacaaatgtcggtgaggatgcggttgtttaaaacgatttgcatggcgttgtgcagttgcagcaggtaaacggtcggggcggcgagtccgatgaggacgcgttcggcggtggggtggatgcggaagcggtgcatcagtgcgttgttgttttggagccggccgttcattttccagttgccgatgacccatttttgatcccacattccgatttggcgatacatcttttttgctccgtgtcgtgtttttttgtctgccgcgtgtggcgcggtgcaacgtgaagtttagtggatatgcggcgggttcgcaacttgaagcggccggccgggcggtttggaatgttgtttcgggcaggctgttttataatggccgcctgatatgtatgcaactataggagatgtgatgcacgcgcttcatttttcggcttcggacaaggccgcgctttatcgggaggtgttgccgcagattgagtctgtggtggctga

SEQ ID NO: 962 - DNA, 459 bp, Neisseria meningitidis
ataacgcggatttgcggctgcttgatttcaacggttttcagggcttcggcaagtttgtcggcggcgggtttcatcaggctgcaatgggaaggtacggacacgggcagcggcagggcgcgtttggcaccggcttctttggcggcagccatggcgcgtccgacggcggcggcgttgcctgcaatcacgatttgtccgggtgagttgaagttgacggcttcgaccacttcgctttgggcggcttcggcacaaatggctttaacctgctcatcttccaagccgagaatcgccgccattgcgcccacgccttgcggtacggcggactgcatcagttcggcgcgcaggcgcacgagtttgaccgcgtcggcaaaattcaatgcgccggcggcaacgagtgcggtgtattcgccgaggctgtgtccggcaacggcggcaggcgttttgccgcccgcttctaaatag

SEQ ID NO: 963 - protein, 152 aa, Neisseria meningitidis
ITRICGCLISTVFRASASLSAAGFIRLQWEGTDTGSGRARLAPASLAAAMARPTAAALPAITICPGELKLTASTTSLWAASAQMALTCSSSKPRIAAIAPTPCGTADCISSARRRTSLTASAKFNAPAATSAVYSPRLCPATAAGVLPPASK

SEQ ID NO: 964 - DNA, 459 bp, Neisseria gonorrhoeae;
atgacgcggatttgcggctgcttgatttcaacggttttgagtgtttcggcaagtttgtcggcggcgggtttcatcaggctgcaatgggaaggaacggataccggcagcggcagggcgcgtttggctccggcttctttggcggcagccatggtgcgtccgacggcggcggcgttgcctgcaatcacgacttgtccgggcgagttgaagttgacggcttcgaccacttcgccctgtgcggattcggcacaaatctgcctgacctgttcatcttccaaacccaaaatggccgccattgcgcctacgccttgcggtacggcggactgcatcagttcggcgcgcaggcggacgagtttgacggcatcggcaaaatccaatgcttcggcggcgacaagcgcggtgtattcgccgaggctgtgtccggcaacggcggcaggcgttttgccgcccacttccaaatag

SEQ ID NO: 965 - protein, 152 aa, Neisseria gonorrhoeae;
MTRICGCLISTVLSVSASLSAAGFIRLQWEGTDTGSGRARLAPASLAAAMVRPTAAALPAITTCPGELKLTASTTSPCADSAQICLTCSSSKPKMAAIAPTPCGTADCISSARRRTSLTASAKSNASAATSAVYSPRLCPATAAGVLPPTSK

SEQ ID NO: 966 - DNA, 459 bp, Neisseria meningitidis
  misc_feature (6)..(6): N is any nucleotide
  misc_feature (8)..(8): N is any nucleotide
  misc_feature (38)..(39): N is any nucleotide
  misc_feature (96)..(96): N is any nucleotide
  misc_feature (102)..(102): N is any nucleotide
  misc_feature (341)..(341): N is any nucleotide
  misc_feature (390)..(390): N is any nucleotide
  misc_feature (410)..(410): N is any nucleotide
atgacncngatttgcggctgcttgatttcaacggtttnnagggcttcggcgagtttgtcggcggcgggtttcatgaggctgcaatgggaaggtacngacacnggcagcggcagggcgcgtttggcgccggcttctttggcggcaagcatagcgcgctcgacggcggcggcattgcctgcaatcacgacttgtccgggcgagttgaagttgacggcttcaaccacttcatcctgtgcggattcggcgcaaatttgttttacctgttcatcttccaagccgagaatcgccgccattgcgcccacgccttgcggtacggcggactgcatcagttcggcgcgcangcgcacgagtttgaccgcgtcggcaaaatccaatgcgccggcggcaacnagtgcggtgtattcgccgangctgtgtccggcaacggcggcaggcgttttgccgcccgcttccgaatag

SEQ ID NO: 967 - protein, 152 aa, Neisseria meningitidis
  misc_feature (3)..(3): Xaa is any amino acid
  misc_feature (13)..(13): Xaa is any amino acid
  misc_feature (114)..(114): Xaa is any amino acid
  misc_feature (137)..(137): Xaa is any amino acid
MTXICGCLISTVXRASASLSAAGFMRLQWEGTDTGSGRARLAPASLAASIARSTAAALPAITTCPGELKLTASTTSSCADSAQICFTCSSSKPRIAAIAPTPCGTADCISSARXRTSLTASAKSNAPAATSAVYSPXLCPATAAGVLPPASE

SEQ ID NO: 968 - DNA, 600 bp, Neisseria meningitidis
tccgttatcgggcgtatggagttggacaaaacgtttgaagaacgcgacgaaatcaacagtactgttgttgcggctttggacgaggcggccggggcttggggtgtgaaggttttgcgttatgagattaaagacttggttccgccgcaagaaatccttcgctcaatgcaggcgcaaattactgccgaacgcgaaaaacgcgcccgtatcgccgaatccgaaggtcgtaaaatcgaacaaatcaaccttgccagtggtcagcgcgaagccgaaatccaacaatccgaaggcgaggctcaggctgcggtcaatgcgtcaaatgccgagaaaatcgcccgcatcaaccgcgccaaaggtgaagcggaatccttgcgccttgttgccgaagccaatgccgaagccatccgtcaaattgccgccgcccttcaaacccaaggcggtgcggatgcggtcaatctgaagattgcggaacaatacgtcgctgcgttcaacaatcttgccaaagaaagcaatacgctgattatgcccgccaatgttgccgacatcggcagcctgatttctgccggtatgaaaattatcgacagcagcaaaaccgccaaataa

SEQ ID NO: 969 - protein, 199 aa, Neisseria meningitidis
SVIGRMELDKTFEERDEINSTVVAALDEAAGAWGVKVLRYEIKDLVPPQEILRSMQAQITAEREKRARIAESEGRKIEQINLASGQREAEIQQSEGEAQAAVNASNAEKIARINRAKGEAESLRLVAEANAEAIRQIAAALQTQGGADAVNLKIAEQYVAAFNNLAKESNTLIMPANVADIGSLISAGMKIIDSSKTAK

SEQ ID NO: 970 - DNA, 951 bp, Neisseria gonorrhoeae
atggaatttttcattatcttgttggcagccgtcgccgttttcggcttcaaatcctttgtcgtcatcccccagcaggaagtccacgttgtcgaaaggctcgggcgtttccatcgcgccctgacggccggtttgaatattttgattccctttatcgaccgcgtcgcctaccgccattcgctgaaagaaatccctttagacgtacccagccaggtctgcatcacgcgcgataatacgcaattgactgttgacggcatcatctatttccaagtaaccgatcccaaactcgcctcatacggttcgagcaactacattatggcaattacccagcttgcccaaacgacgctgcgttccgttatcgggcgtatggagttggacaaaacgtttgaagaacgcgacgaaatcaacagtaccgtcgtctccgccctcgatgaagccgccggggcttggggtgtgaaagtcctccgttacgaaatcaaggatttggttccgccgcaagaaatccttcgcgcaatgcaggcacaaattaccgccgaacgcgaaaaacgcgcccgtattgccgaatccgaaggccgtaaaatcgaacaaatcaaccttgccagtggtcagcgtgaagccgaaatccaacaatccgaaggcgaggctcaggctgcggtcaatgcgtccaatgccgagaaaatcgcccgcatcaaccgcgccaaaggcgaagcggaatccctgcgccttgttgccgaagccaatgccgaagccaaccgtcaaattgccgccgcccttcaaacccaaagcggggcggatgcggtcaatctgaagattgcgggacaatacgttaccgcgttcaaaaatcttgccaaagaagacaatacgcggattaagcccgccaaggttgccgaaatcgggaaccctaattttcggcggcatgaaaaattttcgccagaagcaaaaacggccaaataa

SEQ ID NO: 971 - protein, 316 aa, Neisseria gonorrhoeae
MEFFIILLAAVAVFGFKSFVVIPQQEVHVVERLGRFHRALTAGLNILIPFIDRVAYRHSLKEIPLDVPSQVCITRDNTQLTVDGIIYFQVTDPKLASYGSSNYIMAITQLAQTTLRSVIGRMELDKTFEERDEINSTVVSALDEAAGAWGVKVLRYEIKDLVPPQEILRAMQAQITAEREKRARIAESEGRKIEQINLASGQREAEIQQSEGEAQAAVNASNAEKIARINRAKGEAESLRLVAEANAEANRQIAAALQTQSGADAVNLKIAGQYVTAFKNLAKEDNTRIKPAKVAEIGNPNFRRHEKFSPEAKTAK

SEQ ID NO: 972 - DNA, 948 bp, Neisseria meningitidis
atggaatttttcattatcttgctggcagccgtcgttgttttcggcttcaaatcctttgttgtcatcccacagcaggaagtccacgttgtcgaaaggctcgggcgtttccatcgcgccctgacggccggtttgaatattttgattccctttatcgaccgcgtcgcctaccgccattcgctgaaagaaatccctttagacgtacccagccaggtctgcatcacgcgcgacaatacgcagctgactgttgacggtatcatctatttccaagtaaccgaccccaaactcgcctcatacggttcgagcaactacattatggcgattacccagcttgcccaaacgacgctgcgttccgttatcgggcgtatggaattggacaaaacgtttgaagaacgcgacgaaatcaacagcaccgtcgtctccgccctcgatgaagccgccggagcttggggtgtgaaggttttgcgttatgagattaaagacttggttccgccgcaagaaatccttcgctcaatgcaggcgcaaattactgctgaacgcgaaaaacgcgcccgtatcgccgaatccgaaggtcgtaaaatcgaacaaatcaaccttgccagtggtcagcgcgaagccgaaatccaacaatccgaaggcgaggctcaggctgcggtcaatgcgtcaaatgccgagaaaatcgcccgcatcaaccgcgccaaaggtgaagcggaatccttgcgccttgttgccgaagccaatgccgaagccatccgtcaaattgccgccgcccttcaaacccaaggcggtgcggatgcggtcaatctgaagattgcggaacaatacgtcgccgcgttcaacaatcttgccaaagaaagcaatacgctgattatgcccgccaatgttgccgacatcggcagcctgatttctgccggtatgaaaattatcgacagcagcaaaaccgccaaataa

SEQ ID NO: 973 - protein, 315 aa, Neisseria meningitidis
MEFFIILLAAVVVFGFKSFVVIPQQEVHVVERLGRFHRALTAGLNILIPFIDRVAYRHSLKEIPLDVPSQVCITRDNTQLTVDGIIYFQVTDPKLASYGSSNYIMAITQLAQTTLRSVIGRMELDKTFEERDEINSTVVSALDEAAGAWGVKVLRYEIKDLVPPQEILRSMQAQITAEREKRARIAESEGRKIEQINLASGQREAEIQQSEGEAQAAVNASNAEKIARINRAKGEAESLRLVAEANAEAIRQIAAALQTQGGADAVNLKIAEQYVAAFNNLAKESNTLIMPANVADIGSLISAGMKIIDSSKTAK

SEQ ID NO: 974 - DNA, 948 bp, Neisseria meningitidis
atggaatttttcattatcttgttggtagccgtcgccgttttcggtttcaaatcctttgttgtcatcccacaacaggaagtccacgttgtcgaaaggctggggcgtttccatcgcgccctgacggccggtttgaatattttgattccctttatcgaccgcgtcgcctaccgccattcgctgaaagaaatccctttagacgtacccagccaggtctgcatcacgcgcgacaatacgcagctgactgttgacggcatcatctatttccaagtaaccgaccccaaactcgcctcatacggttcgagcaactacattatggcgattacccagcttgcccaaacgacgctgcgttccgttatcgggcgtatggagttggacaaaacgtttgaagaacgcgacgaaatcaacagtactgttgttgcggctttggacgaggcggccggggcttggggtgtgaaggttttgcgttatgagattaaagacttggttccgccgcaagaaatccttcgctcaatgcaggcgcaaattactgccgaacgcgaaaaacgcgcccgtatcgccgaatccgaaggtcgtaaaatcgaacaaatcaaccttgccagtggtcagcgcgaagccgaaatccaacaatccgaaggcgaggctcaggctgcggtcaatgcgtcaaatgccgagaaaatcgcccgcatcaaccgcgccaaaggtgaagcggaatccttgcgccttgttgccgaagccaatgccgaagccatccgtcaaattgccgccgcccttcaaacccaaggcggtgcggatgcggtcaatctgaagattgcggaacaatacgtcgctgcgttcaacaatcttgccaaagaaagcaatacgctgattatgcccgccaatgttgccgacatcggcagcctgatttctgccggtatgaaaattatcgacagcagcaaaaccgccaaataa

SEQ ID NO: 975 - protein, 315 aa, Neisseria meningitidis
MEFFIILLVAVAVFGFKSFVVIPQQEVHVVERLGRFHRALTAGLNILIPFIDRVAYRHSLKEIPLDVPSQVCITRDNTQLTVDGIIYFQVTDPKLASYGSSNYIMAITQLAQTTLRSVIGRMELDKTFEERDEINSTVVAALDEAAGAWGVKVLRYEIKDLVPPQEILRSMQAQITAEREKRARIAESEGRKIEQINLASGQREAEIQQSEGEAQAAVNASNAEKIARINRAKGEAESLRLVAEANAEAIRQIAAALQTQGGADAVNLKIAEQYVAAFNNLAKESNTLIMPANVADIGSLISAGMKIIDSSKTAK

SEQ ID NO: 976 - DNA, 948 bp, Neisseria gonorrhoeae
atggaatttttcattatcttgttggcagccgtcgccgttttcggcttcaaatcctttgtcgtcatcccccagcaggaagtccacgttgtcgaaaggctcgggcgtttccatcgcgccctgacggccggtttgaatattttgattccctttatcgaccgcgtcgcctaccgccattcgctgaaagaaatccctttagacgtacccagccaggtctgcatcacgcgcgataatacgcaattgactgttgacggcatcatctatttccaagtaaccgatcccaaactcgcctcatacggttcgagcaactacattatggcaattacccagcttgcccaaacgacgctgcgttccgttatcgggcgtatggagttggacaaaacgtttgaagaacgcgacgaaatcaacagtaccgtcgtctccgccctcgatgaagccgccggggcttggggtgtgaaagtcctccgttacgaaatcaaggatttggttccgccgcaagaaatccttcgcgcaatgcaggcacaaattaccgccgaacgcgaaaaacgcgcccgtattgccgaatccgaaggccgtaaaatcgaacaaatcaaccttgccagtggtcagcgtgaagccgaaatccaacaatccgaaggcgaggctcaggctgcggtcaatgcgtccaatgccgagaaaatcgcccgcatcaaccgcgccaaaggcgaagcggaatccctgcgccttgttgccgaagccaatgccgaagccatccgtcaaattgccgccgcccttcaaacccaaggcggggcggatgcggtcaatctgaagattgcggaacaatacgtagccgcgttcaacaatcttgccaaagaaagcaatacgctgattatgcccgccaatgttgccgacatcggcagcctgatttctgccggcatgaaaattatcgacagcagcaaaaccgccaaataa

SEQ ID NO: 977 - protein, 315 aa, Neisseria gonorrhoeae
MEFFIILLAAVAVFGFKSFVVIPQQEVHVVERLGRFHRALTAGLNILIPFIDRVAYRHSLKEIPLDVPSQVCITRDNTQLTVDGIIYFQVTDPKLASYGSSNYIMAITQLAQTTLRSVIGRMELDKTFEERDEINSTVVSALDEAAGAWGVKVLRYEIKDLVPPQEILRAMQAQITAEREKRARIAESEGRKIEQINLASGQREAEIQQSEGEAQAAVNASNAEKIARINRAKGEAESLRLVAEANAEAIRQIAAALQTQGGADAVNLKIAEQYVAAFNNLAKESNTLIMPANVADIGSLISAGMKIIDSSKTAK

SEQ ID NO: 978 - DNA, 948 bp, Neisseria meningitidis; identical to SEQ ID NO: 972

SEQ ID NO: 979 - protein, 315 aa, Neisseria meningitidis; identical to SEQ ID NO: 973

SEQ ID NO: 980 - DNA, 669 bp, Neisseria meningitidis
atgcagcaggcaagctatgcgatgggcgtggacatcggacgctccctgaagcaaatgaaggaacagggcgcggaaatcgatttgaaagtctttaccgaagccatgcaggcagtgtatgacggcaaagaaatcaaaatgaccgaagagcaggctcaggaagtcatgatgaaattccttcaggaacaacaggctaaagccgtagaaaaacacaaggcggacgcgaaggccaataaagaaaaaggcgaagcctttctgaaagaaaatgccgccaaagacggcgtgaagaccactgcttccggcctgcaatacaaaatcaccaaacagggcgaaggcaaacagccgaccaaagacgacatcgttaccgtggaatacgaaggccgcctgattgacggtacggtattcgacagcagcaaagccaacggcggcccggtcaccttccctttgagccaagtgattccgggttggaccgaaggcgtacagcttctgaaagaaggcggcgaagccacgttctacatcccgtccaaccttgcctaccgcgaacagggtgcgggcgacaaaatcggtccgaacgccactttggtatttgatgtgaaactggtcaaaatcggcgcacccgaaaacgcgcccgccaagcagccggctcaagtcgacatcaaaaaagtaaattaa

SEQ ID NO: 981 - protein, 222 aa, Neisseria meningitidis
MQQASYAMGVDIGRSLKQMKEQGAEIDLKVFTEAMQAVYDGKEIKMTEEQAQEVMMKFLQEQQAKAVEKHKADAKANKEKGEAFLKENAAKDGVKTTASGLQYKITKQGEGKQPTKDDIVTVEYEGRLIDGTVFDSSKANGGPVTFPLSQVIPGWTEGVQLLKEGGEATFYIPSNLAYREQGAGDKIGPNATLVFDVKLVKIGAPENAPAKQPAQVDIKKVN

SEQ ID NO: 982 - DNA, 648 bp, Neisseria gonorrhoeae
atgggcgtggacatcggacgctccctgaaacaaatgaaggaacagggcgcggaaatcgatttgaaagtctttaccgatgccatgcaggcagtgtatgacggcaaagaaatcaaaatgaccgaagagcaggcccaggaagtgatgatgaaattcctgcaggagcagcaggctaaagccgtagaaaaacacaaggcggatgcgaaggccaacaaagaaaaaggcgaagccttcctgaaggaaaatgccgccgaagacggcgtgaagaccactgcttccggtctgcagtacaaaatcaccaaacagggtgaaggcaaacagccgacaaaagacgacatcgttaccgtggaatacgaaggccgcctgattgacggtaccgtattcgacagcagcaaagccaacggcggcccggccaccttccctttgagccaagtgattccgggttggaccgaaggcgtacggcttctgaaagaaggcggcgaagccacgttctacatcccgtccaaccttgcctaccgcgaacagggtgcgggcgaaaaaatcggtccgaacgccactttggtatttgacgtgaaactggtcaaaatcggcgcacccgaaaacgcgcccgccaagcagccggatcaagtcgacatcaaaaaagtaaattaa

SEQ ID NO: 983 - protein, 215 aa, Neisseria gonorrhoeae
MGVDIGRSLKQMKEQGAEIDLKVFTDAMQAVYDGKEIKMTEEQAQEVMMKFLQEQQAKAVEKHKADAKANKEKGEAFLKENAAEDGVKTTASGLQYKITKQGEGKQPTKDDIVTVEYEGRLIDGTVFDSSKANGGPATFPLSQVIPGWTEGVRLLKEGGEATFYIPSNLAYREQGAGEKIGPNATLVFDVKLVKIGAPENAPAKQPDQVDIKKVN

SEQ ID NO: 984 - DNA, 819 bp, Neisseria meningitidis
atgaacaccattttcaaaatcagcgcactgaccctttccgccgctttggcactttccgcctgcggcaaaaaagaagccgcccccgcatctgcatccgaacctgccgccgcttcttccgcgcagggcgacacctcttcgatcggcagcacgatgcagcaggcaagctatgcgatgggcgtggacatcggacgctccctgaagcaaatgaaggaacagggcgcggaaatcgatttgaaagtctttaccgaagccatgcaggcagtgtatgacggcaaagaaatcaaaatgaccgaagagcaggctcaggaagtcatgatgaaattccttcaggaacaacaggctaaagccgtagaaaaacacaaggcggacgcgaaggccaataaagaaaaaggcgaagcctttctgaaagaaaatgccgccaaagacggcgtgaagaccactgcttccggcctgcaatacaaaatcaccaaacagggcgaaggcaaacagccgaccaaagacgacatcgttaccgtggaatacgaaggccgcctgattgacggtacggtattcgacagcagcaaagccaacggcggcccggtcaccttccctttgagccaagtgattctgggttggaccgaaggcgtacagcttctgaaagaaggcggcgaagccacgttctacatcccgtccaaccttgcctaccgcgaacagggtgcgggcgacaaaatcggcccgaacgccactttggtatttgatgtgaaactggtcaaaatcggcgcacccgaaaacgcgcccgccaagcagccggctcaagtcgacatcaaaaaagtaaattaa

SEQ ID NO: 985 - protein, 272 aa, Neisseria meningitidis
MNTIFKISALTLSAALALSACGKKEAAPASASEPAAASSAQGDTSSIGSTMQQASYAMGVDIGRSLKQMKEQGAEIDLKVFTEAMQAVYDGKEIKMTEEQAQEVMMKFLQEQQAKAVEKHKADAKANKEKGEAFLKENAAKDGVKTTASGLQYKITKQGEGKQPTKDDIVTVEYEGRLIDGTVFDSSKANGGPVTFPLSQVILGWTEGVQLLKEGGEATFYIPSNLAYREQGAGDKIGPNATLVFDVKLVKIGAPENAPAKQPAQVDIKKVN

SEQ ID NO: 986 - DNA, 819 bp, Neisseria meningitidis
atgaacaccattttcaaaatcagcgcactgaccctttccgccgctttggcactttccgcctgcggcaaaaaagaagccgcccccgcatctgcatccgaacctgccgccgcttcttccgcgcagggcgacacctcttcgatcggcagcacgatgcagcaggcaagctatgcgatgggcgtggacatcggacgctccctgaagcaaatgaaggaacagggcgcggaaatcgatttgaaagtctttaccgaagccatgcaggcagtgtatgacggcaaagaaatcaaaatgaccgaagagcaggctcaggaagtcatgatgaaattccttcaggaacaacaggctaaagccgtagaaaaacacaaggcggacgcgaaggccaataaagaaaaaggcgaagcctttctgaaagaaaatgccgccaaagacggcgtgaagaccactgcttccggcctgcaatacaaaatcaccaaacagggcgaaggcaaacagccgaccaaagacgacatcgttaccgtggaatacgaaggccgcctgattgacggtacggtattcgacagcagcaaagccaacggcggcccggtcaccttccctttgagccaagtgattccgggttggaccgaaggcgtacagcttctgaaagaaggcggcgaagccacgttctacatcccgtccaaccttgcctaccgcgaacagggtgcgggcgacaaaatcggtccgaacgccactttggtatttgatgtgaaactggtcaaaatcggcgcacccgaaaacgcgcccgccaagcagccggctcaagtcgacatcaaaaaagtaaattaa

SEQ ID NO: 987 - protein, 272 aa, Neisseria meningitidis
MNTIFKISALTLSAALALSACGKKEAAPASASEPAAASSAQGDTSSIGSTMQQASYAMGVDIGRSLKQMKEQGAEIDLKVFTEAMQAVYDGKEIKMTEEQAQEVMMKFLQEQQAKAVEKHKADAKANKEKGEAFLKENAAKDGVKTTASGLQYKITKQGEGKQPTKDDIVTVEYEGRLIDGTVFDSSKANGGPVTFPLSQVIPGWTEGVQLLKEGGEATFYIPSNLAYREQGAGDKIGPNATLVFDVKLVKIGAPENAPAKQPAQVDIKKVN

SEQ ID NO: 988 - DNA, 819 bp, Neisseria gonorrhoeae
atgaacaccattttcaaaatcagcgcactgaccctttccgccgctttggcactttccgcctgcggcaaaaaagaagccgcccccgcatctgcatccgaacctgccgccgcttctgccgcgcagggcgacacctcttcaatcggcagcacgatgcagcaggcaagctatgcaatgggcgtggacatcggacgctccctgaaacaaatgaaggaacagggcgcggaaatcgatttgaaagtctttaccgatgccatgcaggcagtgtatgacggcaaagaaatcaaaatgaccgaagagcaggcccaggaagtgatgatgaaattcctgcaggagcagcaggctaaagccgtagaaaaacacaaggcggatgcgaaggccaacaaagaaaaaggcgaagccttcctgaaggaaaatgccgccaaagacggcgtgaagaccactgcttccggtctgcagtacaaaatcaccaaacagggtgaaggcaaacagccgacaaaagacgacatcgttaccgtggaatacgaaggccgcctgattgacggtaccgtattcgacagcagcaaagccaacggcggcccggccaccttccctttgagccaagtgattccgggttggaccgaaggcgtacggcttctgaaagaaggcggcgaagccacgttctacatcccgtccaaccttgcctaccgcgaacagggtgcgggcgaaaaaatcggtccgaacgccactttggtatttgacgtgaaactggtcaaaatcggcgcacccgaaaacgcgcccgccaagcagccggatcaagtcgacatcaaaaaagtaaattaa

SEQ ID NO: 989 - protein, 272 aa, Neisseria gonorrhoeae
MNTIFKISALTLSAALALSACGKKEAAPASASEPAAASAAQGDTSSIGSTMQQASYAMGVDIGRSLKQMKEQGAEIDLKVFTDAMQAVYDGKEIKMTEEQAQEVMMKFLQEQQAKAVEKHKADAKANKEKGEAFLKENAAKDGVKTTASGLQYKITKQGEGKQPTKDDIVTVEYEGRLIDGTVFDSSKANGGPATFPLSQVIPGWTEGVRLLKEGGEATFYIPSNLAYREQGAGEKIGPNATLVFDVKLVKIGAPENAPAKQPDQVDIKKVN

SEQ ID NO: 990 - DNA, 819 bp, Neisseria meningitidis; identical to SEQ ID NO: 984

SEQ ID NO: 991 - protein, 272 aa, Neisseria meningitidis; identical to SEQ ID NO: 985

SEQ ID NO: 992 - DNA, 1326 bp, Neisseria meningitidis
atgaaaaaatacctattccgcgccgccctgtacggcatcgccgccgccatcctcgccgcctgccaaagcaagagcatccaaacctttccgcaacccgacacatccgtcatcaacggcccggaccggccggtcggcatccccgaccccgccggaacgacggtcggcggcggcggggccgtctataccgttgtaccgcacctgtccctgccccactgggcggcgcaggatttcgccaaaagcctgcaatccttccgcctcggctgcgccaatttgaaaaaccgccaaggctggcaggatgtgtgcgcccaagcctttcaaacccccgtccattcctttcaggcaaaacagttttttgaacgctatttcacgccgtggcaggttgcaggcaacggaagccttgccggtacggttaccggctattacgaaccggtgctgaagggcgacgacaggcggacggcacaagcccgcttcccgatttacggtattcccgacgattttatctccgtccccctgcctgccggtttgcggagcggaaaagcccttgtccgcatcaggcagacgggaaaaaacagcggcacaatcgacaataccggcggcacacataccgccgacctctcccgattccccatcaccgcgcgcacaacagcaatcaaaggcaggtttgaaggaagccgcttcctcccctaccacacgcgcaaccaaatcaacggcggcgcgcttgacggcaaagccccgatactcggttacgccgaagaccctgtcgaacttttttttatgcacatccaaggctcgggccgtctgaaaaccccgtccggcaaatacatccgcatcggctatgccgacaaaaacgaacatccytacgtttccatcggacgctatatggcggataagggctacctcaaactcggacaaacctccatgcagggcattaagtcttatatgcggcaaaatccgcaacgcctcgccgaagttttgggtcaaaaccccagctatatctttttccgcgagcttgccggaagcagcaatgacggccctgtcggcgcactgggcacgccgctgatgggggaatatgccggcgcagtcgaccggcactacattaccttgggtgcgcccttatttgtcgccaccgcccatccggttacccgcaaagccctcaaccgcctgattatggcgcaggataccggcagcgcgattaaaggcgcggtgcgcgtggattatttttggggatacggcgacgaagccggcgaacttgccggcaaacagaaaaccacgggatatgtctggcagctcctacccaacggtatgaagcccgaataccgcccgtaa

SEQ ID NO: 993 - protein, 441 aa, Neisseria meningitidis
MKKYLFRAALYGIAAAILAACQSKSIQTFPQPDTSVINGPDRPVGIPDPAGTTVGGGGAVYTVVPHLSLPHWAAQDFAKSLQSFRLGCANLKNRQGWQDVCAQAFQTPVHSFQAKQFFERYFTPWQVAGNGSLAGTVTGYYEPVLKGDDRRTAQARFPIYGIPDDFISVPLPAGLRSGKALVRIRQTGKNSGTIDNTGGTHTADLSRFPITARTTAIKGRFEGSRFLPYHTRNQINGGALDGKAPILGYAEDPVELFFMHIQGSGRLKTPSGKYIRIGYADKNEHPYVSIGRYMADKGYLKLGQTSMQGIKSYMRQNPQRLAEVLGQNPSYIFFRELAGSSNDGPVGALGTPLMGEYAGAVDRHYITLGAPLFVATAHPVTRKALNRLIMAQDTGSAIKGAVRVDYFWGYGDEAGELAGKQKTTGYVWQLLPNGMKPEYRP

SEQ ID NO: 994 - DNA, 1326 bp, Neisseria meningitidis
atgaaaaaatacctattccgcgccgccctgtacggcatcgccgccgccatcctcgccgcctgccaaagcaagagcatccaaacctttccgcaacccgacacatccgtcatcaacggcccggaccggccggtcggcatccccgaccccgccggaacgacggtcggcggcggcggggccgtctataccgttgtaccgcacctgtccctgccccactgggcggcgcaggatttcgccaaaagcctgcaatccttccgcctcggctgcgccaatttgaaaaaccgccaaggctggcaggatgtgtgcgcccaagcctttcaaacccccgtccattcctttcaggcaaaacagttttttgaacgctatttcacgccgtggcaggttgcaggcaacggaagccttgccggtacggttaccggctattacgaaccggtgctgaagggcgacgacaggcggacggcacaagcccgcttcccgatttacggtattcccgacgattttatctccgtccccctgcctgccggtttgcggagcggaaaagcccttgtccgcatcaggcagacgggaaaaaacagcggcacaatcgacaataccggcggcacacataccgccgacctctcccgattccccatcaccgcgcgcacaacagcaatcaaaggcaggtttgaaggaagccgcttcctcccctaccacacgcgcaaccaaatcaacggcggcgcgcttgacggcaaagccccgatactcggttacgccgaagaccctgtcgaacttttttttatgcacatccaaggctcgggccgtctgaaaaccccgtccggcaaatacatccgcatcggctatgccgacaaaaacgaacatccctacgtttccatcggacgctatatggcggataagggctacctcaaactcggacaaacctccatgcagggcattaagtcttatatgcggcaaaatccgcaacgcctcgccgaagttttgggtcaaaaccccagctatatctttttccgcgagcttgccggaagcagcaatgacggccctgtcggcgcactgggcacgccgctgatgggggaatatgccggcgcagtcgaccggcactacattaccttgggtgcgcccttatttgtcgccaccgcccatccggttacccgcaaagccctcaaccgcctgattatggcgcaggataccggcagcgcgattaaaggcgcggtgcgcgtggattatttttggggatacggcgacgaagccggcgaacttgccggcaaacagaaaaccacgggatatgtctggcagctcctacccaacggtatgaagcccgaataccgcccgtaa

SEQ ID NO: 995 - protein, 441 aa, Neisseria meningitidis; identical to SEQ ID NO: 993

SEQ ID NO: 996 - DNA, 1326 bp, Neisseria gonorrhoeae
atgaaaaaacacctgctccgctccgccctgtacggcatcgccgccgccatcctcgccgcctgccaaagcaggagcatccaaacctttccgcaacccgacacatccgtcatcaacggcccggaccggccggccggcatccccgaccccgccggaacgacggttgccggcggcggggccgtctataccgttgtgccgcacctgtccatgccccactgggcggcgcaggattttgccaaaagcctgcaatccttccgcctcggctgcgccaatttgaaaaaccgccaaggctggcaggatgtgtgcgcccaagcctttcaaacccccgtgcattcctttcaggcaaagcggttttttgaacgctatttcacgccgtggcaggttgcaggcaacggaagccttgcaggtacggttaccggctattacgaaccggtgctgaagggcgacggcaggcggacggaacgggcccgcttcccgatttacggtattcccgacgattttatctccgtcccgctgcctgccggtttgcggggcggaaaaaaccttgtccgcatcaggcagacggggaaaaacagcggcacgatcgacaatgccggcggcacgcataccgccgacctctcccgattccccatcaccgcgcgcacaacggcaatcaaaggcaggtttgaaggaagccgcttcctcccttaccacacgcgcaaccaaatcaacggcggcgcgcttgacggcaaagcccccatcctcggttacgccgaagaccccgtcgaactttttttcatgcacatccaaggctcgggccgcctgaaaaccccgtccggcaaatacatccgcatcggatacgccgacaaaaacgaacatccgtatgtttccatcggacgctatatggcggacaaaggctacctcaagctcgggcagacctcgatgcagggcatcaaagcctatatgcggcaaaatccgcaacgcctcgccgaagttttgggtcaaaaccccagctatatctttttccgcgagcttgccggaagcggcaatgagggccccgtcggcgcactgggcacgccactgatgggggaatacgccggcgcaatcgaccggcactacattaccttgggcgcgcccttatttgtcgccaccgcccatccggttacccgcaaagccctcaaccgcctgattatggcgcaggatacaggcagcgcgatcaaaggcgcggtgcgcgtggattatttttggggttacggcgacgaagccggcgaacttgccggcaaacagaaaaccacgggatacgtctggcagctcctgcccaacggcatgaagcccgaataccgcccgtga

SEQ ID NO: 997 - protein, 441 aa, Neisseria gonorrhoeae
MKKHLLRSALYGIAAAILAACQSRSIQTFPQPDTSVINGPDRPAGIPDPAGTTVAGGGAVYTVVPHLSMPHWAAQDFAKSLQSFRLGCANLKNRQGWQDVCAQAFQTPVHSFQAKRFFERYFTPWQVAGNGSLAGTVTGYYEPVLKGDGRRTERARFPIYGIPDDFISVPLPAGLRGGKNLVRIRQTGKNSGTIDNAGGTHTADLSRFPITARTTAIKGRFEGSRFLPYHTRNQINGGALDGKAPILGYAEDPVELFFMHIQGSGRLKTPSGKYIRIGYADKNEHPYVSIGRYMADKGYLKLGQTSMQGIKAYMRQNPQRLAEVLGQNPSYIFFRELAGSGNEGPVGALGTPLMGEYAGAIDRHYITLGAPLFVATAHPVTRKALNRLIMAQDTGSAIKGAVRVDYFWGYGDEAGELAGKQKTTGYVWQLLPNGMKPEYRP

SEQ ID NO: 998 - DNA, 1326 bp, Neisseria meningitidis
atgaaaaaatacctattccgcgccgccctgtgcggcatcgccgccgccatcctcgccgcctgccaaagcaagagcatccaaacctttccgcaacccgacacatccgtcatcaacggcccggaccggccggtcggcatccccgaccccgccggaacgacggtcggcggcggcggggccgtttataccgttgtgccgcacctgtccctgccccactgggcggcgcaggatttcgccaaaagcctgcaatccttccgcctcggctgcgccaatttgaaaaaccgccaaggctggcaggatgtgtgcgcccaagcctttcaaacccccgtccattccgttcaggcaaaacagttttttgaacgctatttcacgccgtggcaggttgcaggcaacggaagccttgccggtacggttaccggctattacgagccggtgctgaagggcgacgacaggcggacggcacaagcccgcttcccgatttacggtattcccgacgattttatctccgtccccctgcctgccggtttgcggagcggaaaagcccttgtccgcatcaggcagacgggaaaaaacagcggcacaatcgacaataccggcggcacacataccgccgacctctcccaattccccatcactgcgcgcacaacggcaatcaaaggcaggtttgaaggaagccgcttcctcccctaccacacgcgcaaccaaatcaacggcggcgcgcttgacggcaaagccccgatactcggttacgccgaagaccccgtcgaacttttttttatgcacatccaaggctcgggccgtctgaaaaccccgtccggcaaatacatccgcatcggctatgccgacaaaaacgaacatccctacgtttccatcggacgctatatggcggacaaaggctacctcaagctcgggcagacctcgatgcagggcatcaaagcctatatgcagcaaaacccgcaacgcctcgccgaagttttggggcaaaaccccagctatatctttttccgagagcttaccggaagcagcaatgacggccctgtcggcgcactgggcacgccgctgatgggcgagtacgccggcgcagtcgaccggcactacattaccttgggcgcgcccttatttgtcgccaccgcccatccggttacccgcaaagccctcaaccgcctgattatggcgcaggataccggcagcgcgattaaaggcgcggtgcgcgtggattatttttggggatacggcgacgaagccggcgaacttgccggcaaacagaaaaccacgggatatgtctggcagcttctgcccaacggtatgaagcccgaataccgcccgtaa

SEQ ID NO: 999 - protein, 441 aa, Neisseria meningitidis
MKKYLFRAALCGIAAAILAACQSKSIQTFPQPDTSVINGPDRPVGIPDPAGTTVGGGGAVYTVVPHLSLPHWAAQDFAKSLQSFRLGCANLKNRQGWQDVCAQAFQTPVHSVQAKQFFERYFTPWQVAGNGSLAGTVTGYYEPVLKGDDRRTAQARFPIYGIPDDFISVPLPAGLRSGKALVRIRQTGKNSGTIDNTGGTHTADLSQFPITARTTAIKGRFEGSRFLPYHTRNQINGGALDGKAPILGYAEDPVELFFMHIQGSGRLKTPSGKYIRIGYADKNEHPYVSIGRYMADKGYLKLGQTSMQGIKAYMQQNPQRLAEVLGQNPSYIFFRELTGSSNDGPVGALGTPLMGEYAGAVDRHYITLGAPLFVATAHPVTRKALNRLIMAQDTGSAIKGAVRVDYFWGYGDEAGELAGKQKTTGYVWQLLPNGMKPEYRP

SEQ ID NO: 1000 - DNA, 1101 bp, Neisseria meningitidis
  misc_feature (364)..(606): N is any nucleotide
  misc_feature (995)..(995): N is any nucleotide
  misc_feature (1082)..(1082): N is any nucleotide
atggaaacacagctttacatcggcatcatgtcgggaaccagcatggacggggcggatgccgtactgatacggatggacggcggcaaatggctgggcgcggaagggcacgcctttaccccctaccccggcaggttacgccgccaattgctggatttgcaggacacaggcgcagacgaactgcaccgcagcaggattttgtcgcaagaactcagccgcctatatgcgcaaaccgccgccgaactgctgtgcagtcaaaacctcgcaccgtccgacattaccgccctcggctgccacgggcaaaccgtccgacacgcgccggaacacggttacagcatacagcttgccgatttgccgctgctggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcttccttacgacaaaaacggtgcaaagtcggcacaaggcaacatattgccgcaactgctcgacaggctgctcgcccacccgtatttcgcacaacgccaccctaaaagcacggggcgcgaactgtttgccataaattggctcgaaacctaccttgacggcggcgaaaaccgatacgacgtattgcggacgctttcccgttttaccgcgcaaaccgtttgcgacgccgtctcacacgcagcggcagatgcccgtcaaatgtacatttgcgacggcggcatccgcaatcctgttttaatggcggatttggcagaatgtttcggcacacgcgtttccctgcacagcaccgccgacctgaacctcgatccgcaatgggtggaagccgccgnatttgcgtggttggcggcgtgttggattaatcgcattcccggtagtccgcacaaagcaaccggcgcatccaaaccgtgtattctgancgcgggatattattattga

SEQ ID NO: 1001 - protein, 366 aa, Neisseria meningitidis
  misc_feature (122)..(202): Xaa is any amino acid
  misc_feature (332)..(332): Xaa is any amino acid
  misc_feature (361)..(361): Xaa is any amino acid
METQLYIGIMSGTSMDGADAVLIRMDGGKWLGAEGHAFTPYPGRLRRQLLDLQDTGADELHRSRILSQELSRLYAQTAAELLCSQNLAPSDITALGCHGQTVRHAPEHGYSIQLADLPLLAXXXXXXXXXXXXXXXXXXXXXXXXXXXXXXXXXXXXXXXXXXXXXXXXXXXXXXXXXXXXXXXXXXXXXXXXXXXXXXXXXQLPYDKNGAKSAQGNILPQLLDRLLAHPYFAQRHPKSTGRELFAINWLETYLDGGENRYDVLRTLSRFTAQTVCDAVSHAAADARQMYICDGGIRNPVLMADLAECFGTRVSLHSTADLNLDPQWVEAAXFAWLAACWINRIPGSPHKATGASKPCILXAGYYY

SEQ ID NO: 1002 - DNA, 1101 bp, Neisseria gonorrhoeae
atggaaacacagctttacatcggcattatgtcgggaaccagtatggacggggcggatgccgtgctggtacggatggacggcggcaaatggctgggcgcggaagggcacgcctttaccccctaccctgaccggttgcgccgcaaattgctggatttgcaggacacaggcacagacgaactgcaccgcagcaggatgttgtcgcaagaactcagccgcctgtacgcgcaaaccgccgccgaactgctgtgcagtcaaaacctcgctccgtgcgacattaccgccctcggctgccacgggcaaaccgtccgacacgcgccggaacacggttacagcatacagcttgccgatttgccgctgctggcggaactgacgcggatttttaccgtcggcgacttccgcagccgcgaccttgctgccggcggacaaggtgcgccgctcgtccccgcctttcacgaagccctgttccgcgatgacagggaaacacgcgtggtactgaacatcggcgggattgccaacatcagcgtactcccccccggcgcacccgccttcggcttcgacacagggccgggcaatatgctgatggacgcgtggacgcaggcacactggcagctgccttacgacaaaaacggtgcaaaggcggcacaaggcaacatattgccgcaactgctcggcaggctgctcgcccacccgtatttctcacaaccccacccaaaaagcacggggcgcgaactgtttgccctaaattggctcgaaacctaccttgacggcggcgaaaaccgatacgacgtattgcggacgctttcccgattcaccgcgcaaaccgtttgggacgccgtctcacacgcagcggcagatgcccgtcaaatgtacatttgcggcggcggcatccgcaatcctgttttaatggcggatttggcagaatgtttcggcacacgcgtttccctgcacagcaccgccgaactgaacctcgatcctcaatgggtggaggcggccgcatttgcgtggttggcggcgtgttggattaaccgcattcccggtagtccgcacaaagcgaccggcgcatccaaaccgtgtattctgggcgcgggatattattattga

SEQ ID NO: 1003 - protein, 366 aa, Neisseria gonorrhoeae
METQLYIGIMSGTSMDGADAVLVRMDGGKWLGAEGHAFTPYPDRLRRKLLDLQDTGTDELHRSRMLSQELSRLYAQTAAELLCSQNLAPCDITALGCHGQTVRHAPEHGYSIQLADLPLLAELTRIFTVGDFRSRDLAAGGQGAPLVPAFHEALFRDDRETRVVLNIGGIANISVLPPGAPAFGFDTGPGNMLMDAWTQAHWQLPYDKNGAKAAQGNILPQLLGRLLAHPYFSQPHPKSTGRELFALNWLETYLDGGENRYDVLRTLSRFTAQTVWDAVSHAAADARQMYICGGGIRNPVLMADLAECFGTRVSLHSTAELNLDPQWVEAAAFAWLAACWINRIPGSPHKATGASKPCILGAGYYY

SEQ ID NO: 1004 - DNA, 1101 bp, Neisseria meningitidis
atggaaacacagctttacatcggcatcatgtcgggaaccagcatggacggggcggatgccgtactgatacggatggacggcggcaaatggctgggcgcggaagggcacgcctttaccccctaccccggcaggttacgccgcaaattgctggatttgcaggacacaggcgcggacgaactgcaccgcagcaggatgttgtcgcaagaactcagccgcctgtacgcgcaaaccgccgccgaactgctgtgcagtcaaaacctcgcgccgtccgacattaccgccctcggctgccacgggcaaaccgtcagacacgcgccggaacacagttacagcgtacagcttgccgatttgccgctgctggcggaacggactcagatttttaccgtcggcgacttccgcagccgcgaccttgcggccggcggacaaggcgcgccgctcgtccccgcctttcacgaagccctgttccgcgacgacagggaaacacgcgcggtactgaacatcggcgggattgccaacatcagcgtactcccccccgacgcacccgccttcggcttcgacacaggaccgggcaatatgctgatggacgcgtggatgcaggcacactggcagcttccttacgacaaaaacggtgcaaaggcggcacaaggcaacatattgccgcaactgctcgacaggctgctcgcccacccgtatttcgcacaaccccaccctaaaagcacggggcgcgaactgtttgccctaaattggctcgaaacctaccttgacggcggcgaaaaccgatacgacgtattgcggacgctttcccgattcaccgcgcaaaccgttttcgacgccgtctcacacgcagcggcagatgcccgtcaaatgtacatttgcggcggcggcatccgcaatcctgttttaatggcggatttggcagaatgtttcggcacacgcgtttccctgcacagcaccgccgaactgaacctcgatccgcaatgggtagaagccgccgcgttcgcatggatggcggcgtgttgggtcaaccgcattcccggtagtccgcacaaagcaaccggcgcatccaaaccgtgtattctgggcgcgggatattattattga

SEQ ID NO: 1005 - protein, 366 aa, Neisseria meningitidis
METQLYIGIMSGTSMDGADAVLIRMDGGKWLGAEGHAFTPYPGRLRRKLLDLQDTGADELHRSRMLSQELSRLYAQTAAELLCSQNLAPSDITALGCHGQTVRHAPEHSYSVQLADLPLLAERTQIFTVGDFRSRDLAAGGQGAPLVPAFHEALFRDDRETRAVLNIGGIANISVLPPDAPAFGFDTGPGNMLMDAWMQAHWQLPYDKNGAKAAQGNILPQLLDRLLAHPYFAQPHPKSTGRELFALNWLETYLDGGENRYDVLRTLSRFTAQTVFDAVSHAAADARQMYICGGGIRNPVLMADLAECFGTRVSLHSTAELNLDPQWVEAAAFAWMAACWVNRIPGSPHKATGASKPCILGAGYYY

SEQ ID NO: 1006 - DNA, 1101 bp, Neisseria meningitidis
  misc_feature (995)..(995): N is any nucleotide
  misc_feature (1082)..(1082): N is any nucleotide
atggaaacacagctttacatcggcatcatgtcgggaaccagcatggacggggcggatgccgtactgatacggatggacggcggcaaatggctgggcgcggaagggcacgcctttaccccctaccccggcaggttacgccgccaattgctggatttgcaggacacaggcgcagacgaactgcaccgcagcaggattttgtcgcaagaactcagccgcctatatgcgcaaaccgccgccgaactgctgtgcagtcaaaacctcgcaccgtccgacattaccgccctcggctgccacgggcaaaccgtccgacacgcgccggaacacggttacagcatacagcttgccgatttgccgctgctggcggaacggacgcggatttttaccgtcggcgacttccgcagccgcgaccttgcggccggcggacaaggcgcgccactcgtccccgcctttcacgaagccctgttccgcgacaacagggaaacacgcgcggtactgaacatcggcgggattgccaacatcagcgtactcccccccgacgcacccgccttcggcttcgacacagggccgggcaatatgctgatggacgcgtggacgcaggcacactggcagcttccttacgacaaaaacggtgcaaaggcggcacaaggcaacatattgccgcaactgctcgacaggctgctcgcccacccgtatttcgcacaaccccaccctaaaagcacggggcgcgaactgtttgccctaaattggctcgaaacctaccttgacggcggcgaaaaccgatacgacgtattgcggacgctttcccgttttaccgcgcaaaccgtttgcgacgccgtctcacacgcagcggcagatgcccgtcaaatgtacatttgcggcggcggcatccgcaatcctgttttaatggcggatttggcagaatgtttcggcacacgcgtttccctgcacagcaccgccgacctgaacctcgatccgcaatgggtggaagccgccgnatttgcgtggttggcggcgtgttggattaatcgcattcccggtagtccgcacaaagcaaccggcgcatccaaaccgtgtattctgancgcgggatattattattga

SEQ ID NO: 1007 - protein, 366 aa, Neisseria meningitidis
  misc_feature (332)..(332): Xaa is any amino acid
  misc_feature (361)..(361): Xaa is any amino acid
METQLYIGIMSGTSMDGADAVLIRMDGGKWLGAEGHAFTPYPGRLRRQLLDLQDTGADELHRSRILSQELSRLYAQTAAELLCSQNLAPSDITALGCHGQTVRHAPEHGYSIQLADLPLLAERTRIFTVGDFRSRDLAAGGQGAPLVPAFHEALFRDNRETRAVLNIGGIANISVLPPDAPAFGFDTGPGNMLMDAWTQAHWQLPYDKNGAKAAQGNILPQLLDRLLAHPYFAQPHPKSTGRELFALNWLETYLDGGENRYDVLRTLSRFTAQTVCDAVSHAAADARQMYICGGGIRNPVLMADLAECFGTRVSLHSTADLNLDPQWVEAAXFAWLAACWINRIPGSPHKATGASKPCILXAGYYY

SEQ ID NO: 1008 - DNA, 1101 bp, Neisseria meningitidis; identical to SEQ ID NO: 1004

SEQ ID NO: 1009 - protein, 366 aa, Neisseria meningitidis; identical to SEQ ID NO: 1005

SEQ ID NO: 1010 - DNA, 396 bp, Neisseria meningitidis
atgactgacaacgcactgctccatttgggcgaagaaccccgttttgatcaaatcaaaaccgaagacatcaaacccgccctgcaaaccgccatcgccgaagcgcgcgaacaaatcgccgccatcaaagcccaaacgcacaccggctgggcaaacactgtcgaacccctgaccggcatcaccgaacgcgtcggcaggatttggggcgtggtgtcgcacctcaactgcgtcgccgacacgcccgaactgcgcgccgtctataacgaactgatgcccgaaatcaccgtcttcttcaccgaaatcggacaagacatcgagctgtacaaccgcttcaaaaccatcaaaaattcccccgaattcgacaccctctcccccgcacaaaaaaccaaactcaaccac

SEQ ID NO: 1011 - protein, 132 aa, Neisseria meningitidis
MTDNALLHLGEEPRFDQIKTEDIKPALQTAIAEAREQIAAIKAQTHTGWANTVEPLTGITERVGRIWGVVSHLNCVADTPELRAVYNELMPEITVFFTEIGQDIELYNRFKTIKNSPEFDTLSPAQKTKLNH

SEQ ID NO: 1012 - DNA, 2037 bp, Neisseria gonorrhoeae
atgattgacaacgcactgctccacttgggcgaagaaccccgttttaatcaaatccaaaccgaagacatcaaacccgccgtccaaaccgccatcgccgaagcgcgcggacaaatcgccgccgtcaaagcgcaaacgcacaccggctgggcgaacaccgtcgagcgtctgaccggcatcaccgaacgcgtcggcaggatttggggcgtcgtgtcccatctcaactccgtcgtcgacacgcccgaactgcgcgccgtctataacgaactgatgcctgaaatcaccgtcttcttcaccgaaatcggacaagacatcgaactgtacaaccgcttcaaaaccatcaaaaattcccccgaatttgcaacgctttcccccgcacaaaaaaccaagctcgatcacgacctgcgcgatttcgtattgagcggcgcggaactgccgcccgaacggcaggcagaactggcaaaactgcaaaccgaaggcgcgcaactttccgccaaattctcccaaaacgtcctagacgcgaccgacgcgttcggcatttactttgacgatgccgcaccgcttgccggcattcccgaagacgcgctcgccatgtttgccgccgccgcgcaaagcgaaggcaaaacaggttacaaaatcggcttgcagattccgcactaccttgccgttatccaatacgccggcaaccgcgaactgcgcgaacaaatctaccgcgcctacgttacccgtgccagcgaactttcaaacgacggcaaattcgacaacaccgccaacatcgaccgcacgctcgaaaacgcattgaaaaccgccaaactgctcggctttaaaaattacgccgaattgtcgctggcaaccaaaatggcggacacgcccgaacaggttttaaacttcctgcacgacctcgcccgccgcgccaaaccctacgccgaaaaagacctcgccgaagtcaaagccttcgcccgcgaacacctcggtctcgccgacccgcagccgtgggacttgagctacgccggcgaaaaactgcgcgaagccaaatacgcattcagcgaaaccgaagtcaaaaaatacttccccgtcggcaaagttctggcaggcctgttcgcccaaatcaaaaaactctacggcatcggattcgccgaaaaaaccgttcccgtctggcacaaagacgtgcgctattttgaattgcaacaaaacggcaaaaccatcggcggcgtttatatggatttgtacgcacgcgaaggcaaacgcggcggcgcgtggatgaacgactacaaaggccgccgccgctttgccgacggcacgctgcaactgcccaccgcctacctcgtctgcaacttcgccccgcccgtcggcggcaaagaagcgcgtttaagccacgacgaaatcctcaccctcttccacgaaaccggccacggactgcaccacctgcttacccaagtggacgaactgggcgtgtccggcatcaacggcgtagaatgggacgcggtcgaactgcccagccagtttatggaaaacttcgtttgggaatacaatgtattggcacaaatgtccgcccacgaagaaaccggcgagcccctgccgaaagaactcttcgacaaaatgctcgccgccaaaaacttccagcgcggtatgttcctcgtccggcaaatggagttcgccctcttcgatatgatgatttacagtgaaagcgacgaatgccgtctgaaaaactggcagcaggttttagacagcgtgcgcaaagaagtcgccgtcatccaaccgcccgaatacaaccgcttcgccaacagcttcggccacatcttcgccggcggctattccgcaggctattacagctacgcatgggccgaagtcctcagcaccgatgcctacgccgcctttgaagaaagcgacgacgtcgccgccacaggcaaacgcttctggcaagaaatccttgccgtcggcggctcccgcagcgcggcggaatccttcaaagccttccgcggacgcgaaccgagcatagacgcactgctgcgccaaagcggtttcgacaacgcggcttga

SEQ ID NO: 1013 - protein, 678 aa, Neisseria gonorrhoeae
MIDNALLHLGEEPRFNQIQTEDIKPAVQTAIAEARGQIAAVKAQTHTGWANTVERLTGITERVGRIWGVVSHLNSVVDTPELRAVYNELMPEITVFFTEIGQDIELYNRFKTIKNSPEFATLSPAQKTKLDHDLRDFVLSGAELPPERQAELAKLQTEGAQLSAKFSQNVLDATDAFGIYFDDAAPLAGIPEDALAMFAAAAQSEGKTGYKIGLQIPHYLAVIQYAGNRELREQIYRAYVTRASELSNDGKFDNTANIDRTLENALKTAKLLGFKNYAELSLATKMADTPEQVLNFLHDLARRAKPYAEKDLAEVKAFAREHLGLADPQPWDLSYAGEKLREAKYAFSETEVKKYFPVGKVLAGLFAQIKKLYGIGFAEKTVPVWHKDVRYFELQQNGKTIGGVYMDLYAREGKRGGAWMNDYKGRRRFADGTLQLPTAYLVCNFAPPVGGKEARLSHDEILTLFHETGHGLHHLLTQVDELGVSGINGVEWDAVELPSQFMENFVWEYNVLAQMSAHEETGEPLPKELFDKMLAAKNFQRGMFLVRQMEFALFDMMIYSESDECRLKNWQQVLDSVRKEVAVIQPPEYNRFANSFGHIFAGGYSAGYYSYAWAEVLSTDAYAAFEESDDVAATGKRFWQEILAVGGSRSAAESFKAFRGREPSIDALLRQSGFDNAA

SEQ ID NO: 1014 - DNA, 2037 bp, Neisseria meningitidis
atgactgacaacgcactgctccatttgggcgaagaaccccgttttgatcaaatcaaaaccgaagacatcaaacccgccctgcaaaccgccattgccgaagcgcgcgaacaaatcgccgccatcaaagcccaaacgcacaccggctgggcaaacactgtcgaacccctgaccggcatcaccgaacgcgtcggcaggatttggggcgtggtgtcgcacctcaactccgtcaccgacacgcccgaactgcgcgccgcctacaatgaattaatgcccgaaattaccgtcttcttcaccgaaatcggacaagacatcgagctgtacaaccgcttcaaaaccatcaaaaactcccccgagttcgacaccctctcccacgcgcaaaaaaccaaactcaaccacgatctgcgcgatttcgtcctcagcggcgcggaactgccgcccgaacagcaggcagaattggcaaaactgcaaaccgaaggcgcgcaactttccgccaaattctcccaaaacgtcctagacgcgaccgacgcgttcggcatttactttgacgatgccgcaccgcttgccggcattcccgaagacgcgctcgccatgtttgccgctgccgcgcaaagcgaaggcaaaacaggctacaaaatcggtttgcagattccgcactacctcgccgtcatccaatacgccgacaaccgcaaactgcgcgaacaaatctaccgcgcctacgttacccgcgccagcgagctttcagacgacggcaaattcgacaacaccgccaacatcgaccgcacgctcgaaaacgccctgcaaaccgccaaactgctcggcttcaaaaactacgccgaattgtcgctggcaaccaaaatggcggacacccccgaacaagttttaaacttcctgcacgacctcgcccgccgcgccaaaccctacgccgaaaaagacctcgccgaagtcaaagccttcgcccgcgaaagcctcggcctcgccgatttgcaaccgtgggacttgggctacgccggcgaaaaactgcgcgaagccaaatacgcattcagcgaaaccgaagtcaaaaaatacttccccgtcggcaaagtattaaacggactgttcgcccaaatcaaaaaactctacggcatcggatttaccgaaaaaaccgtccccgtctggcacaaagacgtgcgctattttgaattgcaacaaaacggcgaaaccataggcggcgtttatatggatttgtacgcacgcgaaggcaaacgcggcggcgcgtggatgaacgactacaaaggccgccgccgtttttcagacggcacgctgcaactgcccaccgcctacctcgtctgcaacttcaccccgcccgtcggcggcaaagaagcccgcttgagccatgacgaaatcctcaccctcttccacgaaaccggacacggcctgcaccacctgcttacccaagtcgacgaactgggcgtatccggcatcaacggcgtagaatgggacgcagtcgaactgcccagtcagtttatggaaaatttcgtttgggaatacaatgtcttggcgcaaatgtccgcccacgaagaaaccggcgttcccctgccgaaagaactcttcgacaaaatgctcgccgccaaaaacttccaacgcggaatgttcctcgtccgccaaatggagttcgccctctttgatatgatgatttacagcgaagacgacgaaggccgtctgaaaaactggcaacaggttttagacagcgtgcgcaaagaagtcgccgtcgtccgaccgcccgaatacaaccgcttcgccaacagcttcggccacatcttcgcaggcggctattccgcaggctattacagctacgcgtgggcggaagtattgagcgcggacgcatacgccgcctttgaagaaagcgacgatgtcgccgccacaggcaaacgcttttggcaggaaatcctcgccgtcggcggatcgcgcagcgcggcagaatccttcaaagccttccgcggacgcgaaccgagcatagacgcactcttgcgccacagcggcttcgacaacgcggcttga

SEQ ID NO: 1015 - protein, 678 aa, Neisseria meningitidis
MTDNALLHLGEEPRFDQIKTEDIKPALQTAIAEAREQIAAIKAQTHTGWANTVEPLTGITERVGRIWGVVSHLNSVTDTPELRAAYNELMPEITVFFTEIGQDIELYNRFKTIKNSPEFDTLSHAQKTKLNHDLRDFVLSGAELPPEQQAELAKLQTEGAQLSAKFSQNVLDATDAFGIYFDDAAPLAGIPEDALAMFAAAAQSEGKTGYKIGLQIPHYLAVIQYADNRKLREQIYRAYVTRASELSDDGKFDNTANIDRTLENALQTAKLLGFKNYAELSLATKMADTPEQVLNFLHDLARRAKPYAEKDLAEVKAFARESLGLADLQPWDLGYAGEKLREAKYAFSETEVKKYFPVGKVLNGLFAQIKKLYGIGFTEKTVPVWHKDVRYFELQQNGETIGGVYMDLYAREGKRGGAWMNDYKGRRRFSDGTLQLPTAYLVCNFTPPVGGKEARLSHDEILTLFHETGHGLHHLLTQVDELGVSGINGVEWDAVELPSQFMENFVWEYNVLAQMSAHEETGVPLPKELFDKMLAAKNFQRGMFLVRQMEFALFDMMIYSEDDEGRLKNWQQVLDSVRKEVAVVRPPEYNRFANSFGHIFAGGYSAGYYSYAWAEVLSADAYAAFEESDDVAATGKRFWQEILAVGGSRSAAESFKAFRGREPSIDALLRHSGFDNAA

SEQ ID NO: 1016 - DNA, 2037 bp, Neisseria meningitidis
atgactgacaacgcactgctccatttgggcgaagaaccccgttttgatcaaatcaaaaccgaagacatcaaacccgccctgcaaaccgccatcgccgaagcgcgcgaacaaatcgccgccatcaaagcccaaacgcacaccggctgggcaaacactgtcgaacccctgaccggcatcaccgaacgcgtcggcaggatttggggcgtggtgtcgcacctcaactccgtcgccgacacgcccgaactgcgcgccgtctataacgaactgatgcccgaaatcaccgtcttcttcaccgaaatcggacaagacatcgagctgtacaaccgcttcaaaaccatcaaaaattcccccgaattcgacaccctctcccccgcacaaaaaaccaaactcaaccacgatctgcgcgatttcgtcctcagcggcgcggaactgccgcccgaacagcaggcagaactggcaaaactgcaaaccgaaggcgcgcaactttccgccaaattctcccaaaacgtcctagacgcgaccgacgcgttcggcatttactttgacgatgccgcaccgcttgccggcattcccgaagacgcgctcgccatgtttgccgccgccgcgcaaagcgaaagcaaaacaggctacaaaatcggcttgcagattccacactacctcgccgtcatccaatacgccgacaaccgcgaactgcgcgaacaaatctaccgcgcctacgttacccgcgccagcgaactttcagacgacggcaaattcgacaacaccgccaacatcgaccgcacgctcgcaaacgccctgcaaaccgccaaactgctcggcttcaaaaactacgccgaattgtcgctggcaaccaaaatggcggacacgcccgaacaagttttaaacttcctgcacgacctcgcccgccgcgccaaaccctacgccgaaaaagacctcgccgaagtcaaagccttcgcccgcgaaagcctgaacctcgccgatttgcaaccgtgggacttgggctacgccagcgaaaaactgcgcgaagccaaatacgcgttcagcgaaaccgaagtcaaaaaatacttccccgtcggcaaagtattaaacggactgttcgcccaaatcaaaaaactctacggcatcggatttaccgaaaaaaccgtccccgtctggcacaaagacgtgcgctattttgaattgcaacaaaacggcgaaaccataggcggcgtttatatggatttgtacgcacgcgaaggcaaacgcggcggcgcgtggatgaacgactacaaaggccgccgccgtttttcagacggcacgctgcaactgcccaccgcctacctcgtctgcaacttcgccccacccgtcggcggcagggaagcccgcctgagccacgacgaaatcctcatcctcttccacgaaaccggacacgggctgcaccacctgcttacccaagtggacgaactgggcgtatccggcatcaacggcgtagaatgggacgcggtcgaactgcccagccagtttatggaaaatttcgtttgggaatacaatgtcttggcacaaatgtcagcccacgaagaaaccggcgttcccctgccgaaagaactcttcgacaaaatgctcgccgccaaaaacttccaacgcggcatgttcctcgtccggcaaatggagttcgccctctttgatatgatgatttacagcgaagacgacgaaggccgtctgaaaaactggcaacaggttttagacagcgtgcgcaaaaaagtcgccgtcatccagccgcccgaatacaaccgcttcgccttgagcttcggccacatcttcgcaggcggctattccgcaggctattacagctacgcgtgggcggaagtattgagcgcggacgcatacgccgcctttgaagaaagcgacgatgtcgccgccacaggcaaacgcttttggcaggaaatcctcgccgtcggcggatcgcgcagcgcggcagaatccttcaaagccttccgcggccgcgaaccgagcatagacgcactcttgcgccacagcggtttcgacaacgcggtctga

SEQ ID NO: 1017 - protein, 678 aa, Neisseria meningitidis
MTDNALLHLGEEPRFDQIKTEDIKPALQTAIAEAREQIAAIKAQTHTGWANTVEPLTGITERVGRIWGVVSHLNSVADTPELRAVYNELMPEITVFFTEIGQDIELYNRFKTIKNSPEFDTLSPAQKTKLNHDLRDFVLSGAELPPEQQAELAKLQTEGAQLSAKFSQNVLDATDAFGIYFDDAAPLAGIPEDALAMFAAAAQSESKTGYKIGLQIPHYLAVIQYADNRELREQIYRAYVTRASELSDDGKFDNTANIDRTLANALQTAKLLGFKNYAELSLATKMADTPEQVLNFLHDLARRAKPYAEKDLAEVKAFARESLNLADLQPWDLGYASEKLREAKYAFSETEVKKYFPVGKVLNGLFAQIKKLYGIGFTEKTVPVWHKDVRYFELQQNGETIGGVYMDLYAREGKRGGAWMNDYKGRRRFSDGTLQLPTAYLVCNFAPPVGGREARLSHDEILILFHETGHGLHHLLTQVDELGVSGINGVEWDAVELPSQFMENFVWEYNVLAQMSAHEETGVPLPKELFDKMLAAKNFQRGMFLVRQMEFALFDMMIYSEDDEGRLKNWQQVLDSVRKKVAVIQPPEYNRFALSFGHIFAGGYSAGYYSYAWAEVLSADAYAAFEESDDVAATGKRFWQEILAVGGSRSAAESFKAFRGREPSIDALLRHSGFDNAV

SEQ ID NO: 1018 - DNA, 1473 bp, Neisseria gonorrhoeae
atgattgacaacgcactgctccacttgggcgaagaaccccgttttaatcaaatcaaaaccgaagacatcaaacccgccgtccaaaccgccatcgccgaagcgcgcggacaaatcgccgccgtcaaagcgcaaacgcacaccggctgggcgaacaccgtcgagcgtctgaccggcatcaccgaacgcgtcggcaggatttggggcgtcgtgtcccatctcaactccgtcgtcgacacgcccgaactgcgcgccgtctataacgaactgatgcctgaaatcaccgtcttcttcaccgaaatcggacaagacatcgaactgtacaaccgcttcaaaaccatcaaaaattcccccgaatttgcaacgctttcccccgcacaaaaaaccaagctcgatcacgacctgcgcgatttcgtattgagcggcgcggaactgccgcccgaacggcaggcagaactggcaaaactgcaaaccgaaggcgcgcaactttccgccaaattctcccaaaacgtcctagacgcgaccgacgcgttcggcatttactttgacgatgccgcaccgcttgccggcattcccgaagacgcgctcgccatgtttgccgccgccgcgcaaagcgaaggcaaaacaggttacaaaatcggcttgcagattccgcactaccttgccgttatccaatacgccggcaaccgcgaactgcgcgaacaaatctaccgcgcctacgttacccgtgccagcgaactttcaaacgacggcaaattcgacaacaccgccaacatcgaccgcacgctcgaaaacgcattgaaaaccgccaaactgctcggctttaaaaattacgccgaattgtcgctggcaaccaaaatggcggacacgcccgaacaggttttaaacttcctgcacgacctcgcccgccgcgccaaaccctacgccgaaaaagacctcgccgaagtcaaagccttcgcccgcgaacacctcggtctcgccgacccgcagccgtgggacttgagctacgccggcgaaaaactgcgcgaagccaaatacgcattcagcgaaaccgaagtcaaaaaatacttccccgtcggcaaagttctggcaggcctgttcgcccaaatcaaaaaactctacggcatcggattcgccgaaaaaaccgttcccgtctggcacaaagacgtgcgctattttgaattgcaacaaaacggcaaaaccatcggcggcgtttatatggatttgtacgcacgcgaaggcaaacgcggcggcgcgtggatgaacgactacaaaggccgccgccgctttgccgacggcacgctgcaactgcccaccgcctacctcgtctgcaacttcgccccgcccgtcggcggcaaagaagcgcgtttaagccacgacgaaatcctcaccctcttccacgaaaccggccacggactgcaccacctgcttacccaagtggacgaactgggcgtgtccggcatcaacggcgtaaaa

SEQ ID NO: 1019 - protein, 491 aa, Neisseria gonorrhoeae
MIDNALLHLGEEPRFNQIKTEDIKPAVQTAIAEARGQIAAVKAQTHTGWANTVERLTGITERVGRIWGVVSHLNSVVDTPELRAVYNELMPEITVFFTEIGQDIELYNRFKTIKNSPEFATLSPAQKTKLDHDLRDFVLSGAELPPERQAELAKLQTEGAQLSAKFSQNVLDATDAFGIYFDDAAPLAGIPEDALAMFAAAAQSEGKTGYKIGLQIPHYLAVIQYAGNRELREQIYRAYVTRASELSNDGKFDNTANIDRTLENALKTAKLLGFKNYAELSLATKMADTPEQVLNFLHDLARRAKPYAEKDLAEVKAFAREHLGLADPQPWDLSYAGEKLREAKYAFSETEVKKYFPVGKVLAGLFAQIKKLYGIGFAEKTVPVWHKDVRYFELQQNGKTIGGVYMDLYAREGKRGGAWMNDYKGRRRFADGTLQLPTAYLVCNFAPPVGGKEARLSHDEILTLFHETGHGLHHLLTQVDELGVSGINGVK

SEQ ID NO: 1020 - DNA, 2037 bp, Neisseria meningitidis; identical to SEQ ID NO: 1014

SEQ ID NO: 1021 - protein, 678 aa, Neisseria meningitidis; identical to SEQ ID NO: 1015

SEQ ID NO: 1022 - DNA, 534 bp, Neisseria meningitidis
atgtttccccccgacaaaacccttttcctctgtctcagcgcactgctcctcgcctcatgcggcacgacctccggcaaacaccgccaaccgaaacccaaacagacagtccggcaaatccaagccgtccgcatcagccacatcgaccgcacacaaggctcgcaggaactcatgctccacagcctcggactcatcggcacgccctacaaatggggcggcagcagcaccgcaaccggcttcgattgcagcggcatgattcaattcgtttacaaraacgccctcaacgtcaagctgccgcgcaccgcccgcgacatggcggcggcaagccgsaaaatccccgacagccgcytcaaggccggcgacctcgtattcttcaacaccggcggcgcacaccgctactcacacgtcggactctacatcggcaacggcgaattcatccatgcccccagcagcggcaaaaccatcaaaaccgaaaaactctccacaccgttttacgccaaaaactacctcggcgcacatactttttttacagaatga

SEQ ID NO: 1023 - protein, 177 aa, Neisseria meningitidis
  misc_feature (116)..(116): Xaa is any amino acid
MFPPDKTLFLCLSALLLASCGTTSGKHRQPKPKQTVRQIQAVRISHIDRTQGSQELMLHSLGLIGTPYKWGGSSTATGFDCSGMIQFVYKNALNVKLPRTARDMAAASRKIPDSRXKAGDLVFFNTGGAHRYSHVGLYIGNGEFIHAPSSGKTIKTEKLSTPFYAKNYLGAHTFFTE

SEQ ID NO: 1024 - DNA, 534 bp, Neisseria gonorrhoeae
atgttttcccccgacaaaacccttttcctctgtctcggcgcactgctcctcgcctcatgcggcacgacctccggcaaacaccgccaaccgaaacccaaacagacagtccggcaaatccaagccgtccgcatcagccacatcggccgcacacaaggctcgcaggaactcatgctccacagcctcggactcatcggcacgccctacaaatggggcggcagcagcaccgcaaccggcttcgactgcagcggcatgattcaattggtttacaaaaacgccctcaacgtcaagctgccgcgcaccgcccgcgacatggcggcggcaagccgcaaaatccccgacagccgcctcaaggccggcgacatcgtattcttcaacaccggcggcgcacaccgctactcacacgtcggactctacatcggcaacggcgaattcatccatgcccccggcagcggcaaaaccatcaaaaccgaaaaactctccacaccgttttacgccaaaaactaccttggagcgcatacgttttttacagaatga

SEQ ID NO: 1025 - protein, 177 aa, Neisseria gonorrhoeae
MFSPDKTLFLCLGALLLASCGTTSGKHRQPKPKQTVRQIQAVRISHIGRTQGSQELMLHSLGLIGTPYKWGGSSTATGFDCSGMIQLVYKNALNVKLPRTARDMAAASRKIPDSRLKAGDIVFFNTGGAHRYSHVGLYIGNGEFIHAPGSGKTIKTEKLSTPFYAKNYLGAHTFFTE

SEQ ID NO: 1026 - DNA, 534 bp, Neisseria meningitidis
atgtttccccccgacaaaacccttttcctctgtctcagcgcactgctcctcgcctcatgcggcacgacctccggcaaacaccgccaaccgaaacccaaacagacagtccggcaaatccaagccgtccgcatcagccacatcgaccgcacacaaggctcgcaggaactcatgctccacagcctcggactcatcggcacgccctacaaatggggcggcagcagcaccgcaaccggcttcgattgcagcggcatgattcaattcgtttacaaaaacgccctcaacgtcaagctgccgcgcaccgcccgcgacatggcggcggcaagccgcaaaatccccgacagccgccttaaggccggcgacctcgtattcttcaacaccggcggcgcacaccgctactcacacgtcggactctatatcggcaacggcgaattcatccatgcccccagcagcggcaaaaccatcaaaaccgaaaaactctccacaccgttttacgccaaaaactacctcggcgcacatactttctttacagaatga

SEQ ID NO: 1027 - protein, 177 aa, Neisseria meningitidis
MFPPDKTLFLCLSALLLASCGTTSGKHRQPKPKQTVRQIQAVRISHIDRTQGSQELMLHSLGLIGTPYKWGGSSTATGFDCSGMIQFVYKNALNVKLPRTARDMAAASRKIPDSRLKAGDLVFFNTGGAHRYSHVGLYIGNGEFIHAPSSGKTIKTEKLSTPFYAKNYLGAHTFFTE

SEQ ID NO: 1028 - DNA, 1467 bp, Neisseria meningitidis
atgtttaaacgcagcgtaatcgcaatggcttgtatttttgccctttcagcctgcgggggcggcggtggcggatcgcccgatgtcaagtcggcggacacgctgtcaaaacctgccgcccctgttgtttctgaaaaagagacagaggcaaaggaagatgcgccacaggcaggttctcaaggacagggcgcgccatccgcacaaggcagtcaagatatggcggcggtttcggaagaaaatacaggcaatggcggtgcggtaacagcggataatcccaaaaatgaagacgaggtggcacaaaatgatatgccgcaaaatgccgccggtacagatagttcgacaccgaatcacaccccggatccgaatatgcttgccggaaatatggaaaatcaagcaacggatgccggggaatcgtctcagccggcaaaccaaccggatatggcaaatgcggcggacggaatgcagggggacgatccgtcggcaggcgggcaaaatgccggcaatacggctgcccaaggtgcaaatcaagccggaaacaatcaagccgccggttcttcagatcccatccccgcgtcaaaccctgcacctgcgaatggcggtagcaattttggaagggttgatttggctaatggcgttttgattgacgggccgtcgcaaaatataacgttgacccactgtaaaggcgattcttgtagtggcaataatttcttggatgaagaagtacagctaaaatcagaatttgaaaaattaagtgatgcagacaaaataagtaattacaagaaagatgggaagaatgataaatttgtcggtttggttgccgatagtgtgcagatgaagggaatcaatcaatatattatcttttataaacctaaacccacttcatttgcgcgatttaggcgttctgcacggtcgaggcggtcgcttccggccgagatgccgctgattcccgtcaatcaggcggatacgctgattgtcgatggggaagcggtcagcctgacggggcattccggcaatatcttcgcgcccgaagggaattaccggtatctgacttacggggcggaaaaattgcccggcggatcgtatgcccttcgtgttcaaggcgaaccggcaaaaggcgaaatgcttgcgggcgcggccgtgtacaacggcgaagtactgcatttccatacggaaaacggccgtccgtacccgaccaggggcaggtttgccgcaaaagtcgatttcggcagcaaatctgtggacggcattatcgacagcggcgatgatttgcatatgggtacgcaaaaattcaaagccgccatcgatggaaacggctttaaggggacttggacggaaaatggcagcggggatgtttccggaaagttttacggcccggccggcgaggaagtggcgggaaaatacagctatcgcccgacagatgcggaaaagggcggattcggcgtgtttgccggcaaaaaagagcaggattga

SEQ ID NO: 1029 - protein, 488 aa, Neisseria meningitidis
MFKRSVIAMACIFALSACGGGGGGSPDVKSADTLSKPAAPVVSEKETEAKEDAPQAGSQGQGAPSAQGSQDMAAVSEENTGNGGAVTADNPKNEDEVAQNDMPQNAAGTDSSTPNHTPDPNMLAGNMENQATDAGESSQPANQPDMANAADGMQGDDPSAGGQNAGNTAAQGANQAGNNQAAGSSDPIPASNPAPANGGSNFGRVDLANGVLIDGPSQNITLTHCKGDSCSGNNFLDEEVQLKSEFEKLSDADKISNYKKDGKNDKFVGLVADSVQMKGINQYIIFYKPKPTSFARFRRSARSRRSLPAEMPLIPVNQADTLIVDGEAVSLTGHSGNIFAPEGNYRYLTYGAEKLPGGSYALRVQGEPAKGEMLAGAAVYNGEVLHFHTENGRPYPTRGRFAAKVDFGSKSVDGIIDSGDDLHMGTQKFKAAIDGNGFKGTWTENGSGDVSGKFYGPAGEEVAGKYSYRPTDAEKGGFGVFAGKKEQD

SEQ ID NO: 1030 - DNA, 1290 bp, Neisseria gonorrhoeae;
atgtttaaacgcagtgtgattgcaatggcttgtatttttcccctttcagcctgtgggggcggcggtggcggatcgcccgatgtcaagtcggcggacacgccgtcaaaaccggccgcccccgttgttgctgaaaatgccggggaaggggtgctgccgaaagaaaagaaagatgaggaggcagcgggcggtgcgccgcaagccgatacgcaggacgcaaccgccggagaaggcagccaagatatggcggcagtttcggcagaaaatacaggcaatggcggtgcggcaacaacggacaaccccaaaaatgaagacgcgggggcgcaaaatgatatgccgcaaaatgccgccgaatccgcaaatcaaacagggaacaaccaacccgccggttcttcagattccgcccccgcgtcaaaccctgcccctgcgaatggcggtagcgattttggaaggacgaacgtgggcaattctgttgtgattgacggaccgtcgcaaaatataacgttgacccactgtaaaggcgattcttgtaatggtgataatttattggatgaagaagcaccgtcaaaatcagaatttgaaaaattaagtgatgaagaaaaaattaagcgatataaaaaagacgagcaacgggagaattttgtcggtttggttgctgacagggtaaaaaaggatggaactaacaaatatatcatcttctatacggacaaaccacctactcgttctgcacggtcgaggaggtcgcttccggccgagattccgctgattcccgtcaatcaggccgatacgctgattgtggatggggaagcggtcagcctgacggggcattccggcaatatcttcgcgcccgaagggaattaccggtatctgacttacggggcggaaaaattgcccggcggatcgtatgccctccgtgtgcaaggcgaaccggcaaaaggcgaaatgcttgttggcacggccgtgtacaacggcgaagtgctgcatttccatatggaaaacggccgtccgtacccgtccggaggcaggtttgccgcaaaagtcgatttcggcagcaaatctgtggacggcattatcgacagcggcgatgatttgcatatgggtacgcaaaaattcaaagccgccatcgatggaaacggctttaaggggacttggacggaaaatggcggcggggatgtttccggaaggttttacggcccggccggcgaggaagtggcgggaaaatacagctatcgcccgacagatgctgaaaagggcggattcggcgtgtttgccggcaaaaaagatcgggattga

SEQ ID NO: 1031 - protein, 429 aa, Neisseria gonorrhoeae
MFKRSVIAMACIFPLSACGGGGGGSPDVKSADTPSKPAAPVVAENAGEGVLPKEKKDEEAAGGAPQADTQDATAGEGSQDMAAVSAENTGNGGAATTDNPKNEDAGAQNDMPQNAAESANQTGNNQPAGSSDSAPASNPAPANGGSDFGRTNVGNSVVIDGPSQNITLTHCKGDSCNGDNLLDEEAPSKSEFEKLSDEEKIKRYKKDEQRENFVGLVADRVKKDGTNKYIIFYTDKPPTRSARSRRSLPAEIPLIPVNQADTLIVDGEAVSLTGHSGNIFAPEGNYRYLTYGAEKLPGGSYALRVQGEPAKGEMLVGTAVYNGEVLHFHMENGRPYPSGGRFAAKVDFGSKSVDGIIDSGDDLHMGTQKFKAAIDGNGFKGTWTENGGGDVSGRFYGPAGEEVAGKYSYRPTDAEKGGFGVFAGKKDRD

SEQ ID NO: 1032 - DNA, 1494 bp, Neisseria meningitidis
atgtttaaacgcagtgtgattgcaatggcttgtattgttgccctttcagcctgtgggggcggcggtggcggatcgcccgatgttaagtcggcggacacgctgtcaaaacctgccgcccctgttgttactgaagatgtcggggaagaggtgctgccgaaagaaaagaaagatgaggaggcggtgagtggtgcgccgcaagccgatacgcaggacgcaaccgccggaaaaggcggtcaagatatggcggcagtttcggcagaaaatacaggcaatggcggtgcggcaacaacggataatcccgaaaataaagacgagggaccgcaaaatgatatgccgcaaaatgccgccgatacagatagttcgacaccgaatcacacccctgcaccgaatatgccaaccagagatatgggaaaccaagcaccggatgccggggaatcggcacaaccggcaaaccaaccggatatggcaaatgcggcggacggaatgcagggggacgatccgtcggcaggggaaaatgccggcaatacggcagatcaagctgcaaatcaagctgaaaacaatcaagtcggcggctctcaaaatcctgcctcttcaaccaatcctaacgccacgaatggcggcagcgattttggaaggataaatgtagctaatggcatcaagcttgacagcggttcggaaaatgtaacgttgacacattgtaaagacaaagtatgcgatagagatttcttagatgaagaagcaccaccaaaatcagaatttgaaaaattaagtgatgaagaaaaaattaataaatataaaaaagacgagcaacgagagaattttgtcggtttggttgctgacagggtagaaaagaatggaactaacaaatatgtcatcatttataaagacaagtccgcttcatcttcatctgcgcgattcaggcgttctgcacggtcgaggcggtcgcttccggccgagatgccgctgattcccgtcaatcaggcggatacgctgattgtcgatggggaagcggtcagcctgacggggcattccggcaatatcttcgcgcccgaagggaattaccggtatctgacttacggggcggaaaaattgtccggcggatcgtatgccctcagtgtgcaaggcgaaccggcaaaaggcgaaatgcttgcgggcacggccgtgtacaacggcgaagtgctgcatttccatatggaaaacggccgtccgtccccgtccggaggcaggtttgccgcaaaagtcgatttcggcagcaaatctgtggacggcattatcgacagcggcgatgatttgcatatgggtacgcaaaaattcaaagccgttatcgatggaaacggctttaaggggacttggacggaaaatggcggcggggatgtttccggaaggttttacggcccggccggcgaagaagtggcgggaaaatacagctatcgcccgacagatgcggaaaagggcggattcggcgtgtttgccggcaaaaaagagcaggattga

SEQ ID NO: 1033 - protein, 497 aa, Neisseria meningitidis
MFKRSVIAMACIVALSACGGGGGGSPDVKSADTLSKPAAPVVTEDVGEEVLPKEKKDEEAVSGAPQADTQDATAGKGGQDMAAVSAENTGNGGAATTDNPENKDEGPQNDMPQNAADTDSSTPNHTPAPNMPTRDMGNQAPDAGESAQPANQPDMANAADGMQGDDPSAGENAGNTADQAANQAENNQVGGSQNPASSTNPNATNGGSDFGRINVANGIKLDSGSENVTLTHCKDKVCDRDFLDEEAPPKSEFEKLSDEEKINKYKKDEQRENFVGLVADRVEKNGTNKYVIIYKDKSASSSSARFRRSARSRRSLPAEMPLIPVNQADTLIVDGEAVSLTGHSGNIFAPEGNYRYLTYGAEKLSGGSYALSVQGEPAKGEMLAGTAVYNGEVLHFHMENGRPSPSGGRFAAKVDFGSKSVDGIIDSGDDLHMGTQKFKAVIDGNGFKGTWTENGGGDVSGRFYGPAGEEVAGKYSYRPTDAEKGGFGVFAGKKEQD

SEQ ID NO: 1034 - DNA, 963 bp, Neisseria meningitidis
atgcaagcacggctgctgatacctattcttttttcagtttttattttatccgcctgcgggacactgacaggtattccatcgcatggcggaggtaaacgctttgcggtcgaacaagaacttgtggccgcttctgccagagctgccgttaaagacatggatttacaggcattacacggacgaaaagttgcattgtacattgccactatgggcgaccaaggttcaggcagtttgacagggggtcgctactccattgatgcactgattcgtggcgaatacataaacagccctgccgtccgtaccgattacacctatccacgttacgaaaccaccgctgaaacaacatcaggcggtttgacaggtttaaccacttctttatctacacttaatgcccctgcactctctcgcacccaatcagacggtagcggaagtaaaagcagtctgggcttaaatattggcgggatgggggattatcgaaatgaaaccttgacgactaacccgcgcgacactgcctttctttcccacttggtacagaccgtatttttcctgcgcggcatagacgttgtttctcctgccaatgccgatacagatgtgtttattaacatcgacgtattcggaacgatacgcaacagaaccgaaatgcacctatacaatgccgaaacactgaaagcccaaacaaaactggaatatttcgcagtagacagaaccaataaaaaattgctcatcaaaccaaaaaccaatgcgtttgaagctgcctataaagaaaattacgcattgtggatggggccgtataaagtaagcaaaggaattaaaccgacggaaggattaatggtcgatttctccgatatccgaccatacggcaatcatacgggtaactccgccccatccgtagaggctgataacagtcatgaggggtatggatacagcgatgaagtagtgcgacaacatagacaaggacaaccttga

SEQ ID NO: 1035 - protein, 320 aa, Neisseria meningitidis
MQARLLIPILFSVFILSACGTLTGIPSHGGGKRFAVEQELVAASARAAVKDMDLQALHGRKVALYIATMGDQGSGSLTGGRYSIDALIRGEYINSPAVRTDYTYPRYETTAETTSGGLTGLTTSLSTLNAPALSRTQSDGSGSKSSLGLNIGGMGDYRNETLTTNPRDTAFLSHLVQTVFFLRGIDVVSPANADTDVFINIDVFGTIRNRTEMHLYNAETLKAQTKLEYFAVDRTNKKLLIKPKTNAFEAAYKENYALWMGPYKVSKGIKPTEGLMVDFSDIRPYGNHTGNSAPSVEADNSHEGYGYSDEVVRQHRQGQP

SEQ ID NO: 1036 - DNA, 963 bp, Neisseria gonorrhoeae
atgcgggcacggctgctgatacctattcttttttcagtttttattttatccgcctgcgggacactgacaggtattccatcgcatggcggaggcaaacgcttcgcggtcgaacaagaacttgtggccgcttctgccagagctgccgttaaagacatggatttacaggcattacacggacgaaaagttgcattgtacattgcaactatgggcgaccaaggttcaggcagtttgacagggggtcgctactccattgatgcactgattcgcggcgaatacataaacagccctgccgtccgcaccgattacacctatccgcgttacgaaaccaccgctgaaacaacatcaggcggtttgacgggtttaaccacttctttatctacacttaatgcccctgcactctcgcgcacccaatcagacggtagcggaagtaggagcagtctgggcttaaatattggcgggatgggggattatcgaaatgaaaccttgacgaccaacccgcgcgacactgcctttctttcccacttggtgcagaccgtatttttcctgcgcggcatagacgttgtttctcctgccaatgccgatacagatgtgtttattaacatcgacgtattcggaacgatacgcaacagaaccgaaatgcacctatacaatgccgaaacactgaaagcccaaacaaaactggaatatttcgcagtagacagaaccaataaaaaattgctcatcaaacccaaaaccaatgcgtttgaagctgcctataaagaaaattacgcattgtggatggggccgtataaagtaagcaaaggaatcaaaccgacggaaggattgatggtcgatttctccgatatccaaccatacggcaatcatacgggtaactccgccccatccgtagaggctgataacagtcatgaggggtatggatacagcgatgaagcagtgcgacaacatagacaagggcaaccttga

SEQ ID NO: 1037 - protein, 320 aa, Neisseria gonorrhoeae
MRARLLIPILFSVFILSACGTLTGIPSHGGGKRFAVEQELVAASARAAVKDMDLQALHGRKVALYIATMGDQGSGSLTGGRYSIDALIRGEYINSPAVRTDYTYPRYETTAETTSGGLTGLTTSLSTLNAPALSRTQSDGSGSRSSLGLNIGGMGDYRNETLTTNPRDTAFLSHLVQTVFFLRGIDVVSPANADTDVFINIDVFGTIRNRTEMHLYNAETLKAQTKLEYFAVDRTNKKLLIKPKTNAFEAAYKENYALWMGPYKVSKGIKPTEGLMVDFSDIQPYGNHTGNSAPSVEADNSHEGYGYSDEAVRQHRQGQP

SEQ ID NO: 1038 - DNA, 963 bp, Neisseria meningitidis
atgcaagcacggctgctgatacctattcttttttcagtttttattttatccgcctgcgggacactgacaggtattccatcgcatggcggaggtaaacgcttcgcggtcgaacaagaacttgtggccgcttctgccagagctgccgttaaagacatggatttacaggcattacacggacgaaaagttgcattgtacattgcaactatgggcgaccaaggttcaggcagtttgacagggggtcgctactccattgatgcactgattcgtggcgaatacataaacagccctgccgtccgtaccgattacacctatccacgttacgaaaccaccgctgaaacaacatcaggcggtttgacaggtttaaccacttctttatctacacttaatgcccctgcactctcgcgcacccaatcagacggtagcggaagtaaaagcagtctgggcttaaatattggcgggatgggggattatcgaaatgaaaccttgacgactaacccgcgcgacactgcctttctttcccacttggtacagaccgtatttttcctgcgcggcatagacgttgtttctcctgccaatgccgatacggatgtgtttattaacatcgacgtattcggaacgatacgcaacagaaccgaaatgcacctatacaatgccgaaacactgaaagcccaaacaaaactggaatatttcgcagtagacagaaccaataaaaaattgctcatcaaaccaaaaaccaatgcgtttgaagctgcctataaagaaaattacgcattgtggatgggaccgtataaagtaagcaaaggaattaaaccgacagaaggattaatggtcgatttctccgatatccaaccatacggcaatcatatgggtaactctgccccatccgtagaggctgataacagtcatgaggggtatggatacagcgatgaagcagtgcgacgacatagacaagggcaaccttga

SEQ ID NO: 1039 - protein, 320 aa, Neisseria meningitidis
MQARLLIPILFSVFILSACGTLTGIPSHGGGKRFAVEQELVAASARAAVKDMDLQALHGRKVALYIATMGDQGSGSLTGGRYSIDALIRGEYINSPAVRTDYTYPRYETTAETTSGGLTGLTTSLSTLNAPALSRTQSDGSGSKSSLGLNIGGMGDYRNETLTTNPRDTAFLSHLVQTVFFLRGIDVVSPANADTDVFINIDVFGTIRNRTEMHLYNAETLKAQTKLEYFAVDRTNKKLLIKPKTNAFEAAYKENYALWMGPYKVSKGIKPTEGLMVDFSDIQPYGNHMGNSAPSVEADNSHEGYGYSDEAVRRHRQGQP

SEQ ID NO: 1040 - DNA, 606 bp, Neisseria meningitidis
atgaccatctatttcaaaaacggcttttacgacgacacattgggcggcatccccgaaggcgcggttgccgtccgcgccgaagaatacgccgcccttttggcaggacaggcgcagggcgggcagattgccgcagattccgacggccgccccgttttaaccccgccgcgcccgtccgattaccacgaatgggacggcaaaaaatggaaaatcagcaaagccgccgccgccgcccgtttcgccaaacaaaaaaccgccttggcattccgcctcgcggaaaaggcggacgaactcaaaaacagcctcttggcgggctatccccaagtggaaatcgacagcttttacaggcaggaaaaagaagccctcgcgcggcaggcggacaacaacgccccgaccccgatgctggcgcaaatcgccgccgcaaggggcgtggaattggacgttttgattgaaaaagttatcgaaaaatccgcccgcctggctgttgccgccggcgcgattatcggaaagcgtcagcagctcgaagacaaattgaacaccatcgaaaccgcgcccggattggacgcgctggaaaaggaaatcgaagaatggacgctaaacatcggctga

SEQ ID NO: 1041 - protein, 201 aa, Neisseria meningitidis
MTIYFKNGFYDDTLGGIPEGAVAVRAEEYAALLAGQAQGGQIAADSDGRPVLTPPRPSDYHEWDGKKWKISKAAAAARFAKQKTALAFRLAEKADELKNSLLAGYPQVEIDSFYRQEKEALARQADNNAPTPMLAQIAAARGVELDVLIEKVIEKSARLAVAAGAIIGKRQQLEDKLNTIETAPGLDALEKEIEEWTLNIG

SEQ ID NO: 1042 - DNA, 624 bp, Neisseria meningitidis
atgagaaaaccgaccgataccctacccgttaatctgcaacgccgccgcctgttgtgtgccgccggtgcgttgttgctcagtcctctggcgcacgccggcgcgcaacgtgaggaaacgcttgccgacgatgtggcttccgtgatgaggagttctgtcggcagcgtcaatccgccgaggctggtgtttgacaatccgaaagagggcgagcgttggttgtctgccatgtcggcacgtttggcaaggttcgtccccgaggaggaggagcggcgcaggctgctggtcaatatccagtacgaaagcagccgggccggtttggatacgcagattgtgttggggctgattgaggtggaaagcgcgttccgccagtatgcaatcagcggtgtcggcgcgcgcggcctgatgcaggttatgccgttttggaaaaactacatcggcaaaccggcgcacaacctgttcgacatccgcaccaacctgcgttacggctgtaccatcctgcgccattaccggaatcttgaaaaaggcaacatcgtccgcgcgcttgcccgctttaacggcagcttgggcagcaataaatatccgaacgccgttttgggcgcgtggcgcaaccgctggcagtggcgttga

SEQ ID NO: 1043 - protein, 207 aa, Neisseria meningitidis
MRKPTDTLPVNLQRRRLLCAAGALLLSPLAHAGAQREETLADDVASVMRSSVGSVNPPRLVFDNPKEGERWLSAMSARLARFVPEEEERRRLLVNIQYESSRAGLDTQIVLGLIEVESAFRQYAISGVGARGLMQVMPFWKNYIGKPAHNLFDIRTNLRYGCTILRHYRNLEKGNIVRALARFNGSLGSNKYPNAVLGAWRNRWQWR

SEQ ID NO: 1044 - DNA, 564 bp, Neisseria meningitidis
atgaaaaaaatcatcttcgccgcactcgcagccgccgccatcagtactgcctccgccgccacctacaaagtggacgaatatcacgccaacgcccgtttcgccatcgaccatttcaacaccagcaccaacgtcggcggtttttacggtctgaccggttccgtcgagttcgaccaagcaaaacgcgacggtaaaatcgacatcaccatccccattgccaacctgcaaagcggttcgcaacactttaccgaccacctgaaatcagccgacatcttcgatgccgcccaatatccggacatccgctttgtttccaccaaattcaacttcaacggcaaaaaactggtttccgttgacggcaacctgaccatgcacggcaaaaccgcccccgtcaaactcaaagccgaaaaattcaactgctaccaaagcccgatggagaaaaccgaagtttgtggcggcgacttcagcaccaccatcgaccgcaccaaatggggcatggactacctcgttaacgttggtatgaccaaaagcgtccgcatcgacatccaaatcgaggcagccaaacaataa

SEQ ID NO: 1045 - protein, 187 aa, Neisseria meningitidis
MKKIIFAALAAAAISTASAATYKVDEYHANARFAIDHFNTSTNVGGFYGLTGSVEFDQAKRDGKIDITIPIANLQSGSQHFTDHLKSADIFDAAQYPDIRFVSTKFNFNGKKLVSVDGNLTMHGKTAPVKLKAEKFNCYQSPMEKTEVCGGDFSTTIDRTKWGMDYLVNVGMTKSVRIDIQIEAAKQ

SEQ ID NO: 1046 - DNA, 4374 bp, Neisseria meningitidis
atgaaaacaaccgacaaacggacaaccgaaacacaccgcaaagccccgaaaaccggccgcatccgcttctcgcctgcttacttagccatatgcctgtcgttcggcattcttccccaagcctgggcgggacacacttatttcggcatcaactaccaatactatcgcgactttgccgaaaataaaggcaagtttgcagtcggggcgaaagatattgaggtttacaacaaaaaaggggagttggtcggcaaatcaatgacaaaagccccgatgattgatttttctgtggtgtcgcgtaacggcgtggcggcattggtgggcgatcaatatattgtgagcgtggcacataacggcggctataacaacgttgattttggtgcggaaggaagaaatcccgatcaacatcgttttacttataaaattgtgaaacggaataattataaagcagggactaaaggccatccttatggcggcgattatcatatgccgcgtttgcataaatttgtcacagatgcagaacctgttgaaatgaccagttatatggatgggcggaaatatatcgatcaaaataattaccctgaccgtgttcgtattggggcaggcaggcaatattggcgatctgatgaagatgagcccaataaccgcgaaagttcatatcatattgcaagtgcgtattcttggctcgttggtggcaatacctttgcacaaaatggatcaggtggtggcacagtcaacttaggtagtgaaaaaattaaacatagcccatatggttttttaccaacaggaggctcatttggcgacagtggctcaccaatgtttatctatgatgcccaaaagcaaaagtggttaattaatggggtattgcaaacgggcaacccctatataggaaaaagcaatggcttccagctggttcgtaaagattggttctatgatgaaatctttgctggagatacccattcagtattctacgaaccacgtcaaaatgggaaatactcttttaacgacgataataatggcacaggaaaaatcaatgccaaacatgaacacaattctctgcctaatagattaaaaacacgaaccgttcaattgtttaatgtttctttatccgagacagcaagagaacctgtttatcatgctgcaggtggtgtcaacagttatcgacccagactgaataatggagaaaatatttcctttattgacgaaggaaaaggcgaattgatacttaccagcaacatcaatcaaggtgctggaggattatatttccaaggagattttacggtctcgcctgaaaataacgaaacttggcaaggcgcgggcgttcatatcagtgaagacagtaccgttacttggaaagtaaacggcgtggcaaacgaccgcctgtccaaaatcggcaaaggcacgctgcacgttcaagccaaaggggaaaaccaaggctcgatcagcgtgggcgacggtacagtcattttggatcagcaggcagacgataaaggcaaaaaacaagcctttagtgaaatcggcttggtcagcggcaggggtacggtgcaactgaatgccgataatcagttcaaccccgacaaactctatttcggctttcgcggcggacgtttggatttaaacgggcattcgctttcgttccaccgtattcaaaataccgatgaaggggcgatgattgtcaaccacaatcaagacaaagaatccaccgttaccattacaggcaataaagatattgctacaaccggcaataacaacagcttggatagcaaaaaagaaattgcctacaacggttggtttggcgagaaagatacgaccaaaacgaacgggcggctcaaccttgtttaccagcccgccgcagaagaccgcaccctgctgctttccggcggaacaaatttaaacggcaacatcacgcaaacaaacggcaaactgtttttcagcggcagaccaacaccgcacgcctacaatcatttaaacgaccattggtcgcaaaaagagggcattcctcgcggggaaatcgtgtgggacaacgactggatcaaccgcacatttaaagcggaaaacttccaaattaaaggcggacaggcggtggtttcccgcaatgttgccaaagtgaaaggcgattggcatttgagcaatcacgcccaagcagtttttggtgtcgcaccgcatcaaagccacacaatctgtacacgttcggactggacgggtctgacaaattgtgtcgaaaaaaccattaccgacgataaagtgattgcttcattgactaagaccgacatcagcggcaatgtcgatcttgccgatcacgctcatttaaatctcacagggcttgccacactcaacggcaatcttagtgcaaatggcgatacacgttatacagtcagccacaacgccacccaaaacggcaaccttagcctcgtgggcaatgcccaagcaacatttaatcaagccacattaaacggcaacacatcggcttcgggcaatgcttcatttaatctaagcgaccacgccgtacaaaacggcagtctgacgctttccggcaacgctaaggcaaacgtaagccattccgcactcaacggtaatgtctccctagccgataaggcagtattccattttgaaagcagccgctttaccggacaaatcagcggcggcaaggatacggcattacacttaaaagacagcgaatggacgctgccgtcaggcacggaattaggcaatttaaaccttgacaacgccaccattacactcaattccgcctatcgccacgatgcggcaggggcgcaaaccggcagtgcgacagatgcgccgcgccgccgttcgcgccgttcgcgccgttccctattatccgttacaccgccaacttcggtagaatcccgtttcaacacgctgacggtaaacggcaaattgaacggtcagggaacattccgctttatgtcggaactcttcggctaccgcagcgacaaattgaagctggcggaaagttccgaaggcacttacaccttggcggtcaacaataccggcaacgaacctgcaagcctcgaacaattgacggtagtggaaggaaaagacaacaaaccgctgtccgaaaaccttaatttcaccctgcaaaacgaacacgtcgatgccggcgcgtggcgttaccaactcatccgcaaagacggcgagttccgcctgcataatccggtcaaagaacaagagctttccgacaaactcggcaaggcagaagccaaaaaacaggcggaaaaagacaacgcgcaaagccttgacgcgctgattgcggccgggcgcgatgccgtcgaaaagacagaaagcgttgccgaaccggcccggcaggcaggcggggaaaatgtcggcattatgcaggcggaggaagagaaaaaacgggtgcaggcggataaagacaccgccttggcgaaacagcgcgaagcggaaacccggccggctaccaccgccttcccccgcgcccgccgcgcccgccgggatttgccgcaactgcaaccccaaccgcagccccaaccgcagcgcgacctgatcagccgttatgccaatagcggtttgagtgaattttccgccacgctcaacagcgttttcgccgtacaggacgaattagaccgcgtatttgccgaagaccgccgcaacgccgtttggacaagcggcatccgggacaccaaacactaccgttcgcaagatttccgcgcctaccgccaacaaaccgacctgcgccaaatcggtatgcagaaaaacctcggcagcgggcgcgtcggcatcctgttttcgcacaaccggaccgaaaacaccttcgacgacggcatcggcaactcggcacggcttgcccacggcgccgttttcgggcaatacggcatcgacaggttctacatcggcatcagcgcgggcgcgggttttagcagcggcagcctttcagacggcatcggaggcaaaatccgccgccgcgtgctgcattacggcattcaggcacgataccgcgccggtttcggcggattcggcatcgaaccgcacatcggcgcaacgcgctatttcgtccaaaaagcggattaccgctacgaaaacgtcaatatcgccacccccggccttgcattcaaccgctaccgcgcgggcattaaggcagattattcattcaaaccggcgcaacacatttccatcacgccttatttgagcctgtcctataccgatgccgcttcgggcaaagtccgaacacgcgtcaataccgccgtattggctcaggatttcggcaaaacccgcagtgcggaatggggcgtaaacgccgaaatcaaaggtttcacgctgtccctccacgctgccgccgccaaaggcccgcaactggaagcgcaacacagcgcgggcatcaaattaggctaccgctggtaa

SEQ ID NO: 1047 - protein, 1457 aa, Neisseria meningitidis
MKTTDKRTTETHRKAPKTGRIRFSPAYLAICLSFGILPQAWAGHTYFGINYQYYRDFAENKGKFAVGAKDIEVYNKKGELVGKSMTKAPMIDFSVVSRNGVAALVGDQYIVSVAHNGGYNNVDFGAEGRNPDQHRFTYKIVKRNNYKAGTKGHPYGGDYHMPRLHKFVTDAEPVEMTSYMDGRKYIDQNNYPDRVRIGAGRQYWRSDEDEPNNRESSYHIASAYSWLVGGNTFAQNGSGGGTVNLGSEKIKHSPYGFLPTGGSFGDSGSPMFIYDAQKQKWLINGVLQTGNPYIGKSNGFQLVRKDWFYDEIFAGDTHSVFYEPRQNGKYSFNDDNNGTGKINAKHEHNSLPNRLKTRTVQLFNVSLSETAREPVYHAAGGVNSYRPRLNNGENISFIDEGKGELILTSNINQGAGGLYFQGDFTVSPENNETWQGAGVHISEDSTVTWKVNGVANDRLSKIGKGTLHVQAKGENQGSISVGDGTVILDQQADDKGKKQAFSEIGLVSGRGTVQLNADNQFNPDKLYFGFRGGRLDLNGHSLSFHRIQNTDEGAMIVNHNQDKESTVTITGNKDIATTGNNNSLDSKKEIAYNGWFGEKDTTKTNGRLNLVYQPAAEDRTLLLSGGTNLNGNITQTNGKLFFSGRPTPHAYNHLNDHWSQKEGIPRGEIVWDNDWINRTFKAENFQIKGGQAVVSRNVAKVKGDWHLSNHAQAVFGVAPHQSHTICTRSDWTGLTNCVEKTITDDKVIASLTKTDISGNVDLADHAHLNLTGLATLNGNLSANGDTRYTVSHNATQNGNLSLVGNAQATFNQATLNGNTSASGNASFNLSDHAVQNGSLTLSGNAKANVSHSALNGNVSLADKAVFHFESSRFTGQISGGKDTALHLKDSEWTLPSGTELGNLNLDNATITLNSAYRHDAAGAQTGSATDAPRRRSRRSRRSLLSVTPPTSVESRFNTLTVNGKLNGQGTFRFMSELFGYRSDKLKLAESSEGTYTLAVNNTGNEPASLEQLTVVEGKDNKPLSENLNFTLQNEHVDAGAWRYQLIRKDGEFRLHNPVKEQELSDKLGKAEAKKQAEKDNAQSLDALIAAGRDAVEKTESVAEPARQAGGENVGIMQAEEEKKRVQADKDTALAKQREAETRPATTAFPRARRARRDLPQLQPQPQPQPQRDLISRYANSGLSEFSATLNSVFAVQDELDRVFAEDRRNAVWTSGIRDTKHYRSQDFRAYRQQTDLRQIGMQKNLGSGRVGILFSHNRTENTFDDGIGNSARLAHGAVFGQYGIDRFYIGISAGAGFSSGSLSDGIGGKIRRRVLHYGIQARYRAGFGGFGIEPHIGATRYFVQKADYRYENVNIATPGLAFNRYRAGIKADYSFKPAQHISITPYLSLSYTDAASGKVRTRVNTAVLAQDFGKTRSAEWGVNAEIKGFTLSLHAAAAKGPQLEAQHSAGIKLGYRW

SEQ ID NO: 1048 - DNA, 1827 bp, Neisseria meningitidis
ttgggcatttcccgcaaaatatcccttattctgtccatactggcagtgtgcctgccgatgcatgcacacgcctcagatttggcaaacgattcttttatccggcaggttctcgaccgtcagcatttcgaacccgacgggaaataccacctattcggcagcaggggggaacttgccgagcgcagcggccatatcggattgggaaaaatacaaagccatcagttgggcaacctgatgattcaacaggcggccattaaaggaaatatcggctacattgtccgcttttccgatcacgggcacgaagtccattcccccttcgacaaccatgcctcacattccgattctgatgaagccggtagtcccgttgacggatttagcctttaccgcatccattgggacggatacgaacaccatcccgccgacggctatgacgggccacagggcggcggctatcccgctcccaaaggcgcgagggatatatacagctacgacataaaaggcgttgcccaaaatatccgcctcaacctgaccgacaaccgcagcaccggacaacggcttgccgaccgtttccacaatgccggtagtatgctgacgcaaggagtaggcgacggattcaaacgcgccacccgatacagccccgagctggacagatcgggcaatgccgccgaagccttcaacggcactgcagatatcgttaaaaacatcatcggcgcggcaggagaaattgtcggcgcaggcgatgccgtgcagggcataagcgaaggctcaaacattgctgtcatgcacggcttgggtctgctttccaccgaaaacaagatggcgcgcatcaacgatttggcagatatggcgcaactcaaagactatgccgcagcagccatccgcgattgggcagtccaaaaccccaatgccgcacaaggcatagaagccgtcagcaatatctttatggcagccatccccatcaaagggattggagctgttcggggaaaatacggcttgggcggcatcacggcacatcctatcaagcggtcgcagatgggcgcgatcgcattgccgaaagggaaatccgccgtcagcgacaattttgccgatgcggcatacgccaaatacccgtccccttaccattcccgaaatatccgttcaaacttggagcagcgttacggcaaagaaaacatcacctcctcaaccgtgccgccgtcaaacggcaaaaatgtcaaactggcagaccaacgccacccgaagacaggcgtaccgtttgacggtaaagggtttccgaattttgagaagcacgtgaaatatgatacgaagctcgatattcaagaattatcggggggcggtatacctaaggctaagcctgtgtttgatgcgaaaccgagatgggaggttgataggaagcttaataaattgacaactcgtgagcaggtggagaaaaatgttcaggaaataaggaacggtaatataaacagtaactttagccaacatgctcaactagagagggaaattaataaactaaaatctgccgatgaaattaattttgcagatggaatgggaaaatttaccgatagcatgaatgacaaggcttttagtaggcttgtgaaatcagttaaagagaatggcttcacaaatccagttgtggagtacgttgaaataaatggaaaagcatatatcgtaagaggaaataatrgggtttttgctgcagaataccttggcaggatacatgaattaaaatttaaaaaagttgactttcctgttcctaatactagttggaaaaatcctactgatgtcttgaatgaatcaggtaatgttaagagacctcgttataggagtaaataa

SEQ ID NO: 1049 - protein, 608 aa, Neisseria meningitidis
LGISRKISLILSILAVCLPMHAHASDLANDSFIRQVLDRQHFEPDGKYHLFGSRGELAERSGHIGLGKIQSHQLGNLMIQQAAIKGNIGYIVRFSDHGHEVHSPFDNHASHSDSDEAGSPVDGFSLYRIHWDGYEHHPADGYDGPQGGGYPAPKGARDIYSYDIKGVAQNIRLNLTDNRSTGQRLADRFHNAGSMLTQGVGDGFKRATRYSPELDRSGNAAEAFNGTADIVKNIIGAAGEIVGAGDAVQGISEGSNIAVMHGLGLLSTENKMARINDLADMAQLKDYAAAAIRDWAVQNPNAAQGIEAVSNIFMAAIPIKGIGAVRGKYGLGGITAHPIKRSQMGAIALPKGKSAVSDNFADAAYAKYPSPYHSRNIRSNLEQRYGKENITSSTVPPSNGKNVKLADQRHPKTGVPFDGKGFPNFEKHVKYDTKLDIQELSGGGIPKAKPVFDAKPRWEVDRKLNKLTTREQVEKNVQEIRNGNINSNFSQHAQLEREINKLKSADEINFADGMGKFTDSMNDKAFSRLVKSVKENGFTNPVVEYVEINGKAYIVRGNNRVFAAEYLGRIHELKFKKVDFPVPNTSWKNPTDVLNESGNVKRPRYRSK

SEQ ID NO: 1050 - DNA, 33 bp, Neisseria meningitidis;
cgcggatcccatatgttgcctgcaatcacgatt

SEQ ID NO: 1051 - protein, 28 aa, Neisseria meningitidis
CCCGCTCGAGTTTAGAAGCGGGCGGCAA

SEQ ID NO: 1052 - DNA, 34 bp, Neisseria meningitidis
cgcggatcccatatgttcaaatcctttgtcgtca

SEQ ID NO: 1053 - protein, 27 aa, Neisseria meningitidis
CCCGCTCGAGTTTGGCGGTTTTGCTGC

SEQ ID NO: 1054 - DNA, 30 bp, Neisseria meningitidis
cgcggatcccatatggccgcccccgcatct

SEQ ID NO: 1055 - protein, 31 aa, Neisseria meningitidis
CCCGCTCGAGATTTACTTTTTTGATGTCGAC

SEQ ID NO: 1056 - DNA, 33 bp, Neisseria meningitidis
cgcggatcccatatgtgccaaagcaagagcatc

SEQ ID NO: 1057 - protein, 25 aa, Neisseria meningitidis
CCCGCTCGAGCGGGCGGTATTCGGG

SEQ ID NO: 1058 - DNA, 32 bp, Neisseria meningitidis
cgcggatcccatatggaaacacagctttacat

SEQ ID NO: 1059 - protein, 29 aa, Neisseria meningitidis
CCCGCTCGAGATAATAATATCCCGCGCCC

SEQ ID NO: 1060 - DNA, 29 bp, Neisseria meningitidis
cgcggatcccatatgactgacaacgcact

SEQ ID NO: 1061 - protein, 26 aa, Neisseria meningitidis
CCCGCTCGAGGACCGCGTTGTCGAAA

SEQ ID NO: 1062 - DNA, 31 bp, Neisseria meningitidis
cgcggatcccatatgaaacaccgccaaccga

SEQ ID NO: 1063 - protein, 31 aa, Neisseria meningitidis
CCCGCTCGAGTTCTGTAAAAAAAGTATGTGC

SEQ ID NO: 1064 - DNA, 32 bp, Neisseria meningitidis
ccggaattctagctagcctttcagcctgcggg

SEQ ID NO: 1065 - protein, 28 aa, Neisseria meningitidis
CCCGCTCGAGATCCTGCTCTTTTTTGCC

SEQ ID NO: 1066 - DNA, 31 bp, Neisseria meningitidis
cgcggatcccatatgtgcgggacactgacag

SEQ ID NO: 1067 - protein, 28 aa, Neisseria meningitidis
CCCGCTCGAGAGGTTGTCCTTGTCTATG

SEQ ID NO: 1068 - DNA, 2242716 bp, Neisseria meningitidis
taaaccttatccacatccaaacgcataaccgtaacccattcaccgttatggaaatgtcgcccgacaaccacccagccgaatgattcataaaatatttgcacatcaggcgtataaagatacaagaactttatccccagcgaacgcgctgcgcctatgcagtgggcgaccagcctcctgccaatgccttttccgcgatattcaggtaaaacaaagacatcccccaaccaatattcataccgtggaaaactttccatatcatgccgcttgaccgcagccgaacccaacaggattccggaatcatccacagccgcaaatgccagcggcagttcgtcatccttcaaacacctgccgtaataggcatgaatcttatccacagaagaccacggttcaaatccgtgccactcctcaaacaacgcctgaaccaacctgccgatatgcccggctttcagccgtgtaatgaaaacagtattgtccacaaagagggaattcatcggtcaattccccgacgccttcgttccccctgcgccgtaaaccgcattccaagcatggtccaaacgcactccgatttgcctcaaatcttcagcctgccgggctttttgcgccattgctgcaggaatttccgcttccaaacgggcgatgtctgcctgagccgtctgcaaacgccggcgcgcatcttccaaatccgactgcatcccgatgatttttccgtccagattgttttgcttttgcaataaggcgcggtaaccggattggatgctgagcagattgtcttcagcatcccctgcccatacgcttgtagaaaaaacaaccatcagaaaataaaatatttttttcatttttaacttccatttaaatgctgtctgaagccgtattccgacatcagacggcatcgcccacgcctgtggataacttaagcgcggatgcgtttcaacacttcttctttgccgattaatgccaacacagcatcgacgctgggggttttcgccgtaccgcagacggcaaggcgcaggggcatgccgagtttgcccattttaatgccttcttcgtcgcagaagggtttgaagaggtcgtggatggcttcggcattccagtcttccagcccttcgaggcgttcggcaaagcgcagcatacgggcggcggcttcatcgtcccagtgtttctgcacgtctgcttcggcaggcgtttgtttgacgtagaagtagaagcactcgtcggcaagcgtgttcaagtcttgggggcggtctttgaccagttccaacacatcttccaaagcaggtttttcggtttcatgaatatcgcgcaacgcaaggcggggtttgacgagttcggcgagtttgccgttgggtgtgattttgatgtgttcgccgttgatccagtagagttttttcaagtccatacggcttggagacggggaaacgtctttcaaatcaaaccattcgatgaattgttccattgtgaagaattcatcgtcgccgtgcgcccagcccaagcgtgccagatagttgagcatcgcttcgggcaggatgcccattgcgccgaaatcggtaatggcaacggtatcgccgctgcgtttggagatttttttgccttgttcgttaagaatcatcggcaggtggccgtattcgggcaggttcgcgtcgatggcttttaagatgttgatttgtttcggcgtgttgttcacatggtcgtcgccgcggataacgtgggtaacgcccatgtcgtagtcgtctacgacaacgcagaagttgtaggtcggcgtaccgtcggcgcgggcgataatcaggtcatcgagtgcttcgttggggatggagatttcgcctttgaccaagtctgtccatttggtcacaccgtccaaaggcgttttgaaacggacaacgggttgtacgtcggacgggatttcgggcagggttttacctacttccggacgccagcggcggtcgtaagtcgccgagccttctttttcggctttctcacgcatggcttccagctcttctttgctgcaatagcagtagtaggcatggcctttttctaaaagttcggcaatgacctctttgtagcggtcgaaacggcgagtttggtaaacgacgttgtcggcgttgtcgtaattgagaccgacccatttcatgccgtcgaggatgatgttgacggattcggcggtagaacgcgccaagtcggtgtcttcaatacgtaataggaactcgcctttatgatggcgggcaaacgcccatgaaaacaaggcggtgcgcacgccgccgatgtgcaggtagccggtggggctgggggcgaaacgggttttgacggtcatgatggctccgaaatctttgaaagcgtttattttactggttttaccgtgcttgggcatcaaaaatgccgtctgaaccctgcctgcggataaagtttcagacggcattttccttgttttcaatgcttcggcacgcggaacagtgtatcacgcgccgccgaccgaattccttcgggattgcgtccaaaaaaaagttcaatgaaacagctaattgaaaaaatcccgcccccatttttccaaacggtagagggataacgcatatccctcttgcagcataaagatttttttcttatttcccgcatcaaaccgcgtggtcggcgtggcagacatataaacgcggacacccaaatcctccgccatttccgccgcccgcgccaaatggtagggatcgctgacaatcaccacgctggcaataccgttggcacgcaaaaccggacggatgttgttcaggttttcataagtgttgcgcgaagtgttttcaaacaggatgttgcgcgccggaaccccctgtttgagtgcgtaccgccgcccgacctcggcttcggtcatatagccttttttggtccggcctcccgtaaacacgattttgcctaccctgcggctctgataaagtgcgatggcatggttgatgcgttcgcggaaaacaggagaagggcgtttgtcccacgcggcggcgcccaacaccagcgcggcatccgcccggacatacggcggcaaaacctgcccacccgtccgataaaccgcccaaacggatgaggcaaacaccagcaaaagcggaaaaacactcaaacagaaaccgcccaacaggtaatagcgcaagccgttgcggctgcaaaacagccgtttgttcacaataccgcttcgatattttccagcggtctgccgacagccgccttaccgtttgccaaaacaatcggacgctccaacagggcgggatgatcggcgatggcacgcagcagcgcgtcattgtccaaattggggttgtccaaacccaattccttatacaaatcatctttcacgcgcatcatcccgcgcgccgatgccaagcccaatttgttgaaaatatccttcaattcggacaagtcgggcggcgtatccaaatatttgaccacttcggcagcaatgccgcgttcttccaatagggacaaggcggcacgcgatttgctgcaacgcggattgtggaaaattttgatttcaggcatgacatttccttgcttctcgacaatccccttattatcggcttacacagggttttactcaatatcccgcctacaaccgtaccaaacggtttacaatacccgaatcgacatacaaaggacaaaacgatgaaatacttgaatcttgccgcaatcacccttgccgccacatttgccgcacataccgcctcggcagacgaactggccggatggaaagacaacaccccgcaaagcctgcaatcgctcaaagcccccgtacgcatcgtcaacctttgggcgacttggtgcggcccgtgccgaaaagagatgcctgccatgtccaaatggtacaaagcgcagaaaaaaggcagcgtcgatatggtcggcatcgcgctcgacacatccgacaatatcggcaacttcctcaaacaaactcctgtttcctacccgatttggcgttacaccggggcgaacagccgaaactttatgaaaacctacggaaacactgtcggcgtactgccctttaccgtcgtcgaagcaccgaaatgcggatacaggcagaccattaccggggaggtaaacgaaaaaagcctgaccgacgccgtcaaactcgcccattcaaaatgccgttaaacgccggatgccgtctgaagccgcttcagatggcatttttcttttccacccgcctgccggtgcaaacttatccactatctaaaaacaggcggaatctttataatcggcactgtcttacctattgttcagacggcatatccctgcggacgcaaccgcccgaaacgatatgccgcccttccttacaggacctcctatgatccgtttcgaacaagtttccaaaacctatcccggcggttttgaagccctgaaaaacgtcagcttccaaatcaacaaaggcgaaatgatatttatcgcgggacactccggttcgggcaaatccaccatcctcaaactgatttcgggcattaccaagccgagcaggggcaaaatcctgtttaacgggcaggacctcggcacattgtccgacaaccaaatcggctttatgcgccaacacatcggcatcgtgttccaagaccacaaaatcctctacgaccgcaacgtcctgcaaaacgtcatcctgccgcttcggattatcggctatccgccgcgcaaagccgaagagcgtgcccgcatcgccatcgaaaaagtcggcctgaaaggacgagaattggacgatcccgtaaccctctccggcggtgaacaacaacgcctgtgcatcgcccgcgccgtcgttcaccagcccggcctgctgattgccgacgaaccctccgccaacctcgaccgcgcctacgcgctcgatattatggaattgttcaaaaccttccacgaagcgggaactaccgtcatcgttgccgcacatgacgaaaccctgatggcggactacggacaccgcatcctgcgcctctcgaaaggacgactcgcatgagcatcatccactacctctcgctgcacgtcgaatccgcgcgcaccgcgctcaagcagctcctgcgccaacccttcggcacactgcttaccctcatgatgctcgccgtcgcgatgaccctgccgctgtttatgcatctgggcatccaaagcgggcaaagcgtgttgggcaaactcaacgagtcgccgcaaatcacaatctatatggaaacctccgccgcacaaagcgacagcgataccgtccgcagcctgctggcgcgcgacaaacggctcgacaacatccgcttcatcggcaaagaagacggtctggaagaattacagtccaatcttgaccaaaatctgatttccatgcttgacggcaaccccctgccggatgtctttatcgttacccccgacccggcaaccacgcccgcccaaatgcaggcaatctaccgagacattaccaaactgcctatggtcgaatccgcgtctatggataccgaatgggtgcaaacgctgtaccaaatcaacgagttcatccgcaaaattttgtggtttctttccctgacgctggggatggcgttcgtccttgtcgcacacaacaccatccgcctgcaaatcctcagccgcaaagaagaaatcgaaatcaccaaactcttgggcgcgcccgcgtcgtttatccgccgcccattcctttatcaagccatgtggcagagcatcctttccgccgccgtcagcttggggctttgcggttggctgctctctgccgtgcgcccattggtcgatgccattttcaaaccctacggacttaatatcggctggcggttcttctacgctggcgaactcgggctggtgttcggcttcgtcatcgcgttgggcgtattcggcgcgtggcttgccaccacccagcacctgctcggcttcaaagccaaaaaataaaacaccgtcaaaaatgccgtccgaacccgttttcagacggcatttcaatttgccagtataatggcgcatttttccaacaaggaacctaccatgctgacctcggaacaagtaaaagccatgattgaaggcgtggcaaaatgcgaacatatcgaagtagaaggcgacggacaccattttttcgccgtcatcgtttcatcagaatttgaaggcaaggcacgcctcgcgcgccaccgcctgattaaagacggactcaaagcccaactggaaagtaacgaactgcacgcactttccatttcggttgccgccactccggcggaatgggcagccaaagcacaataatcgccacacaaaaatgccgtctgaaaccatttcgtttcagacggcattttttttatatcaaaccgcttacgcgccgcgtttttccaaagcggctacggcaggcagctctttgccttccaagaactcaaggaacgcgccgccgccggtggagatgtagccgatttgttcggtaacgccgaatttggcaatcgccgccagcgtgtcgccgccgcccgcaatcgagaacgctttgctttgggcaatggcttcggcaagggctttcgtaccgcctgcgaattggtcaaactcgaacacgccgaccggcccgttccaaacgaccgtaccggcggctttaagcaaatcggcaagcgcggcagcggatttcggaccgatgtccaaaatcatctcgtcttcggcaacgtcggcaatgtctttcaccacagcttccgcatcggcggcaatgtctttcaccacagcttccgcatcggcggcaaaggctttggcaacgacgacatcggtcggcagcggcacagaaccgccttttgccgccattttcgccataatttttttggattcttccaccaaatcgtgttccgccaaagatttgccgatggctttgccttccgccaacaggaaggtgtttgcgataccgccgccgacgatgagttggtcgactttgtccgccagcgattcgaggatggtcagcttggtggacactttgctgccggcaacgatggcaaccatcgggcgcgcgggctgtttcaaggctttgcccaaagcgtcgagttcgcccgccatcaatacgccggcgcaggcaacgggcgcggcttgggcgacggcttcggtcgaggcttgggcgcggtgggcggttccgaacgcgtcattgacgaacacgtcgcacaaagaagcgtaggctttacccagttccaaatcgtttttcttctcgcctttgttgatgcgcacgttttgcagcatgacgacatcgcccgcgttcagggcgggtttgttttcacgccagtcgttcaatactttcacgtctttgcccaacaggctgcccaagtgcgcggcaacgggggcgacatcgtcttcggggtggaactcgccttcggtcgggcggccgagatgggtcatcacgataacggacgcaccgttgtccacgcagtatttaatggacgcgagcgaggcgcggatacgggtgtcgtcgctgattttgccgtctttgaacggtacgttcatatcggcgcggatgaggacggttttgccctgcacgttttgttcggtcagttttaaaaatgccataatcagtccttttcaatcagtgtttgcgatacggaaacaattgatgccgtctgaaggcttcagacggcatcgcaacccgatcagccggatacgcgctcgattttcgcgccgacgctgccgagttttttttcaatattttcataaccgcgatccaagtggtaaatctgttcgaccacggtttcgcctcgcgccgccaaaccggcgataacgaggctggcggacgcacgcaaatccgtcgccttgacgactgcgccggaaagctgttccacaccctgcacaaatgccgtattgccctcggttgtgatgttcgcccccatccggttcaactcggggacgtgcataaagcggttttcaaaaatcgtttccaccacgcggcagcttccctccgccacggcattcaatgccataaactgcgcctgcatatccgtggggaagccggggtggacgaccgtgcggatgtccaccgccttcggacgctgccgcatatcgatggcgatccaatcgtcgcccgcctcaatcaccgcacctgcctcaaccagtttgtccaacaccacttccatcgttttcggcgcggcattccgcaaaaccaccctgccaccggttatcgccaccgcgcacaggaacgtccccgcctcgatccggtcggggacgacgctgtgttcgcagccttgcagctcgtccaccccttccacaatcattgtggacgtaccgatgccgctgattttcgcgcccattttgaccaggcattccgccaaatcgaccacttcaggctcaatggcgcagttttccaaaaccgtcgtaccttccgccagcgtcgccgccatcagcaggttttccgtgccgccgacggtaacgacatccatcgccacgcgcgtacctttgagtttgcctttggctttgacgtaaccgtgttcgataacaatctcagcacccatcgcttccaagcctttcaaatgctgatcgacggggcgcgaaccgatggcgcagccgcccggcaggctgacttgcgcctcgccgaaacgcgccagcgtcgggcccagcaccaaaatcgaagcgcgcatcgttcggaccaactcgtaaggggcgcaggtattgtttaccgtaccgccgttgatttcaaattcgctgatattgtcggtcaggacgcgcgcgcccatcccctgaagcagcttttgcgtggttttcacatctgccagcatagggacgtttttcaggcgcaacgtacccgatgtcagcaaacccgcgcacatcagcggcaatgccgcgtttttcgcgcccgagaccgttatttccccgttgagcgggccgtttgcggagattttcagtttgtccacgtttgttctttcctggtgggtacttgtatagtgaattaacaaaaatcgggacaaggcggcgaagccgcagacagtacagatagtacagaaccgattcacttggtgcttcagcaccttagagaatcgttctctttgagctaaggcgaggcaataccgtactggtttttgttaatccactataatatttcaattctcgggacaacgcataaagcatcacccgatgaaggttgcagaggcggaattataagggattttcgggaaaaatacggaagccgcaccaaagaatttgacgaaatgccgcgctttccgaacaaggattgtcggaagacaaaaaagccgagttttgaaaactcagcttttttgctttatctggtgggtcgtgagcgattcgaacgctcgaccaacggattaaaagtccgctgctctaccggctgagctaacgacccgataagtttggaattttacagaccggccgaaaccctgtcaagccccttgcgggcggacgggcgttatatccgcttatcggcctgtttttttcgtataaaccaaagaagtcaacaccgatgcacccaatgcgccgaacacgaccgacagcgaaacggaaatcgggatatgcacccaatgcattaccagcattttcacaccgataaaacccaacacgaatgccaatccatatttcaggaagataaagcgttccgccacatccgccagcaggaaatacatcgcccgcaagcccagaattgcgaaaatattggaagtcagcacgataaacggatcggtggtaacggcaaagacggcggggatgctgtccacggcaaacacgacatcgctcaattcaatcatgaccagcaccaaaaacagcggcgtggcgatttttttgccgttttcgacggtaaaaaatttctcgccgtgaaattccgtgccgaccggaacgactttcttgacggtattcagcagcctgctgtttgccaaatcctctttctcatcgccttcgggcttcatcatgtgtataccagtatagagcaggaacgcgccaaacagatacagaatccactcaaactgctgaaccagtgccgcgccgacgaaaatcatgacggtgcgcaataccaatgcgcccaatacgccgtacagcagcacgcggtgctgaaactgtggtgcgactttgaagtagccgaatatcatcaggaacacgaaaatattgtcgactgccaacgatttttccaaaatgtagccggtaaagaattccaatactttttcttttgcgactgccgcgccgtagccgggattgccggcgagttcaaaatacagccagcccgcgaacaggcaggatacggcaacccacaagccgctccatgccaaggcttctttgacgccgactttatggctgccgtttttcttcagcgaaaacatatccaaggcaatcatgaccagcactgccgcaaaaaaaacgccgtaaaacaacggcgacccgatgccgggatattctgtcatggttcaatctcctgatttgaaatgtaattgtgttaccagctgatataaaacatcgcttttgccaaaaagacaatcagcagcatatgggtaaagacgacggcgtgtatgtatttcgaccaaccgaccgtcagtgtggaacgcgccattttgacgacggcgatggcgaagtgcgccaatacgctgaacgccaacaggattttcagcgtcagcatcgtaccgaaggaagtggcaaacggttcgcccaatatagaaagatagcggtttgccgccatcacgatgccgctggcgaacagcagtccgaccacaaacggcatcaccctgacggcgcggtaagacattgccttttccacttcgcgccgcgcctcgcgcgacacccgtcccgtatgcaggacggacaaaaccagcacttcaaaaaacacgccgccgacaaaggcaatagcgcaatacagatgaacgatgtgcgcgacggcataaatactcatacgatgctccaaacggaaaactcggatacggattgtatcactatcgcccccgatatccgcataccgcttcccgcaccgcctcggcgattctcgcgcccgctccgcgatgttgtgcgataaagccgtccacgcgcgcctgcatctgcatcccccccccctcggacgataaggttttttcaacggcttcccgccacgcatccgccgattcgacttgaaccgccgcacccgatgccaaggcgtgtcggcaggcttcggaaaaattgtaggttgaaaagccgaatatcgtcggaacgccgcaggaaagcggttcgatgatgttctgacaacccgaatcgaccagactgccgccgacaaaagcgacatcggcgcacaggtaatacgcatacagctcgcccatactgtcgcctatccacacctgcgtatcaggttcgaccggcaaaccgtcgctgcgccgctgaaccttaaacccgaagcgttttgccgtttcaaataccgtctgaaaatgctcgggatggcgcggcacgacgaccagcagcgcatcgccgcgatattgttgccacgccgccagcagtttttccgcctcgtcttcaccccgataaacgcgcgtgctgccgcacacggcaaccggccggcctccgatgcgtttttcaaactgccccgccagcgttttcatctgttccgacggtatgatgtcgtatttggtattgccgcacacctgcacggatgccgcgcccaatttcgccaaccgcgccgcatccgcctctgtctgcgccagacaccccgtcagcgaagcggcggcaggacggatcaggcggcggactttcagataaccgttcaacgatttttccgacagccgcgcattcgccaaaaacagcggcacacccgcgcgccggcattccctcatcaggttgggccagatttcggtttccatcaaaatgccgaacatcgggcggtgttcgcgcaaaaactgccgtacccacgtttttttgtcatacggaagatagcggcattgcgcatcgggaaacagaacttgcgcggtttcccgccccgtcggggtcatctgcgtcatcagcagcggcgcatcgggaaaacgccgccgcaactcgcgtatcaaggactgggcggcacgcgtttctccgaccgaaacggcgtgtatccaaaccgcgccggtaacgggattcggatacggcttgccgaaacgctcgtcccgatgcgcccgatatgccggggcacttccggagcgtttgtccaaataacgccgtatccatatcggcgcaagcagccacaatacatcataaagccattggaacatctttctatttcctgcaaaacaaatgccgtctgaacggttcagacggcatttcggcaacggaatcaaatatcgtaggttgtcgaagcggtatctccgcccttgcccgtccagttggtatggaaaaactcaccgcgcggtttgtcggtgcgctcgtaagtgtgcgcgccgaagtagtcgcgctgtgcctgcaagaggttggcaggcagacgttcggtcgtgtagccgtccaagaacgtaatcgccgaagccatgcagggcatagggatgccgcattcgaccgccttggcaaccaccttgcgccacgccggcaggcagttttccaaaatatttttgaaatacggatccgcacccaagaacaccaaatcgggattgttttcatacgcgtcgcggatattgcttaagaatgcgctgcgaatgatgcacccctcgcgccacagcagcgcagtgttgccgtagtccaaatcccagccgtagctttcgcccgcttcgcggatcagcataaagccttgtgcgtaggaaatgattttagatgcaagcagggcctgtctcaacgcctcgacccattcttgtttgccgccttcgacgggcgtaacggttcgggcgaacagtttgccggtctgcacgcgctgttctttgaacgacgaaacgcagcgggcgaatacggcttcggaaatcagcgtcagcggaatacccaaatccaaagcattgatgcccgtccatttgcctgtacctttttgccctgccgtatcgaggattttctcgaccagcggttcgccgccttcgtccttatagcccaaaattgccgctgtgatttcaatcagataagaatccagctcggttttgttccactcggcaaacacgcggtacatttcgtcgtaagacagccccaagccgtctttcatgaactggtacgcttcgcaaatcaactgcatatcgccatattcgatgccgttatgcaccattttgacaaaatgccccgcaccgtctttgccgacccagtcgcaacacggttcgccctgcgacgttttggcggcaatcgcctgaaaaatcggcttgaccgcatcccaagcgcgcttatccccgcccggcataatggacggcccgcgccgcgccccttcttccccgccggacacgcccgcgccgacaaacaaaatccctttttcagcaaggtaatgtgtccgccgtgtcgtgtcggggtaattggcattgccgccgtcgataaggatgtcgccttcttccaacagcggaagcagttgttcgataaattcgtcaaccaccgaaccggcacgaaccatcatcataatttttcgcggtttttccagcttatcgaccaaatcttgcaaagaatacgcgccgataatattagttccttttgccgcgccgtttaaaaattcgtccaccttggcagtcgtgcggttgtaggcaaccaccttaaatccgcaatcgttcatattcaaaatcaggttttgccccataaccgccaaaccgattacaccaatatcgccgttcattgcaggaagctccgttatagatttaatttatcgaccgcaactctacccgatttacacttgtttaacaatccttaactttttaattttttgaaaagatgcctttacgctttgctgtaccgttttgctgaagggttataaataaaatataaaatttaaataataaaacgatgattatattgataggagaaattttctgtgggtaacttttttttattttaaaaatcatcaggatttcttttttttagggtgtcggtaaggcggattcccttttgtgcatacctgtggattgtttttcatgaagaatagtttttgtggacagtttgcttgttgtgcaaatggcatcctacttttctttaccgaatggctgccgatgtctttaagaaccggaatactgtggaggtttgagaggaaagtgtgtttggaacttgtggaaatggtcaggtgtcggcacgaatgtcttatttctgcatatcggcagagtgcgcatccgaatttgtgtataagtggtggaaaaaatgagatttgcgggtaaatctcacaatatttcagtcagataactttggattgcttgtgtataagtaaactttcggatggggatacgtaacggaaacctgtaccgcgtcattcccacgaacctacattccgtcattcccacgaaagtgggaatgatgaaattttgagttttaggaatttatcgggagcaacagaaaccgctccgccgtcattcccgcgcaggcgggaatctagaacgtaaaatctaaagaaaccgtgttgtaacggcagaccgatgccgtcattcccgcgcaggcgggaatctagaccattggacagcggcaatattcaaagattatctgaaagtccgagattctggattcccactttcgtgggaatgacgggatttgagattgcggcatttatcggaaaaaacagaaaccgctccgccgtcattcccgcgcaggcgggaatccagaccttagaacaacagcaatattcaaaggttatctgaaagtccgagattctggattcccactttcgtgggaatgacgggattttaggtttctgattttggttttctgtttttgtgggaatgatgaaattttgagttttaggaatttaccggaaaaaacagaaaccgctccgccgtcattcccgcgcaggcgggaatccagaccttagaataacagcaatattcaaagattatctgaaagtccgggattctagattcccactttcgtgggaatgacggcatcagtctgccgtttacagcacggtttctttagattttacgttctagattcccgcctgcgcgggaatgacgaatccatccatacgaaaacctgcaccacgtcattcccacgaacctacatcccgtcattcccacaaaaacagaaacctcaaatcccgtcattcccgcgcaggcgggaatctagacttgtcggtgcggacgcttatcggataaaacggtttcttgagattccgcgtcctggattcccactttcgcgggaatgacgaattttaggtttctgttttggttttttgtccttgtaggaatgatgaaaatttaagttttaggaatttaccggaaaaaatagaaagcgttatccacaagttctgatgttcagctcgtgaaatgcgtcgggcaaatcatcgctgtcggcaaattccacccggtcgtaagccgtttcgtctgccaaaaccgcgcgcaagagtgcgttgttgatggcgtgtcccgatttgtagccttcaaatgcgccgacaatcggatgtccgacgatatacaaatcaccgatggcatcaaggattttgtggcgcacaaactcatcgggatagcgcaagccttcaggattcaggacatccgtgtcgtcaatcacgatggcgttgttcaaattgccgcccaaacccagattgtgggcgcgcatcatttccacttcgtgcataaagccgaaagtgcgcgcgcgcgcgatttcgtcgatgtaggatttgccggcgaaatcgatttcaaaagtgggcgagctgcggttgaaaaccggatggtcgaattcgatggtcagcgttaccttaaagccgtcatacggcgtaaagcgcacccatttgcccgcttctttgatttcgacaggcttgaggattttcaaaaaacgcttttgcgccttttgatcgaccacgcccgcatcttgcaaaaggtaaataaacggcaggctggagccgtccataatcgggatttcgggcgcgttcagctcaatcagcgcattgtcgatgccgtaggcggacagcgcggacataatgtgttcgatcgtgccgacgcgcacgcctttgtcggtaacgatggtggaggaaaggcgggtatcgttgatcaaataaggggtcagcttgatttgttcgcccatctcgccgtccaaatcggtacggcggaaggaaatcccgctgttttcaggcgcggggtgcagggtcagcgcgacgcgttcgcccgaatgcagcccgacgccggtaacgctgatggatttcgccaaagttctttgcagcataaaccgcttccttatcaagggggtaagttttggaataatacgataaaaccggaaaaacaggctatgtttttccatagtatttgccaatgtatccgttttcaatacgtaagccgcataaaaatgtatagtggattaacaaaaatcaagacaaggcgacgaacccacccccctcctgaaaaacgcaaaaaatgccgtccgaaaacctttcggacggcattttcgcgtaaaccgtcattcccacaaggacaaaaaaccaaaacagaaaaccaaaaacagcaacctaaaattcgtcattcccgcgcaggcgggaatttggaatttcaatgcctcaagaatttatcggaaaaaaccaaaacccttccgccgtcattcccacgaaagtgggaatctagaaatgaaaagcagcaggcatttatcggaaatgaccgaaactgaacggactggattcccgcttttgcgggaatgacggcgacagggttgctgttatagtggatgaacaaaaaccagtacggcgttgcctcggcttagctcaaagagaacgattctctaaggtgctgaagcaccaagtgaatcggttccgtactatttgtactgtctgcggcttcgtcgccttgtcctgatttttgttaatccactatatctagccgaattactttattttttgatacgtaaccggccggttgccgtcattcccgcgcaggcgggaatctagacattcaatgctaaggcaatttatcgggaatgactgaaactcaaaaagctggattcccactttcgtgggaatgacgcggtgcaggtttccgtacggatagcttcgtcattcccgagtaggcgggaatctagtccgcttgttcggtaaatgagagggcggattgcgcgcctgtcagataaaccacgtgtttaaacgggcggcaatgaggtacgcgcagagccttgaagcgcaatcgatatattattttcagccaaaacggacgcccccgcttgccttgcaaacctttaaaaaggaagccacccggattaatccgagtggccgtggaaaatcacttaccgcttgatttatttaaaatttatggtataatttaccttagctggcatcacttgcgtcgcggcaggttgacggcaggtgcttggtgtcaatcttcttaccgttggcggcggcggcggcggtaacgtcgtcgttggcggctttggctttgtcgcgcgtaaccggctgtccgcagaaccattttaccgaaccgttttgacgcttggcccacagggagagttttttgcctttgatttcgttgtttacgttgcttgaagccatttgggcggtaacgacgccgtttttgacttcaacgcttttaacatatttgcctttgatttcagaggaggttgccacgccggcagaagtgttgttgccgggccattcgccgtgattcaggtaatactcggtaacggctgatttttgaccttcggccaaaagaatggcttcggaaacttgtgcgcgggctgtgtagtcttgataagcaggaagggcgactgccgccaaaatgccgacgatggcaatcacaatcatcagctcgataagggtaaaacctttttgaagggtgttcataaaattactcctaattggaaaggaaatgcctcaagcttacgccatcggcattatgcaatgtatttgaccatcggtattttgttgcgatacctgtgtattataaagcaagattggtaccaagtttgtattttgaggtgaaaatttatgcgtttatctctatgtaattgtttttattttacattttctttcgtttggcgtggtttgagtaattagggggttgccgttttttgtcagcagtgttgaaaattgtcagttttagtgccgattttcggcacttttttattggcgtggggtatctctattggcatggggcatcgggtgtgttgattgggtcggaatttgagatttttgaatttgcgcggtagcatagggtgggttgggtgggaaattttaaatttaatttttaaaaatttccgttttcttggaaagtgattgaaatcggcgcgtggtgttcctgtgcaaccggcagttgaatcatcgcggcaggtttccgtgcggatggcttcgtcattcccgcgcaggcgggaatccagccttgttggtacggaaacttatcgggaaaacggtttcttgagattttacgttctggattcccactttcgcgggaatgacgcggtgcaggtttccgtatggatagcttcgtcattcccgcgcaggcgggaatccaggtctgtcggcacggaaacttatcgggtaaaaaggtttcttgagatttttcgtcctggattcccactttcgtgggaatgacgggatgtaggttcgtgggaatgacggtttaggtatttttatagaaagccgtaggtggtgtttctatgcaaacgacagatgaatcatcgcggcaggttgacggcaggtgcttggtgtcgattttgtcggtgccggtggcggcggcggtaacggcgtcgtctttggcgttgtcggcgcgcgtaaccggcagtccgcagaaccattttaccgaaccggcttgacgcttggcccacagggagagttttttgcctttgatttcgttgtttacgttgcttgaagccatttgggcggtaacgacgccgtttttgacttcaacgcttttaacatatttgcctttgatgtcggcggaggttgccacgccggcagaactgttgttgccgggccattcgccgtgattcaggtaatactctgtgacggctgatttttgaccttcagccaaaagaatggcttcgtcattcccgcgcaggcgggaatctaggtctgtcggcacggaaacttatcgggaaaacagtttcttgagattttgcgttctggattcccgctttcgcgggaatgacgggattaaagtttcaaaatttattctaaataactgaaattcaacgaactagattcccactttcgtgggaatgacgaattttaggttgctgtttttgtgggaatgatgaaattttaagttttaggaatttatcgaaaaaacagaaaccgctccgccgtcattcccgcgcaggcgggaatccagcctcgtcggtacggaaacttatcgggtaaaaaggtttctctagtttggtgtcgattttcttgtcgatgctgttgacggcaggtgcttggtgtcgatctgcttgccgttggcggcggtgtcggctttgacggcgtcggcgctggcgttgtcgcgcttaaccggctgtccgtagaaccattttaccgaaccgtcttgacgcttggcccacagggagagttttttgccttggatttctttgtttacgccgcttgaaagcattgtggcggtaacgacgccgtttttgacttcaactttctcaacatatttgcctttgatgttggcggaggttgccacgccggcagaactgttgttgccgggccattcgccgtgattcaggtaatactcggtgacggctgatttttgaccttcagccaaaagaatggcttcgtcattcccgcgcaggcgggaatctagaccttagaacaacagcaatattcaaagattatctgaaagtccgggattctagattcccactttcgtgggaatgacgaattttaggttgctgtttttggttttctgtttttgagggaatgatgaaattttaagttttaggaatttatcagaaaaaacagaaaccgctccgccgtcattcccgcgcaggcgggaatccaggtctgtcggtacggaaacttatcgggtaaaacggtttctctagtttggtgtcgattttcttgtcggtgctgttgacggcaggtgcttggtgttgatgttggcggtgcccttgccggtggcggcggtgacggcgtcgtctttggctttgtcgcgcgtaaccggctgtccgcagaaccattttaccgaaccgttttgacgcttggcccacagggagagttttttgcctttgatttcgttgtttacgttgcttgaagccatttgggcggtaacgacgccgtttttgacttcaacgcttttaacatatttgcctttgatttcagaggaggttgccacgccggcagaactgttgtcgccgggccattcgccgtgattcaggtaatactcggtaacggctgatttttgaccttcgaccaaaaggatagcttcgtcattcccgcgcaggcgggaatccagccttgtcggtacggaaacttatcgggtaaaacggtttctttagattttgcgttctggattcccactttcgtgggaatgacgggattaaagtttcaaaatttattctaaataactgaaactcaacgaactagattcccgcttttgcgggaatgacgaattttaggtttctgttttgggttttctgtttttgagggaatgatgaaattttaggtttctgtttttggttttctgtccttgtgggaatgatgaaattttaagttttaggaatttatcggaaaaaacagaaaccgctccgccgtcattcccgcgcaggcgggaatccagcctcgtcggtgcggaaacttatcgggaaaacggtttctttagattttacgttctggattcctactttcgtgggaaagacgaattttaggtttctgtttttggttttctgtccttgtgggaatgatgaaaatttaagttttaggaatttatcggaaaaaacagaaaccgctctgccgtcattcccgcaaaagcgggaatccagcctcgtcggtgcggaaacttatcgggtaaaaaggtttctttagtttggtgtcgattttgtcggtgccggtggcggcggcaacgtcgtctttggcgttgtcggcgcgcgtaaccggctgtccgcagaaccattttaccgaaccggcttgacgcttggcccacagggagagttttttgcctttgatttcgttgtttacgccggttgaaagcattgtggcggtaacgacgccgtttttgacttcaacttccttaacatatttgcctttgattgttgaagaagatgccacgccggcggcatcattaaatcccgtcattcccactttcgtgggaatgacgggattaaagtttcaaaatttattctaaataactgaaactcaacgaactagattcccgcttttgcgggaatgacgaattttaggttgctgtttttggttttctgtccttgcgggaatgatgaaattttaagttttaggaatttatcgaaaaaacagaaaccgctccgccgtcattcccgcgcaggcgggaatccagcctcgtcggtgcggaaacttatcgggaaaacggtttcttgagattttgcgttctggattcccgctttcgtgggaatgacggtttaggtatttttatagaaagccgtaggtggtgtttctatgcaaacgacagatgaagcgtcgcggcaggttgacggcaggtgcttggtgttgatgttgtcggcggtcttggcggcggcggcgacggtgtcggctttggcgtcggtgcgcgtaaccggctgtccgcagaaccattttaccgaaccgtcttgacgcttggcccacagggagagttttttgccttggatttctttgtttacgccgcttgaaagcattgtggcggtaatgacgccgtttgcgactgtaacttccttaacatatttgcctttgattgttgaagaagatgccacgccggcagaagtgttgttgccgggccattcgccgtgattcaggtaatactctgtgacggctgatttttgaccttcggccaaaaggatagcttcgtcattcccgcgcaggcgggaatccaggtctgtcggtacggaaacttatcgggtaaaacggtttctttagattttgcgttctggattcccactttcgcgggaatgacgggattaaagtttcaaaatttattctaaataactgaaaccaacgaactagattcccacttttgcgggaatgacgaagtttttctgccatttgccgtgattcgggcaatactcggtaacggctgattttttgaaagtgtttgaaatcggcgcgtggtgtttctatgcaaccggtagatgaatcatcgcggcaggttgacggcaggtgcttggtgttgattttgtcgtcggtcttgccgttggcggcggcgacgtcggtggcggtggcggtggcggtgtcgttgcgcgtaaccggctgtccgcagaaccatttgaccgaaccgttttgacgcttggcccacagggagagttttttgcctttgatttctttgtttacgccgcttgaaagcattgtggcggtaacgacgccgtttttgacttcaactttctcaacatatttgcctttgatgtcggaggaggatgccacgccggcggcatcattaaatcccgtcattcccgcaaaagcgggaatctagaactcaggaccggagaaacctttttacccgataagtttccgtgccgacagacctagattcccgcctgcgtgggaatgatgggattaaagtttcaaaatttattctaaataactgaaactcaacgaactagattcccgcttttgcgggaatgacgaattttaggtttctgtttgtgggtttctgttcttgtgggaatgatgaaattttaagttttaggaatttatcggaaaaaacagaaaccgctccgccgtcattcccgcgcaggcgggaatccagccttgtcggtacggaaacttatcgggtaaaaaggtttctctagtttggtgtcgattttcttgtcggtgctgttgacggcaggtgcttggtgttgattttgtcggtgtcgggtgtggcggcggtgacttcgtcggtgccggctttggcgttggcggcgttgcgcgtaaccggctgtccgcagaaccattttaccgaaccgtcttgacgcttggcccacagggagagttttttgccttggatttctttgtttacgccgcttgaaagcattgtggcggtaatgacgccgtttgcgactgtaacttccttaacatatttgcctttgattgttgaagaagatgccacgccggcagaagtgttgtttttcggccattcgccgtgattcgggtaatactcgggtgtttttgtgcaaacggcagatgctgcgtcgcggcaggttgacggcaggtgcttggtgttggttttcttgttgccggtgttgtcggcggcgacggtgtcgtcggtgccggcgcgcgtaaccggctgtccgcagaaccattttaccgaaccgttttgacgcttggcccacagggagagttttttgccttggatttctttgtttacgccgcttgaaagcattgtggcggtaacgacgccgtttgcgactgtaacttccttaacatattttcctttgattttagaggaggatgccacgccggcggcatcattaaatcccgtcattcccacgaaagtgggaatctagaactcaggaccggagaaacctttttacccgataagtttccgtgccgacagacctggattcccgcctgcgcgggaatgacgaagtttttcggccattcgccgtgattcgggcaatactcgggtgttttgtgcaaacggcagatgctgcgtcgcggcaggttgacggcaggtgcttggtgtcaatcttcttaccgttggcggcggcggcggcggtaacgtcgtcgttggcggctttggcgttgtcgcgctcaaccggctgtccgcagaaccattttaccgaaccggcttgacgcttggcccacagggagagttttctgcctttgatttctttgtttacgccgcttgaagccattatgtcagacggtattgcccgggcagctttattcgtacactttcagcagctcgacttcaaatatcaaagtggcgtgcgggggaatcacgccgcccgcgccgtgtgcgccgtagcccatttccgaagggatggtcagcttgcgtttgccgccttccttcatgccgccgaagccttcgtcccagcctttgatgacttgtccgacaccgagcgtgatggtcagcggctggcggcggtcgaggctggagtcgaatttggttccgttttccagccaacctgtgtaatgcacggtaatctctttgcctttaactgcttcttttccgaagccttcttgcaagtcttcaataatcaggccgcccatatttgtcctttcgttgcttgttggtcaaaacggcaagggtaacataccgtccgtcgaagtcaaatgccgctcaaacgtcagctgcatcggtgcagctgaaacggctgtgtttgtttgactgttttatttttttcgtaaaggttccatgctttttcatggaaatagaaaacgacggtgttgattaggggttcgaccagcgcaactgctcccgatacgcctatactgcccgtcagtacataggttacactgaaggcgacgctgaaatgcagtgcggcaaaagtcagggttttaagcatcatcctctcccggattggacattgacggagagatgataaagattatcataaggctgcgcggtttaaatttgctatttgttgttagtgtagataaatcgttttttaaataaggataggaattatgaatcataaaaagatcgttgttttggatgcggatactttgcccggccgggtttttcattttgattttccgcacgagcttgcggtttacggtacgacaggtgcggatgaaacggcagaacgggtgcgcgatgcacatattgtcattactaacaaagtgatgatttctgccgatattattgcggctaatccgcagttggagctgattgccgtcagtgcgaccggcgtgaacaatgtcgatattggggcggcgaaggcggccggtgttgcggtatgcaatgtccgcgcatacggaaacgaatcggttgcggaacacgcctttatgctgatgattgcgttaatgcggaatttgcctgcctatcagcgtgatgttgcggcaggattgtgggaaaagtcgccgtttttctgccattacggcgcgccgattcgggatttgaacggcaaaacgctggcggttttcggacgcggcaatatcggacggacgcttgccggatacgcgcaggcattcggtatgggggtggtgtttgccgaacacaaacacgcgtccgctgtgcgtgaaggctatgtttcctttgaagatgcggtacgggctgctgatgtgttgtcgctgcactgtccgctaaacgcccaaactgaaaatatgataggcgaaaacgaattgcggcagatgaagcctggcgcggttttaatcaattgtgggcgcggcgggctggtggatgaaaacgcgctgcttgccgcactcaaatacgggcagatcggtggggcaggtgtcgatgttttgacgaatgagccgcccaaaaacggcaatcccttgctgaatgcacgattacccaatctgattgttacgccgcataccgcgtgggcaagtcgtgaggctttggacaggctgtttgatatattgttggcgaacattcacgcctttgtgaaaggagaggcgcaaaaccgcgtggtttgaacctgtcgggattgcggaaaaaaatgccgtctgaacgcctcaagggttcagacggcatttcttgagattcccgtttaaccgactttgtcgcccggctgcgcgcctgtatccacatccaagagcttcagtttcccgtctgccgtggcggcactcaaaatcatgccttcagatacaccgaattttgccattttgcgcggggcgaagttggcgacggcgatgaccatgcggccgttcaattcggcagggttcgggtaagacgcggcgatgccggagaagatgatgcgtttttcaaaaccgaaatcgaggtcgaatttcaaaagtttggtgctgccttcgacagcttcgcagttcaatactttggcaacgcgcatgtcgattttcataaagtcgtcgaaactcgcctgttcggcgactttttcgtatttgccctcttcggcggcaggtgcggctgcggcggcgatgctttgtttgttggcttcgattaaatcgtccacttgtttttgctccactcgttgcattaaatgttcgtatttgttgatggcgtgtttgcccaaggtatcgcgtgtatttgcccaagtgatggcttccaaattcaggaatttggcggcgtttgcggcggtttgcggcaagacgggggcgaggtaggcggtcaacatggtgaaggcgttgatgagttcgctgcatacttcgtgcaggcgttcgtcttggccttcttgtttggcgagttcccacggcttgttggcatcaacgtattcgttgacaatgtctgccaaggccatgatgtcgcgcagggctttggcgtattcgcggctttcgtagcattcggcaatggcttcgctttgcgcagtcagttttgccagcaattcgctgtcggcaacatctttcagacggccttcaaagcgtttggcgatgaaacctgaggcgcgggcggcgatgttgacgtatttgccgacgaggtcgctgtttacgcggctgataaagtcttgcaggttcaaatcgatgtcttcgattttgctgttgagtttggcggcgatgtagtagcgcatccactcggggttcaggccttgttccagataggatttggcggtaataaacgtgccgcgcgatttggacattttttgtccgtcgacggtcaaaaagccgtgtgcgtacacgccggtcggggcgcggtggccggagaaatgcagcatagcgggccagaacagggcgtggaaatagagaatatctttgccgatgaagtggtacatctcggtttggctgtcggctttgaagtattcgtcaaaatcgacgccgatgcggtcgcacaggtttttaaacgacgccatgtagccgacgggcgcgtccagccagacgtagaagtatttgcccggcgcgtcggggatttcaaaaccgaaatacggcgcgtcgcgggaaatatcccagtcggacagggtggtttcttcaccttcgcccagccattctttcattttgttgagggcttcggcttgcagatggggcttgccgtcgtgcgggttgttgccggaagtccatgctttgaggaagtcggcgcattcgcccagtttgaagaagaagtgttcggattcgcgcaattcgggtttcgtaccggaaacggcggaatacgggttaatcagttcggtcggggaataggtcgtgccgcagacttcgcagttgtcgccgtattggtcttgggcgtggcatttcgggcattcgcctttgacgaagcggtcgggcaggaacatttgtttttcggggtcgaaaagctgctcgatgacgcggctctcaatcttgccgttggctttcagcgcgcggtaaatgtcttgggaaaactgtttgttttcaggggaatgggtgctgtaataattgtcgtaaccgatgaaaaagccagtaaagtcggcgaggtgctcttcgcgcactttggcaatcatgtcttcgggcgcgataccttgtttttgcgcggcaagcattacgggcgtgccgtgggtgtcgtcggcgcagcagtagtggcacgcgtggccgcgcagtttttgaaagcgcacccaaacgtcggtttggatgtgttcgaccatgtggccgaggtggatgctgccgttggcatagggcagggcggaggtaactaagattttgcgtgtcatattgtgctttgcaaacaatgggtaaaggcggattataccgcaaatcaaacggggaaatgccgtctgaagcctgaaaaatcgggcttcagacggcatttttgccaaccggcgggagttattcgacggttacggatttcgccaggttgcgcggcttgtccacatcggtaccgcgtgcgagggcggtgtggtaggcgaggagctgcacggggatagtatgcacgacgggggacagtttgccgacgtggcgcggtgcgcggataacgtgcacaccttcggtggcattaaaattgctgtcgaggtcggcaaagacgaaaagttcgccgccgcgcgcgccgacttcctgcatattggctttgactttgtccaacaggctgtcgttgggtgcgatgacgacgacgggcatattttcgtccaccagggcaagcggcccgtgcttcagttcgccggcaggataggcttcggcgtggatgtaggtgatttccttcagcttcaacgcaccttcgagggcaatcgggtaatggatgccgcgccctaaaaacagcgcgctggttttcttggcaaactgttgcgcccatgcggcaatttgaggttcgaggttcagagcgtgctgcacgctgccgggaagctggcggagttcttcggtgtaacgcgcttcgtcttcttcggaaaccaaaccgcgcactttcgccagcgttaccgccaaaccgaacagcgcaaccagttgcgtggtaaacgctttggtcgaggcgacgccgatttccgcaccggcacgggtataaagcacgaggctgctttcgcgcggcagggcggattccatcacgttgcaaatggagaggctgtggcggtgtcccaaggatttggcgtatttcaacgcctccatcgtgtccagcgtttcgccggattgggaaatggtaatgaccagttggtcggaatcagcaatcacgctgcggtatcggtattcgctggcgatttcgacgtcggacgggatttttgcgatggattccaaccaatatttggcggtcagcgcggcgtaataggacgtgccgcaggcaaggattttgacgctgcggatgctttcaaacacgcttttggcatctttgccgaagttttcggggatgaagccgccgtcgaggaaaacctccgccgtgtctgcaatcgcgcggggctgctcgtggatttctttttgcataaagtggctgtacagtcccagttccaaagaggcgagcgagagttcggataccttgactttgcgttcggcaggcaggccgtttttatcggtcagccttttgatgccgtctgaagccagcagcgcgatgtcgccgtcttcgaggtacgccacgcggcgcgtaaaggcgatgacggcggatacgtccgaagcgataaaggtttcatcgtcgcccaaagcgaccaaaagcgggcagcccatacgcgccacaactaattcatcaggcttgtcttgggcaataaccgcgatggcgtatgcgccgtggaaacgtttgaccgcttcttgtaccgcttcaaacagcctgccgccgttttgcgcgtattcgtgattgatgctgtgtgcgatgacttcggtatccgtttgcgattcaaaacggtatcccaaaccttccaaacgtttgcgttcgctttcaaagttttcgatgatgccgttgtgtacgaccgcaatcataccgccgctgatgtgcgggtgggcgttcggctcagtaacgccgccgtgtgtcgcccaacgcgtatgtccgatgccgatgccgccgctgatgcctttttcgcgtgccgcgtcctccataagctgcacgcgtccgacgcggcgcacacgtttgattttgccgtcggtgttgacggcaatgcctgatgagtcataaccccggtattcgaggcgtttgagaccgtcggtcagaaaatcgacgacgttgtgatgggcgcggatggcgccgacgataccgcacataactgttccttagtatccggttgaaaaaaaacaggcgcggacggcttccgtgccgcaccttcctcttcggattataaaccgcctcccgcgccggaaaacagcaaaatgccgtctgaaggcttgggcttgctcaaaaaaaggagggatttccctgtttatccaggatgggcgttcagacggcattacctgctgctggtttatagtttttgcaaatcaacattgacaagctgaaaaaaaaaaacaatatactcgctcggtcttaatgttaacggagtatggaaatgaaacaaatgcttttagccgtcggcgtggtggcggtgttggcgggctgcggcaaggatgccggcggttacgagggttattggcgcgaaaagtcggacaaaaaagagggtatgattgccgtcaaaaaagaaaaaggcaattacttccttaataaaatccacgtggttacaggcaaggaagagtccttgcttttgtctgaaaaagacggcgcgctttcgataaacacagggataggggaaatcccgatcaaactttccgacgacgggaaagagctgtatgtcgaacgtaggcagtatgtcaaaaccgatgcggcgatgaaggacaaaatcatcgcccatcagaaaaagtgcggacaaacagcacaggcataccgcgacgcgcgaaatgcgttgccgtcaaaccagacgtatcagcagcatctggcggcgatcgagcaattgaaacggcggtttgaagccgagtttgacgaattggaaaaagaaatcaaatgcaacggcagaagcccggcattgttgctttagtaggggacaaccgggaggatgccgccgtccgaatcggatgtgcggtttctgtaccggtacgggcgggcaggaatgtccgccttttttgttcggatgcgtttgaatacccgtttgattccgaccgtttgcaaggggtatttccgttcgggcggaaattatagtggattaacaaaaaccagtacggcgttgcctcgccttagctcaaagagaacgattctctaaggtgctcaagcaccaagtgaatcggttccgtactatttgtactgtctgcggcttcgtcgccttgtcctgatttaaatttgatccactataattccgtcaaataagaaaggaattttgtgcctgcggtatcgcaaaacttcgccttaatgcgcccgattgcctagggatgggcttcagatggcattgttttccggtttacgggcggtattcgggcttcataccgttgggtaggagctgccagacatatcccgtggttttctgtttgccggcaagttcgccggcttcgtcgccgtatccccaaaaataatccacgcgcaccgcgcctttaatcgcgctgccggtatcctgcgccataatcaggcggttgagggctttgcgggtaaccggatgggcggtggcgacaaataagggcgcacccaaggtaatgtagtgccggtcgactgcgccggcatattcccccatcagcggcgtgcccagtgcgccgacagggccgtcattgctgcttccggcaagctcgcggaaaaagatatagctggggttttgacccaaaacttcggcgaggcgttgcggattttgccgcatataagacttaatgccctgcatggaggtttgtccgagtttgaggtagcccttatccgccatatagcgtccgatggaaacgtagggatgttcgtttttgtcggcatagccgatgcggatgtatttgccggacggggttttcagacggcccgagccttggatgtgcataaaaaaaagttcgacagggtcttcggcgtaaccgagtatcggggctttgccgtcaagcgcgccgccgttgatttggttgcgcgtgtggtaggggaggaagcggcttccttcaaacctgcctttgattgctgttgtgcgcgcggtgatggggaatcgggagaggtcggcggtatgtgtgccgccggtattgtcgattgtgccgctgttttttcccgtctgcctgatgcggacaagggcttttccgctccgcaaaccggcaggcagggggacggagataaaatcgtcgggaataccgtaaatcgggaagcgggcttgtgccgtccgcctgtcgtcgcccttcagcaccggttcgtaatagccggtaaccgtaccggcaaggcttccgttgcctgcaacctgccacggcgtgaaatagcgttcaaaaaactgttttgcctgaaaggaatggacgggggtttgaaaggcttgggcgcacacatcctgccagccttggcggtttttcaaattggcgcagccgaggcggaaggattgcaggcttttggcgaaatcctgcgccgcccagtggggcagggacaggtgcggtacaacggtatagacggccccgccgccgccgaccgtcgttccggcggggtcggggatgccgaccggccggtccgggccgttgatgacggatgtgtcgggttgcggaaaggtttggatgctcttgctttggcaggcggcgaggatggcggcggcgatgccgtacagggcggcgcggaataggtattttttcataatggacaatgttgccggcagtaataagaaagatggtttcgggcggcgttgcggcagccgtggagaggggattttaacacagggcgcagctgcagcctgcggaactttccgccgcgcggtactgcagataaaaataacttgcatttgtatttacaagcaatgaaaatattccgataatatattattcatcatccttgttcgttcgcgtttatgctggtcgcttttttaattatgttgcgcgagggtattgaagccgcgctcattgtcggcatcgttgccggttttctgaaacagtccggacattccaaactgatgcctaaggtctggttcggggtcgtccttgcttctttgatgtgtttggggctggggtacggcatccattcggcaacgggcgagattccccagaagcagcaggagttcgtcgtcggcattatcggtttggttgccgttgccatgctgacttatatgattttatggatgaaaaaggcggcgcgttcgatgaagcggcagcttcaggattctgtgcaggcggctttgaaccgtggcagcggtcaaggatgggccttggtcggtatggcgtttcttgccgtggcgcgcgaaggtctggagagtgtttttttcctgcttgccgtattcaaacagagcccgacgtggcagatgccggccggcgcggtagcgggggttttggctgccgccgtgattggcgcgttgatttatcagggcgggatgcgcctgaatctggcgaagtttttccgttggacgggggcgtttctgattgtcgttgccgccggcctgcttgccggctcgctgcgcgcgctgcatgaggcaggtatttggaacgcgcttcaggacattgtgttcgactcatcaaaatatttgcacgaagacagtccgttgggcgtgctgctcggcggatttttcggctataccgaccatccgacgcagggcgagaccttggtttggctgctgtaccttattcccgtcataacttggtttttgtgcggcagcaggccgtctgaaactttaacccgtaaagaggagctgaaatgagaaaattcaatttgaccgcattgtccgtgatgcttgccttaggtttgaccgcgtgccagccgccggaggcggagaaagctgcgccggcagcgtccggtgaggcgcaaaccgccaacgagggcggttcggtcagtatcgccgtcaacgacaatgcctgcgaaccgatggaactgaccgtgccgagcggacaggttgtgttcaatattaaaaacaacagcggccgcaagctcgaatgggaaatcctgaaaggcgtgatggtggtggacgagcgcgaaaacatcgcccccggactttccgataaaatgaccgtcaccctgttgccgggcgaatacgaaatgacttgcggtcttttgaccaatccgcgcggcaagctggtggtaaccgacagcggctttaaagacaccgccaacgaagcggatttggaaaaactgtcccaaccgctcgccgactataaagcctacgttcaaggcgaggttaaagagctggtggcgaaaaccaaaacttttaccgaagccgtcaaagcaggcgacattgaaaaggcgaaatccctgtttgccgacacccgcgtccattacgaacgcatcgaaccgattgccgagcttttcagcgaactcgaccccgtcatcgatgcgcgtgaagacgacttcaaagacggcgcgaaagatgccggatttaccggctttcaccgtatcgaatacgccctttgggtggaaaaagacgtgtccggcgtgaaggaaattgcagcgaaactgatgaccgatgtcgaagccctgcaaaaagaaatcgacgcattggcgtttcctccgggcaaggtggtcggcggcgcgtccgaactgattgaagaagtggcgggcagtaaaatcagcggcgaagaagaccggtacagccacaccgatttgagcgacttccaagccaatgtggacggatctaaaaaaatcgtcgatttgttccgtccgctgatcgaggccaaaaacaaagccttgttggaaaaaaccgataccaacttcaaacaggtcaacgaaattctggcgaaataccggactaaagacggttttgaaacctacgacaagctgggcgaagccgaccgcaaagcgttacaggcctctattaacgcgcttgccgaagaccttgcccaacttcgcggcatactcggcttgaaataagccgcaagcgttcagacggtatttggcggcagataccgtctgaagttttatagtggattaacaaaaaccagtacggcattgcctcgccttgccttgccgtactatttatactgtctgcggcttcgtcgccttgtcctgatttttgttaatccactatatccgccatatattgcagggcgggatttcaacctgccgctatcggttaatggaaaaacggcgtgcagggatacccatcctgctgcacggatattgaaggaaacaccatgagcaaaaaacaacccgcacaaccgaccaggcgcactctttttaaaaccgcgatcgcagccggagcagtcggcgcaatcggaggttatctcggcggcaaaaaacagggcgaaaccgccgaacgcaccgccgaaagccaacactcgccccaagcctatccctgctacggcgaacatcaggcaggcatcgttacgccgcagcaggcgttttcgattatgtgcgccttcgacgtaaccgcgcaaagtgccaagcagctggaaaacctgttccgcacgctgaccgcccgcatcgagtttctcacccaaggcggcgaataccaagacggcgacgacaaacttccgccagccggcagcggcattttgggcaaagccttcaaccccgacgggttgaccgttaccgtgggggtgggcagcagcctgtttgacggccggttcggactcaaagacaaaaaaccgattcatttgcaggaaatgcgcgacttctccaacgataagctgcaaaaaagctggtgcgacggcgatttgagcctgcaaatctgtgccttcacccccgaaacctgccaagccgccctgcgcgacatcatcaaacacaccgtccaaaccgccgttatccgttggagtatcgacgggtggcagcccaaatccgaacccggcgcgatggcggcgcgcaacctgttgggcttcagggacggcacgggcaaccccaaagtttccgatcccaaaactgccgacgaggttttgtggacgggggtggccgccaacagcctcgacgaaccggagtgggcgaaaaacggcagctatcaggcagtccgccttatccgccactttgtcgagttttgggacaggacgccgcttcaagagcaaaccgacattttcgggcggcgcaaatacagcggtgcgccgatggacggcaaaaaagaagccgaccaaccggattttgccaaagaccccgagggtgatatcacgcccaaagacagccatatacgcctggcgaatccgcgcgatcccgaattcctcaaaaaacaccgcctcttccgccgcgcctacagctattcgcgcggactcgcctcaagcggacagcttgatgtcgggctggtgttcgtctgctatcaggcaaaccttgccgacggattcatcttcgtgcaaaacctcctcaacggcgaaccgctggaagaatacatcagccccttcggcggcggctatttcttcgtcttgcccggcgtggaaaaaggcggctttttggggcaagggctgctgggcgtataaatccgccatataaaaaacgccgtccgaaccttgccaaacgggttcggacggcgtttcttgtttttgggcggtcaggcttttttgacgaattcggattttaaattcatcgcgctgccgtcgattttgcagccgatgttgtgatcgccttcttgcaggcgtatgcctttgacttttgtgccttgtttgatcaccatcgagctgccttttaccttgaggtctttgatgaggatgacggtatcgccgttttgcagcactgcgccgttggcatcgcgcacttgagccgcaaggtcggcggcggattcggtttcattccattcatgggcgcattcggggcagatgtattgtccgccgtcttcataggtgtattcggaggcgcattgcgggcatgggggtaatgacatggtttgccgtccttatcggatgtttgttttggggtgccgtctgaaacctgaaaccggcttcagacggcatagctttattgtttgtctttttcaggacgcacccagccttcgatgacggtttggcgggcgcgggcgagggcgagtttgttgtcttcgacattgcgggtaatcgtgctgcccgcgcctgtggttactttgttgccgagggtaacgggggcgactaggacgcagtttgaaccgatgcgcacttcgtcgccgatgacggttttgtgtttgtgcacgccgtcgtagttggcaataatcgtaccggcgccgaagttggttttgcagccgacttcggcgtcgccgatgtaggtgaggtggttggctttggtgcctttgccgatggcggcgtttttgatttcgacgaagttgccgacgtgtacgtcgtctgcaaggcgggcttgcggacgcaggcgggcgtacgggccgattcggttgttttcgccgacttcgcagctttcgaggtgggagaagggggcgattttgctgtttgcgccgattttggcgtttttgatgacgcagtttgcgccgatttcgacgttgtcgccgagctcgatgtcgccttcaaagatacagttcacatcaatcacgacgtcttgcccgtgtttcagacggcctcgtaaatcgaaacgtgccggatcgcgcagggttacgcctgctttgagcaattcttgcgcctgttcggtttggaagatgcgttcgagttcggtgagctggagtttgttgttcacgccggcggcgaggtgggaggcgcgcacttggacgggatgaactttaataccgtcggcaacggctttggcgatgaggtcggtcaggtagtattcgccttgtgcattgttgctggaaaggctgttcagccagttttcgagtttggcgttgggcaggacgaggatgccggtattgatttctttcacggctttttggacggcgtcggcgtctttttcttcgacgatggcggttacgctgccgttgctgtcgcggatgatacgccccaagcctgtcgggtcgttgggaacgtcggtcaacagcccgacttcgttgcctgcggcttcgagcagggtttcgagggtttcaacgtcaattaaaggaacgtcgccgtacaacaccagcgtgcggccttcggcggaaaggtggggcagggcggttttgacggcgtggccggtaccgagctgttcggtttgttcaacccaaacgacatcgcgtttgacggtgtccaagacttgctctttgccgtggccgatgacgacgcagatgttttgcggattcagtgcggctgcggtgtcgataacgcgcccgaccatgggcttgccgccgatgcggtgcagcacttttggcattttggaatacatgcgcgtgcctttgccggcggcgaggatgacgatgtttaaagtgttttgcggcatgacggtttcctgtgcaatgccgtctgaagcggcttcagacggcatagggtaggtttatcggttttgaaactttggtttttgccagtgttggcgatgctcttcgtcggcgttgttgccggtttgattgggtaacacggcatggcgttcgggacggtattggttgtagttcatatttttcgagtagctgccgtcttggtaataaacgggcgtgccggcgggatatttttgacggacggcggtcttgccgttgccgtcttgataagtttcccacgcgcagcccgacaaaagggcggcggcagcggtcaggaagaggaaggttttacgcatggcttttctttcgtattttcggggggtagggggtattgtaatgattttggcggtgttctgacaaagtttctgcataccgagccagttgcgccatatcgcttacggaggcatcgataaagggcagcgcgtgggattttgcaccgaaccggacggttttcatacccagcgcctttgcctgatgcaggttgtccgcgctgtcgtccaccataatgcagcattcgggcggtacgtccaacaggcggcagacattgagatacgcttgcggattgggtttgtacagcagcccgaaatcatccgtgccgaaaagcgcgtcgaaacggttttccaaaccgagtgcgttgacaacggcacggacgtaaaacgacgggccgttggaaaaaaccgccttgcgcccttttaggcggctcagggtgttttgtgtttcaggcatgccgtgcagcctggtcaggattgcatcgatcggatggctttcgcgcaaaaattcggcgatgtcgatttcgggatggtggatttgcagtccggcgagcgttgcgccgtagcggtgccaatagtcttgacgcaggtcggacgcggcagattcggagagtttgaggcggcgtgccatatagcgtgtcatagcgcggttgatgagtgtgaagatgcctgcgtcggcatcgtgcagcgtgttgtcgaggtcgaacagccacacggtcgggttttcttgcatgttgaaccgtgaaaatttgttagaatgttattttacagcgaatagaggaggactcggaatgaaacggaaaatttggctgctgccgctgctggcggtttcggcatacctgcaggcgcagacggaagtcaggctggcggtgcataagtcgttcagcctgcccaaagggttgattgcgcgcttcgagcgggcaaacgatgcgaaggtgtcgattattcaggcgggcggcgcgaacgaaatgctcaacaaactgattttgagccgcgccaacccgattgccgacgcggtgtatggtttggacaacgccaatatcggcaaggcgcgggaaatgggcattttggcggcggcgcaacccgaatccgcccccgtcgcggtcgggctgccttcggctttggcggtcgattacggctatgtgtccatcaattacgacaaaaaatggtttgaaggcaaaaagctgcccctgccgcaaaccctgcaggatttgacccgccccgaatataaaaacctattggtcgtgccgtcccccgccacgtcgtccccggggctgggcttcctgatggcgaacatcagcggtctgggcgaagaaagcgcgttcaaatggtgggcacagatgcggcagaacggcgtgaaggtcgccaaaggctggagcgaggcgtattacaccgacttttcgcacaacggcggcgcgtatccgctggtggtcggttatgccgccagcccggcggcggaagtgtatttttccaaaggcaaatacagcgagccgccgacgggcaacctgtttttaaaaggcggcgtattccgccaggtcgaaggcgcggcggtcttgaagggcgcgaaacagccggaattggcggcaaaactggtgcaatggctgcaaagtcgggaagtgcagcaggcggttccgtccgaaatgtgggtttaccccgccgtcaaaaacacgcgcctgcccgacgtgttccgcttcgcccaagccccgacgcacaccaccgcccccgcgcagcgcgatattgatgcgaaccagcgcggatgggtttcccgttggattagaacggttttgaaataaaacaaacatacctccccgcagggcttcatacggcatttttacacctgtgccgattacgccgcacggggcggatgttcgatcaagaggaaaacaatggacttcaaacaatttgattttttacacctgatcagtgtttccggttgggagcatctggctgaaaaggcgtgggcgttcgggctgaaccttgccgccgcgctgcttatttttttggtcggaaaatgggcggcgaaacgcattgtcgctgtgatgagggcggcgatgacgcgcgcgcaggtcgatgccacgctgattagttttttgtgtaatgttgccaatatcggcttattgattttggtgattattgccgcattgggcagattgggcgtttccacaacatccgtaaccgccttaatcggcggcgcgggtttggcggtggcgttgtccctgaaagaccagctgtccaattttgccgccggcgcactgattatcctgttccgcccgttcaaagtcggcgattttatccgcgtcggcggttttgaaggatatgtccgagagattaaaatggtgcagacttctttgcggacgaccgacaacgaagaagtcgtgctgcccaacagcgtggtgatgggcaacagcatcgtcaaccgttccacactgccgctgtgccgcgcccaagtgatagtcggcgtcgattacaactgcgatttgaaagtggcgaaagaggcggtgttgaaagccgccgtcgaacaccccttgagcgttcaaaacgaagagcggcaggctgccgcctacatcaccgccttgggcgacaatgccatcgaaatcacattatgggcttgggcaaacgaagcagaccgctggacgctgcaatgcgacttgaacgaacaagtggtcgaaaacctccgcaaagtcaatatcaacatcccgttcccgcaacgcgacatacacatcatcaattcttaaacgccgtctgaaagaggagtgggaaatggacgcgctgcacaccatcgcccgaaacctgacgaaaaaacgtcaaaccgtaagctgtgccgaatcctgtacgggcggaatgcttgccgccgcattcacaagcgttgcaggcagttcgcaatggttcgaccagagttttgtaacatacagcaacaaagccaaagaagaccgcttgggcgtgttgcccgaaaccctgctcgaacacggcgcggtcagccgccaaaccgtctatgagatggcgcgcggcgcgaaagccgtggcgcaggcggattacgccgtcggtatttccggcatcgccggtccgggcggcggcagcgaaagcaaacccgtcggcacggtttggttcgggtttgcctttccgggcggaagttgcgaagcaatgcgccgttttgacggcaaccgcgaatccgtccgcgcgcaggcggtcgccttcgcgttggaacggttggcggggctgattgaaaacggcggcgatgctgtctaaacaaaatctccgtctgaacaaaatccccatcggataaaaaatgccgtctgaaacgtttcgggtttcagacggcattttgtcggggtaggcggcggtgcggcttatttcactttacctttcaacgcgccatagcctgccgcgtccatttgttccagcgggatgaatttcaagctcgcgccgttgatgcagtagcgcagtccgcctttgtcgcgcgggccgtcggggaagacgtgtcccaaatgcgagtcggcggcgtggctgcgcacttcggtgcggcgcatgttgtagctgaaatcatcgtgttcggtaacggattttgcatcaatcgggcgcgtgaagctcggccagccgcagccggaatcatatttgtcggcggagctgaacaaaggttcgccgctgacaacgtccacataaatgccgggtttgaacaaatggtcgtattcgtggctgaaggcatattcggtcgcgctgttttgggtaacttggtattgctcttcggtcagggtgcgtttgagttcggcgtcactcggttttttatacgttgccgcgtcgaagcctttgccttgcggggcggtcttggttttgcccggcagcggttcgtcagctttgcggatgtcgatgtggcagtagccgttggggtttttaatcaagtagtcctgatggtattcctcggcatcgtagaagtttttcagcggctcgttttcaacaacgaggggcagttggtatttttgctgctcgcgtttgagggcggcggcgatgacggctttttcggcggggtcggtgtagtacacgccgctgcggtattgcgtaccggtgtcgttgccctgtttgttgaggctggtcggatcaacgacgcggaagaaatattgcaggatgtcgtctaggctgagtttgtcggcatcgtaggtcactttgacggtttcggcgtggcccgtatggcggtaggacacgtcttcatagctcggatttttcgtgttgccgttggcgtagccggataccgcgtcaaccacgccgtcgatgcgttggaaataggcttccaagccccagaagcagccgccggcgaggtaaatggtgcgcgtgttcatgatttttgaatcctttttctgagtgtcgggtttgtagaacgaatgtttcaagctgcccaaatcggcattcgggtcgcggattaacgccaacgcctgcgcttcgttgatgctgcctttgacgatgcgctgcacgtcgctgtctttaccgattaacgcccacgaggggtaaacgctgatattcaggctttgggcgatcgtgccgccgttgtcggttacgacgggcagcttgggataattcaaaccggcataccatttttggaagtcgccgtcttttttctcgtgcaaaaagcccggggaggcgacggtaatcaggttggcggagctgaattttgcatcttgcgcccatttttcggtctgtcccaattcggacagacacaaaggacaccagctcgcccaaaatttaatcagcgtcggtttgtcttttttcaagtaaacactggcggggcggttgtccgcagttttcaaagtggataaagtgtgcggcacggtcgcggctccggcatcgacgattttgggcgaacaagcacccagcgcaagcaggcagccgaacttggcgcaaagggaaaagaaagtacggtgtttcattttgatgtttcctgtgtggacggtttgcatgattagacgtttgagatgccgaaaccttacagcccggattttcagacaaccttaccgcgtaaaatacgctacaatacgccctgtttcaagtttctaaaattaaaaggaaaattcaatgttcagcttcttccgtcgcaagaaaaaacaggaaacgccggctctcgaggaggctcaaattcaggaaaccgcagcaaaagcagaatctgaacttgctcaaatagttgaaaatattaaagaagatgctgaatctttagcagaaagcgtcaaagggcaggtcgaatctgccgttgaaaccgtcagcggtgcggttgaacaggtaaaggaaaccgttgccgagatgctgtctgaagcagaggaagcggcggaaaaagcagcggaacaagtcgaagcggcaaaagaagccgttgccgaaaccgtcggcgaggctgtcgggcaagttcaagaagccgttgcgacaactgaagaacacaagctcggttgggcggcgcgtttgaaacaaggcctgaccaaatcgcgcgacaaaatggcgaaatcgctggcgggcgtgttcggcggcggacaaatcgacgaagatttatacgaagagctggaaaccgtgctgattaccagcgatatgggcatggaagccaccgaatacctgatgaaagacgtgcgcgaccgcgtcagcctcaaagggctgaaagacggcaacgaattgcgcggcgcgttgaaagaagccttgtacgacctgattaagcctctggagaaacctttggttttgcccgaaaccaaagagccgtttgtcatcatgcttgccggcatcaacggcgcgggcaaaaccacgtctatcggtaaactcgccaaatatttccaagcgcagggcaaatccgtattgctggcggcaggcgatactttccgtgccgccgcgcgtgagcagcttcaagcttggggcgagcgcaacaacgtaaccgtgatttcgcaaaccacgggcgattccgccgccgtgtgcttcgatgccgtccaagccgccaaagcgcgcggcatcgacattgtgctggccgacaccgccggccgcctgcccacgcagcttcatttgatggaagaaatcaaaaaagtgaaacgcgtgctgcaaaaagccatgcccgacgcgccgcacgaaatcatcgtcgtgcttgatgccaatatcgggcaaaacgccgtcaaccaagtcaaagcctttgacgacgcattggggctgaccggtttaatcgttaccaaactcgacggcacggcaaaaggcggcatcctcgccgcgcttgcctccgaccgccccgttcccgtccgctatatcggcgtgggcgaaggcatagacgacctgcgcccgtttgacgcgcgcgcgtttgtggacgcactgctggattgagccgaaatgccgtccgaaaacagcagaccgatgccgtcattcccgcgcaggcgggaatccagaccttgggataacggcaatattcaaaggttatctgaaagtccgagattctggattcccactttcgtgggaatgacgggatgtaggttcgtgggaatgacgtggtgcaggtttccgtatggatggattcgtcattcccgcgcaggcgggaatctagaacgtaaaatctaaagaaaccgtgttgtaacggcagaccgatgccgtcattcccgcgcaggcgggaatctagaccattggacagcggcaatattcaaagattatctgaaagtccgagattctggattcccactttcgtgggaatgacgggatttgagattgcggcatttatcggaaaaaacagaaaccgctccgccgtcattcccgcgcaggcgggaatctaggtttgtcggtgcggaaacttatcgggtaaaacggtttctttagattttgcgttctagattcccactttcgcgggaatgacgaagagttgcgggaatgatggaaagctatgggaataacgaagggttaaagtaatcacgggatggtgttcgcgggaatataaattgaaataattcaaaagggtattatatgcagcctgcggtttatattttagcaagccaacgtaatggcacgttatacattggcgttacatctgatttggtgcaacgtatttaccaacatagggagcatttgattgagggatttacatcacggtacaacgttactatgctggtttggtatgaactgcatcctacgatggagagtgcaattactcgggaaaaacagttgaagaaatggaacagggcttggaaattgcaactgattgaagaaaataatgtttcttggcaggatttatggtttgatattatttagcccgtcattcccgcgcaggcgggaatccggcttgttcggtttcggttttttttttgaggtttcgggcaacttctaaaccgtcattcccgcgtaggcgggaatctagaccttgggataacggcaatattcaaagtttataaaagacccgttattcccgcgcaggcgggaatctagaccttagaacaacagtaatattcaaaggttagctgaagctttagagattctagattcccactttcgtgggaatgacgggatgtaggttcgcgggaatgacgggatttgagattgcggcatttatcggaaaaaacagaaaccgttctgccgtcattcccgcgcaggcgggaatccggcttgttcggtttcggtttttttgaggtttcgggcaacttctaaaccgtcattcccgcgcaggcgggaatctagaccattggacagcggcaatattcaaagattatctgaaagtccgagattctagattcccactttcgtgggaatgacgggatgtaggttcgtgggaatgacgggatttgagattgcggcatttatcggaaaaaacagaaaccgctctgccgtcattcccgcgcaggcgggaatccggcttgttcggtttcggttttttttttttttgaggtttcgggcaacttctaaaccgtcattcccgcgcaggcgggaatccagaccattggacagcagcaatattcaaagattatctgaaagtccgggattctagattcccactttcgtgggaatgacgggatgtaggttcgtgggaatgacgggatttgagattgcggcatttatcggaaaaacagcaaccgctccgccgtcattcccgcgcaggcgggaatctagaccttgggataacagcaatattcaaaggttagctgaagctttagagattctggattcccactttcgtgggaatgacggaatgtaggttcgtgggaatgacgggatttgagattgcggcatttatcggaaaaacagcaaccgctccgccgtcattcccgcgcaggcgggaatctagaccttgggataacagcaatattcaaaggttagctgaagctttagagattctggattcccactttcgtgggaatgacggaatgtaggttcgtgggaatgacgggattagagtttcaaaatttattctaaatagctgaaactcaacgcactggattcccgcctgcgcgggaatgacgaattttaggtttctgattttggttttctgtttttgagggaatgacgggatttgagattgcggcatttatcgggagcaacagaaaccgctccgccgtcattcccgcgcaggcgggaatctagaccttagaacaacagcaatattcaaaggttagctgaagctttagagattctagattcccactttcgtgggaatgacggaatgtaggttcgtgggaatgacgcggtgcaggtttccgtatggatgggttcgtcattcccgcgcaggcgggaatccggcttgttcggtttcggttttttttttttgaggtttcgggcaacttctaaaccgtcattcccgcgcaggcgggaatctagaccttagaacaacagcaatattcaaagattataaaagacctgtcattcccgcgcaggcgggaatctaggtctgtcggcacggaaacttatcgggtaaacggtttcttgagattccgcgtcctggattcccactttcgtgggaatgacgggatgtaggttcgtgggaatgacgcggtgcaggtttccgtatggatgggttcgtcattcccgcgcaggcgggaatctagaccttagaataacagcaatattcaaagattatctgaaagtccgagattctggattcccactttcgtgggaatgacggaatgtaggttcgcgggaatgacgcggtgcaggtttccgtgaggatggattcgtcattcccgcgcaggcgggaatctagaccttagaacaacagcaatattcaaagattataaaagacctgtcattcccgcgcaggcgggaatccagaccttagaacaacagcaatattcaaaggttagctgaagctttagagattctggattcccactttcgtgggaatgacgggatgtaggttcgtgggaatgacgcggtgcaggtttccgtgcggatggattcgtcattcccgcgcaggcgggaatccagaccttgggataacagcaatattcaaaggttataaaagacccgtcattcccgcgcaggcgggaatctagaccttagaacaacagtaatattcaaaggttagctgaagctttagagattctggattcccactttcgtgggaatgacgggattagagtttcaaaatttattctaaatagctgaaactcaacgcactggattcccgcctgcgcgggaatgacgaattttaggtttctgattttggttttctgtttttgtaggaatgatgaaattttgagttttaggaatttatcggaaaaaacagaaaccgctccgccgtcattcccgcgtaggcgggaatccagaccgttgggcatctgcagcggtttgctaaaaaccgctttactgtgataagtgcgcagggttagaatggcgcggtaaccttatatattgtaccccgtcaaaggggcgcattgcttttcttaacattcccctttggcagccaagtgaaagggcttttcaatcagcaattcggcgggcgcggaatcgggcggtttaccgaaccccggcgttcgcggcgcgccgccccgtcccgtgaaggcaaactcaaggaataaaagatgaataaaacttggaaacggcaggttttccgccataccgcgctttataccgccatattgatgttttcccataccggcgggggggggggcaggcgcaagcgcaaacgcaaacgcaaacgcataaatacgctattgtaatgaacgcgcaaaatctgcccgaggtaaagtggggggatcaatatcagtcattgacgcacaaaagcaatgaacgcgaagttatccatacgagtggttttggtttggcaaaaaagagcattagtttctcattcaataataccgatgaagttgttgctgaaaaaaaagatactgtcgttttcggcgcggcgacctacctgccgccctacggaaaggtttccggttttgataccgctaagctgaccgagcgcaaaaatgcccttgatcagattggtacgaccaaaacggggctggtaggctacagctacgaaggtagcacatgctccagcggaggttgtcctacagttgcctatagaacccaatttaccttcggcaattccagtttggcaaaaaaggcaaacggcggcgggctggatatatacgaagacaaaagccgcgacaattcgcccatttacaaattgaaggatcatccttggttgggcgtgtctttcaatttgggcggagagagctccttcaaaccaaagagacaaggttctttggtatcttcttttagcgaggacgtgacgcagcaaaatggtgcgggcagccaacacaaagacaaaaacctcgtttatacgacagacgattacaagagtcagaataataaaaaccatcaggacaaacaccacgccgtcgccttttatctgaacgccaagctgcacctgctggataaaaaacacattaaaaatatcgtgcaaggtaaaacagttaatttgggtatcttgaaaacacgcatcgagccgacggaagcatggaaaagacggaatagtaacttttttaacggtagttggacgtatgaagagaaaggaacagtcagcgtcaaactcaaattgccggaagtcaaagcaggccgctgcatcaacgcaaataaccccaataagagtaccaaagccccttcccccgcactgactgcccccgcgctgtggttcggacctgtgcaaaatggtaaggtgcagatgtattccgcttcggtttccacctaccccgatagttcgagcagccgcatcttccttcaaaatctgaaaagaaaaaccgaccccaacaaacccggccgccattccctcgcagacttggctaagtcggatattgaaaatcgacagccgaatttcacagggcggcaaaccatcatccgattggatggcggcgtacagcagatcaaactgggtagaaacaatgatgaggtcgccaattttaatggaaatgacggcaaaaacgacactttcggcattgttagtgaagggagcttcatgcctgatgccagcgagtggaaaaaagtattgctgccttggacggttcgtgcttccaatgatgacggtcaatttaacacattcaacaaagaagaaaaagacggcaagccaaaatacagccaaaaataccgcagccgcgacaacggcaagcacgagcgcaatttgggcgacatcgtcaacagccccatcgtggcggtcggcgagtatttggctacttccgccaacgacgggatggtgcatatcttcaaacaaagcggcggggacaagcgcagctacaatctgaagctcagttatatcccgggtacgatgccgcgcaaggatattcaaaacaccgaatccacccttgccaaagagctgcgcgcctttgccgaaaaaagctatgtgggcgaccgctacggcgtggacggcggctttgtcttgcgcaaagtcgaacggaacgggaaagaccatgtgtttatgttcggcgcgatgggctttggcggcagaggcgcgtatgccttggatttaagcaaaatcgacagcggcaacggcaacctggcagacgtttccctgtttgatgtcaaacatgacaagaatggcaataacggcgtgaaattaggctacaccgtcggcacgccgcaaatcggcaaaacccacgacggcaaatacgccgctttcctcgcctccggttatgcgactaaagacattaccagcggcgacaataaaaccgcgctgtatgtgtatgatttggaaagcagcggcacgctgattaaaaaaatcgaagtacccggtggcaagggcgggctttcgtcccccacgctggtggataaagatttggacggcacggtcgatatcgcctatgccggcgatcgcggcggcagtatgtaccgctttgatttgagcaatcaagatcctaatcaatggtctgtacgcgccatttttgaaggcacaaaaccgattacttccgcgcccgctatttcccaactgaaagacaaacgcgtggttatcttcggcacgggcagtgatttgagtgaggatgatgtactcagtacgagcgaacaatatatttacggtatcttcgacgacgatacggtggcgaataacgtaaatgtaaaactcagcggtttgggaggcgggctgctcgagcaagagcttaagcaggaggataaaaccttattcctgaccgattacaagcgatccgacggatcgggcagcaaagggtgggtagtgaaattgaagggcggacagcgcgttaccgtcaaaccgaccgtggtattgcgtaccgcctttgtaaccatccataaatatacgggtacggacaaatgcggcgcggaaaccgccattttgggtatcaataccgccgacggcggcaagctgaccaagaaaagcgcgcgcccgattgtgccggccgagaatcaggctgtcgcgcaatattccggccataagaaaggcatcaacggcaaatccatccctataggttgtatgcaaaaaggcaatgaaatcgtctgcccgaacggatatgtttacgacaaaccggttaatgtgcgttatctggatgaaaagaaaacagacggattttcaacaacggcagacggcgatgcgggcggcagcggtatagaccccgccggcaagcgttccggcaaaaacaaccgctgcttctcccaaaaaggggtgcgcaccctgctgatgaacgatttggacagcttggacattaccggcccgacgtgcggtatgaaacgaatcagctggcgtgaagtcttctactgatttgcacgcgaaaatgccgtccgaaaggttttcggacggcattttttgcgtttttcgggaggggcgggttcgtaaaaggcgggctatagggtaggcttcatctcgccaatctcactgaatccatcaatttccacaattcaattaaataccgtcaaaccgatgccgtcattcccgcgcaggcgggaatctagaccttagaacaacagcaatattcaaaggttagctgaagctttagagattctggattcccactttcgtgggaatgacgggatgcaggtttccgtatgaatggattcgtcattcccgcgcaggcgggaatccagaccttagaacaacagtaatattcaaagattatctgaaagtccgagattctggattcccactttcgtgggaatgacgggattttaggtttctgattttggttttctgtttttgtaggaatgatgaaattttgagttttaggaatttaccggaaaaaacagaaaccgttctgtcgtcattcccgcgcaggcgggaatctagacattcaatgctaaggcaatttatcgggaatgactgaaactcaaaaaactggattcccactttcgtgggaatgacgggatttgagattgcggcatttatcgggagcaacagaaaccgctctgccgtcattcccgcgcaggcgggaatccagaccttagaacaacagtaatattcaaagattatctgaaagtccgagattctggattcccgcctgcgcgggaatgacgaattttaggtttctgattttgtttttctgtttttgtgggaatgatgaaattttgagttttaggaatttatcggaaaaaacagaaaccgctctgccgtcattcccgcgcaggcgggaatctagaccttagaacaacagcaatattcaaagattatctgaaagtctgagattctagattcccactttcgtgggaatgacgggatgtaggttcgtgggaatgacgtggtgcaggttcgtgggaatgacgtggtgcaggttcgtaggaatgacgtggtgcaggtttccgtgcggatggattcgtcattcccgcgcaggcgggaatctagaccttagaacaacagcaatattcaaaggttatctgaaagtccgagattctggattcccactttcgtgggaatggcgcgattagagtttcaaaatttattctaaatagctgaaactcaacgcactggattcccgcctgcgcgggaatgacgaagtggaagttacccgaaacttaaaacaagtgaaaccgaacgaaccggattcccactttcgtgggaatgacgggatgcaggtttccgtacggatggattcgtcattcccgcgcaggcgggaatctagacattcaatgctaaggcaatttatcgggaatgactgaaactcaaaaaactggattcccactttcgtgggaatgacgggattagagtttcaaaatttattctaaatagctgaagctcaacgcactggattcccgcctgcgcgggaatgacgaagtggaagttacccgaaacttaaaacaagcgaaaccgaacgaactggattcccattgtcgtggaaatgacgggattttaggtttctgtttttggttttctgttttcgtgggaatgacgggatgtaggttcgtgggaatgacggttcagttgctacgcatttaccctgcgcaaagctttatccactatcttgtaacctgtctgacaatctgtcctctcttacaaaatgccgaaactttttcaggctgcattttggggctgcctgtgcggaatttggcggtaggcgcggtagtagggttcgagctgtcgggcgatgagttggagctgttggaggaggatgtggctttgtgttccgctgctgtgggtgcggagggtgtcgagttcgccgcgcagtgtatccagtgctgtctgaaagtcgtcgggttcggtttcgggcaggtgttggaagatgtgggcggtgtgttcggcggcgaggtggaactgtgcggtaaagtcggggctgcattcttcgtgcatttcgctgcggtatgcgccgagggcggagatgtagccggtcagggcgtagccggttttgagcagggtaaagccgggttgcaggctgtcggcgaattttgcgggttcgctgctcatgtcggaaagggtgctgctgagggcggcggtgtgttcgtgggcgcggcggcgggtggcgcggtattcgacgtcgtcgccggtttcgccgcttttgaggcgttcggtgattttttcgagataggcaccgttgctgcatacggcaagggcggcggtgcgttcgagcgtgaggtatttccagtctggccacaggtagctgactgccgcccaggcaagggatgcgccgataatggtgtcgatgatgcgtacgggcatggcggcgtatacgtccaaacctgcgagggagaggctggtcagggcttgaatggtaatgaagaaggtggagaaactgtatttgtaggtgcgggtcatgaaaaagagggtggtactggcgatgacaatccagagtttggtttcgacagacggggtgaagtaggggacgagcgagccgacgattacgccgagtacggtgccggcgatgcgctggcggacgcggcttttggtggcggtgtagttgggttggcagacgaaaagggcggtcagtagtatccagtagccgaggttgaggttgagggcttcgacgatggtgcaggcggcggcaacgacgagggacaggcggacggcatggcggaatacgcctgattcgaggtttagctgcggacggattgcctgccaggtgtttttgaggctgctggtttcgagggcggcgatgcgggtgtcgcccatgcggtcgttttctgcctgcaggccgttgtgctggagttggcggaactgctggtcgacgctgccgaggttgtcgagaaggcggcgcaggtggcggatgtcgggactgtcgttgctgtctgaaaggaggcgcagcgattggcggcagccttcgatggcgcggccgaggcgtttgctgtaaacgtagtctttgcttgcgcgcagggcttgggcggtgttgcggcaggcttgtccctgcatttcgagcaggcggtggatgcggaagatgatgtcggtgtttttgaatttttcggacatttcctgataatcgacgtgggcggagctgatgcgttcgtgtatgtcttgggcggcaaagtagtaacgcagcattttggcggtgcgcgggtggcggtgtttgccgcgaaggcggtaaaacagggcggaacggcattggttgaaggcggtgatgacgccggtgttgctcatggcgaggtcgatgtggcggttgcctatccaggctgcctcatcggggtcgaagaagtcggctttggcttcgaggtagccgccgagtgcgtcgtaggcgttggcgacgctttcttggacggggcggtggggcaggacgatttggaacaggaggatggcggtgctgtacagtacggtgccgcataaaatcatgaaggggttggtcagccagtaggtttcgggggtgtaggtaagtgtggtgtaggtggcgacggcgagtgcaccgaaggcgaaggtgcggtatttgagcccgaccgcgcctaaaatggtgaagccgaaggtcatcagggtcatggcgaggatgaagggcagccctgtgccgagggtgctttgtgccgtgagcgaggagagggtgaacagggcgacggtggtgatgatgtttttcagccgtccggtcaggcggttgtccaaatcgacaaggccgccggcgatgatgccgagtacgaagggcatggcgagcttgggttcgcctagctgccagacgatggaggcggcggtaaaaacactggcgaaaacgggaagcgaggtaatgagcagaggcttgaggagtggggttttcatggttttaccggtttattgttatgaagtgaatatagtggattaacaaaaaccagtacggcgttgcctcgccttagctgaaagagaacgattctctaaggtgctcaagcaccaagtgaatcggttccgtactatttgtgctgtctgcggcttcgtcgccttgtcctgatttttgttaatccactataaatttaatccactataaagtgtagcacatgaatggggcggataaaatcatgccgtctgaaaacggggatgcggttttcagacggcattgggttttgcggatcaggaaatgaggttgagaccgttgaccctgtcgtaaaggagttcgggcgttttgccttctttgtgcagttggatgtgcaatcgcaggttgttggcggaaacggactggcgcagggcttcttcgtaactgatgatgccgtgacggtacagttcgaaaaggttttgatccatcgtctgcattccgtcggttttggcggtttccatgattttactgatgttcatcaggtcgcccttcaggatgaagtcttggatggcgggcgtgttgatgagcaagtcgacaaccgccgtcctgcccgttttgtcttgtttgagggcgaggcgttggcagatgatgccggtcaggttgagggcgatgtcgatcagtatttggttgtgctgttctttggggtagaagttgagtatgcgttcgagcgactgcggcgcggtgttggcgtggagcgtaaaaatgcacaggtggccggtttgggcgagctgcatcgcgtattccatactttccctgctgcggacttcgccgatgcagaccacgtcgggggattggcgcatagcgttttgtaccgccgtctgccagtttatggtgtcgacgccgatttcgcgctgggtaaagatgcagcggcgcggtttgtagataaattcaatcgggtcttcgatggtaacgatatggctgggcagggttttgttgcggtgttcgagcatagtcgccatcgtggtggatttgcccgaaccggtaggcccgacgataatcagcagcccgcgcggtgcgacggcgaggtctttgagtttttcgggcaggcccaattcctgcatttgcgggatgacgtggttgatgcgccgcaaaaccaaacctgcgctgccttggctgtggtaggcgttggcgcggtagcgcgtgccgctgcgcgactggacggagtagttgatttcgccgtcgcgccggaatatttccgattgttcggcgttcatcgtcgatgcggcgatggcggcggtttcctcgcccgtcagcgccttttgcggctgcggggttaatgcgctgttgattttcaacgagggcgggaatcctttgctgataaggatgtcggacgcgttttgtgcttctgcggtttcgcacaggcggtcgagcagcgggtggaagtgtgcgccgatttcggccggggtttcggatcggctttgttttttttgagaatacacttgaaccatttcgtccaagatgtcgtgcaggttatcggtattcatcgttagcttcttttcggtttaagccttgcagtttgcggcggcaggtttcaacaggaaggcggacgcttcttgttcggaaaggtagccgggcgggatgctgcgtcccgccccgcgtgtttgcgccttgttttcccgccggtatggccggaaagcggttgtgtgtcagaaactcatactttcgctgttttgcgcgcgtctgcgtgcgacttccggtgcgatcagcccttggcgcaccagcgattgcagcgattggtccattgtctgcataccgctcgcctgcccggtttgcaggacggagttaatctgcgtgattttgttttcgcggatgaggttgcggacggcggggttggcaatcaggatttcgtgcgaggcgacacggccgttgccgtcgtgcgttttcagcaggttttgggagatgacggcggtcagcgattcggacagcatagagcgcaccatttctttttctcccgccgggaatacgtccacaatacggtcgacggtttttgctgcgccggtcgtgtgcagcgtgccgaaaaccaagtgtccggtttcggcggcggtcagtgccaagccgatggtttctgggtcgcgcatctcgccgacaaggataacgtcggggtcttcgcgcaatgcggaacgcagcgcgttggcgaagctgagggtgtgctggtgcagctcgcgctggttaatcagggattttttgctttggtggacgaattcaatcgggtcttcgatggtcaggatgtgtgccggctgggtttcgttgatgtagttgatcatcgcggcaagcgtggtcgatttgcccgaaccggtagggccggtaaccaaaaccatgccgcgcggcgattctgcgattttttggaaaatgctcggggctttcaattcttccagcgataagacggtgctgggaatggtgcggaatacggcggcgggaccgcggccgatgttgaaggcgttgacgcggaatcgggcgacgttgggcagttcgaacgagaagtcgacttccaagttttgctggtagattttccgctggtggtcgttcatcaccgaagttaccatattaccgacctcttccgcgctcatttcgggaaggttgatgcgccgcatatcgccgtgaacccgaatcataggggatatgcccgaactcaggtgaaggtcggatgctttgtttttagcgccgaaggcgagtaagtcggtaatctgcataatgcggctctgtttagtataatgtttcgattggttggaatggttctaacaaccttgattgtaccgccctgactggaggggtttcaactgtttaatcatttttaattaggggataatctatgacggtgttgcaagaacgttattgtgaggtgtccgaccgtatcggaaaattggttctgcaggcgggcagggagccgcattccgtcagcctgattgccgtcggtaagactttcccttcagacggcatccgcgaagtttacgccgccggacagcgtgatttcggcgagaactatattcaggagtggtacggcaaaacggaagagttggcggatttgaccgacatcgtgtggcacgtcatcggcgatgtgcagtccaacaaaaccaagtttgtcgccgaacgcgcgcattgggtgcataccgtatgccgtctgaaaaccgccgtccggctgagcgggcaacgtccttcctcaatgccgcctttgcaggtgtgtatcgaggtgaacattgcgggcgaggcggtgaagcacggtgtcgcgcccgaagaagcagtcgcgcttgctgtggaagtggcgaagctgccgaatatcgtcgtacgtggactgatgtgtgttgccaaagccaacagcagtgaaacggagttgaaggtgcaatttcaaacgatgcggaaactgcttgccgacctcaatgcggctggcgttaaggcagacgtgctgtctatggggatgtcggacgatatgcctgccgccattgagtgcggtgcgacacacgtccgtatcggcagcgcgattttcgggaaaaggggctgatggaaattcgggcaataaaatatacggcaatggctgcgttgcttgcatttacggttgcaggctgccggctggcggggtggtatgagtgttcgtccctcaccggctggtgtaagccgagaaaaccggctgccatcgatttttgggatattggcggcgagagtccgccgtctttaggggactacgagataccgctttcagacggcaatcgttccgtcagggcaaacgaatatgaatccgcacaacaatcttacttttacaggaaaatagggaagtttgaagcctgcgggctggattggcgtacgcgtgacggcaaacctttgattgagacgttcaaacagggaggatttgactgcttggaaaagcaggggttgcggcgcaacggtctgtccgagcgcgtccgatggtaaaaaattgggaatgaatttagtaaggtaattttgaatagggtagaaataatgaatgtttattttctcggcggcggcaatatggcggctgccgttgcgggcggattggtcaaacaaggcggttaccgcatctatatagccaatcggggtgcggaaaaacgcgaacgtttggaaaaagagttgggggtcgaaacttcggcaaccctgccggagcttcattccgacgatgttttaatccttgccgtcaaaccgcaggatatggaagctgcgtgcaaaaatatccgcaccaacggcgcattggtgctttctgtcgcagccggattgtcggtcggtacgctcagccgttacctcgggggaacacgccgcattgtccgggttatgccgaatacacccggaaaaatcgggctgggcgtatctggtatgtatgccgaagcggaagtatcggaaacagaccgcaggattgccgatcgaatcatgaaatcagtcggtttgactgtttggttggatgatgaggaaaaaatgcacggcattaccggcatcagcggcagcggaccggcttatgtgttttatctgctggacgcattgcaaaatgccgccatccgacaagggtttgatatggcagaagcacgcgcgctcagtctggcaacgtttaaaggagcggttgcccttgccgagcagacgggtgaagatttcgagaagcttcaaaaaaatgtaacgtcaaaaggcgggacaacccacgaagccgtggaagctttcaggcggcatcgtgtcgccgaagccataagcgagggcgtttgtgcctgtgtgcgccgttcgcaggaaatggaacggcaatatcaataatgtaaagaaaataaaaaaaccaatccaaaacgtgttatgatgcgcgttttcaaaaacgccttaggcaataagccttataaaaatcaaaggaataaagccactttgtggtgctttgttttttgcggtgaaccgagaggatatacattatggcaaagctgacagaacaagatattttgaattggagcgggccggaagacgattatatgaatgacgaccatttggcttttttccgcgaattgctggtaaaaatgcaagacgaactcatcgaaaatgcttccgctacgacagggcatctccaagaacacgaatcagcccccgatcctgccgaccgtgccacacaggaagaagagtacgcattggaactccgtacccgcgatcgggaacgaaaacttctcagtaaaatacaggcgaccatccgcaatattgatgaaggggattatggattctgtgccgatacgggagagcctatcggtttgaagcggctgctggcacgcccgacagccactttatctgttgagtcccaagaacgccgagagaggatgaaaaaacagtttgccgactgatggcggcaaacaaaatgccgtctgagtccccgagtttcagacagcatattcacaaaggcgcaccagccggaggagggagaggaaaggattgttggaggcggcgcagtatttagcagaaataaaaaaccttatccgacagcgacatgacgaatttccccaaaaaaatcccgctgaaagcattgaccgtttttccctgtgggcgtatagttcggttcttcgctgctgcagaagtggcggacgaactgaaaagtatagcacagaatgttggggatatcgagagatatcttgacaggcggaaggaatactttataattcgcaacgctctttaacaaaacagattaccgataagtgtgagtgccttgagtctcacactgtttgaaagacagacaagataatgttttgaacattgtcctgttggtttctttgaagcagaccagaagttaaaaagttagagattgaacataagagtttgatcctggctcagattgaacgctggcggcatgctttacacatgcaagtcggacggcagcacagagaagcttgcttctcgggtggcgagtggcgaacgggtgagtaacatatcggaacgtaccgagtagtgggggataactgatcgaaagatcagctaataccgcatacgtcttgagagagaaagcaggggaccttcgggccttgcgctattcgagcggccgatatctgattagctagttggtggggtaaaggcctaccaaggcgacgatcagtagcgggtctgagaggatgatccgccacactgggactgagacacggcccagactcctacgggaggcagcagtggggaattttggacaatgggcgcaagcctgatccagccatgccgcgtgtctgaagaaggccttcgggttgtaaaggacttttgtcagggaagaaaaggctgttgctaatatcagcggctgatgacggtacctgaagaataagcaccggctaactacgtgccagcagccgcggtaatacgtagggtgcgagcgttaatcggaattactgggcgtaaagcgggcgcagacggttacttaagcaggatgtgaaatccccgggctcaacccgggaactgcgttctgaactgggtgactcgagtgtgtcagagggaggtagaattccacgtgtagcagtgaaatgcgtagagatgtggaggaataccgatggcgaaggcagcctcctgggacaacactgacgttcatgcccgaaagcgtgggtagcaaacaggattagataccctggtagtccacgccctaaacgatgtcaattagctgttgggcaacctgattgcttggtagcgtagctaacgcgtgaaattgaccgcctggggagtacggtcgcaagattaaaactcaaaggaattgacggggacccgcacaagcggtggatgatgtggattaattcgatgcaacgcgaagaaccttacctggtcttgacatgtacggaatcctccggagacggaggagtgccttcgggagccgtaacacaggtgctgcatggctgtcgtcagctcgtgtcgtgagatgttgggttaagtcccgcaacgagcgcaacccttgtcattagttgccatcattcagttgggcactctaatgagactgccggtgacaagccggaggaaggtggggatgacgtcaagtcctcatggcccttatgaccagggcttcacacgtcatacaatggtcggtacagagggtagccaagccgcgaggcggagccaatctcacaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtgggggataccagaagtaggtaggataaccacaaggagtccgcttaccacggtatgcttcatgactggggtgaagtcgtaacaaggtagccgtaggggaacctgcggctggatcacctcctttctagagaaagaagaggctttaggcattcacacttatcggtaaactgaaaaagatgcggaagaagcttgagtgaaggcaagattcgcttaagaagagaatccgggtttgtagctcagctggttagagcacacgcttgataagcgtggggtcggaggttcaagtcctcccagacccaccaagaacgggggcatagctcagttggtagagcacctgctttgcaagcagggggtcatcggttcgatcccgtttgcctccaccaatactgtacaaatcaaaacggaagaatggaacagaatccattcagggcgacgtcacacttgaccaagaacaaaatgctgatataataatcagctcgttttgatttgcacagtagatagcaatatcgaacgcatcgatctttaacaaattggaaagccgaaatcaacaaacaaagacaaagcgtttgttttgattttttattctttgcaaaggataaaaatctctcgcaagagaaaagaaaacaaacacagtatttgggtgatgattgtatcgacttaatcctgaaacacaaaaggcaggattaagacacaacaaagcagtaagctttatcaaagtaggaaattcaagtctgatgttctagtcaacggaatgttaggcaaagtcaaagaagttcttgaaatgatagagtcaagtgaataagtgcatcaggtggatgccttggcgatgataggcgacgaaggacgtgtaagcctgcgaaaagcgcgggggagctggcaataaagcaatgatcccgcgatgtccgaatggggaaacccactgcattctgtgcagtatcctaagttgaatacatagacttagagaagcgaacccggagaactgaaccatctaagtacccggaggaaaagaaatcaaccgagattccgcaagtagtggcgagcgaacgcggaggagcctgtacgtaataactgtcgagatagaagaacaagctgggaagcttgaccatagtgggtgacagtcccgtattcgaaatctcaacagcggtactaagcgtacgaaaagtagggcggggcacgtgaaatcctgtctgaatatggggggaccatcctccaaggctaaatactcatcatcgaccgatagtgaaccagtaccgtgagggaaaggcgaaaagaaccccgggaggggagtgaaacagaacctgaaacctgatgcatacaaacagtgggagcgccctagtggtgtgactgcgtaccttttgtataatgggtcaacgacttacattcagtagcgagcttaaccgaataggggaggcgtagggaaaccgagtcttaatagggcgatgagttgctgggtgtagacccgaaaccgagtgatctatccatggccaggttgaaggtgccgtaacaggtactggaggaccgaacccacgcatgttgcaaaatgcggggatgagctgtggataggggtgaaaggctaaacaaactcggagatagctggttctccccgaaaactatttaggtagtgcctcgagcaagacactgatgggggtaaagcactgttatggctagggggttattgcaacttaccaacccatggcaaactaagaataccatcaagtggttcctcgggagacagacagcgggtgctaacgtccgttgtcaagagggaaacaacccagaccgccagctaaggtcccaaatgatagattaagtggtaaacgaagtgggaaggcccagacagccaggatgttggcttagaagcagccatcatttaaagaaagcgtaatagctcactggtcgagtcgtcctgcgcggaagatgtaacggggctcaaatctataaccgaagctgcggatgccggtttaccggcatggtaggggagcgttctgtaggctgatgaaggtgcattgtaaagtgtgctggaggtatcagaagtgcgaatgttgacatgagtagcgataaagcgggtgaaaagcccgctcgccgaaagcccaaggtttcctgcgcaacgttcatcggcgtagggtgagtcggcccctaaggcgaggcagaaatgcgtagtcgatgggaaacaggttaatattcctgtacttgattcaaatgcgatgtggggacggagaaggttaggttggcaagctgttggaatagcttgtttaagccggtaggtggaagacttaggcaaatccgggtcttcttaacaccgagaagtgacgacgagtgtctacggacacgaagcaaccgataccacgcttccaggaaaagccactaagcttcagtttgaatcgaaccgtaccgcaaaccgacacaggtgggcaggatgagaattctaaggcgcttgagagaactcaggagaaggaactcggcaaattgataccgtaacttcgggagaaggtatgccctctaaggttaaggacttgctccgtaagccccggagggtcgcagagaataggtggctgcgactgtttattaaaaacacagcactctgctaacacgaaagtggacgtatagggtgtgacgcctgcccggtgctggaaggttaattgaagatgtgagagcatcggatcgaagccccagtaaacggcggccgtaactataacggtcctaaggtagcgaaattccttgtcgggtaagttccgacccgcacgaatggcgtaacgatggccacactgtctcctcctgagactcagcgaagttgaagtggttgtgaagatgcaatctacccgctgctagacggaaagaccccgtgaacctttactgtagctttgcattggactttgaagtcacttgtgtaggataggtgggaggcttagaagcagagacgccagtctctgtggagccgtccttgaaataccaccctggtgtctttgaggttctaacccagacccgtcatccgggtcggggaccgtgcatggtaggcagtttgactggggcggtctcctcccaaagcgtaacggaggagttcgaaggttacctaggtccggtcggaaatcggactgatagtgcaatggcaaaaggtagcttaactgcgagaccgacaagtcgagcaggtgcgaaagcaggacatagtgatccggtggttctgtatggaagggccatcgctcaacggataaaaggtactccggggataacaggctgattccgcccaagagttcatatcgacggcggagtttggcacctcgatgtcggctcatcacatcctggggctgtagtcggtcccaagggtatggctgttcgccatttaaagtggtacgtgagctgggtttaaaacgtcgtgagacagtttggtccctatctgcagtgggcgttggaagtttgacgggggctgctcctagtacgagaggaccggagtggacgaacctctggtgtaccggttgtaacgccagttgcatagccgggtagctaagttcggaagagataagcgctgaaagcatctaagcgcgaaactcgcctgaagatgagacttcccttgcggtttaaccgcactaaagagtcgttcgagaccaggacgttgataggtggggtgtggaagcgcggtaacgcgtgaagctaacccatactaattgctcgtgaggcttgactctatcatttgaagaacttcaagagataaaagcttactgactgattcagtcattaccgaatatattgattaaggctttaccgatttgtaacagtttaagtttggcggccatagcgagttggtcccacgccttcccatcccgaacaggaccgtgaaacgactcagcgccgatgatagtgtggttcttccatgcgaaagtaggtcactgccaaacacccattcagaaaacccccgattattcgggggtttttgctttgcccggaaaaaatgtttgctttgcccggaaaaaatgtcggtgatggcgggacggcatccgtacggtgtccggtcgggtttgcggaggaacggcttgaaactttgggatattcattttagaatgactcgttttatcgtcgcaagatgcggtttattgtttgcaacccttaaaggaaaaaccatgaagaaaatgttcgtgctgttctgtatgctgttctcctgcgccttctcccttgcggcggtaaacatcaatgcggcttcgcagcaggagttggaggcgctgccaggcataggccctgcggtgctggcgaagctgaaggatcaggcttccgtcggcgcgcccgcaccaaaaggcccagccaaaccagtgctgcccgcggataaaaaataaaatagggggaagtctgcagccgcatcaaatgccgtctgaacatgcgttcgggcggcgtttttataacaaaaacacttcatggcggttggttttatgcctatctaagtttttgtgtcgtgcatacctgaagatttcagacggcatcggtttatgctgtctgaaaagtgtattccgtttcagtttgtaagctatggcagtctgtttgtcttgtgttttgcgcaattgcccttattttgagccgtgattttattttgaattagatgaaaaaatgagtaatcaagatttttatgcgacgctgggtgtggcaagaacagctaccgatgatgagattaaaaaagcctaccggaaattggcgatgaaataccatcccgaccgcaatcctgacaataaagaggcggaagagaagtttaaagaagtacaaaaggcgtatgaaactttgtccgacaaggaaaagcgcgctatgtacgaccagtatggtcatgcggcgtttgaaggcggcggacaggggggcttcggagggtttggcggatttggcggtgcgcagggttttgactttggggatattttcagccaaatgtttggaggcggttcggggcgcgcccagcctgattatcagggtgaggacgttcaagtcggtatcgaaatcacgcttgaagaagccgcaaaaggtgtgaagaaacgcatcaatattccgacttatgaagcgtgtgatgtctgtaacggcagtggcgcgaaaccggggacatccccggaaacctgcccgacttgcaaaggttcgggtacggtgcacatccagcaggcgattttccgtatgcagcagacttgtccgacctgccacggtgcgggcaaacacattaaagaaccttgcgtcaaatgccgtggcgcggggcggaataaggcggtcaagacggtggaagtcaatattcccgccggtatcgatgacgggcagcgtatccgtttgagcggcgaaggcgggccgggtatgcacggtgcgcctgccggcgacttgtatgtaaccgtccgcattcgggcgcataagattttccaacgcgacggtctggacttgcattgcgaactgccgatcagttttgccacggctgctttgggcggggagttggaagtgccgaccttggacggaaaggtcaagctcaccgtccccaaagaaacccaaaccggcaggaggatgcgcgtgaagggtaagggtgtcaaatctttacgcagcagcgcgaccggcgatttgtactgccatattgttgtcgaaacgcctgtcaatttgaccgaccgtcaaaaagagcttttggaagaatttgagcggatttctaccggcttggaaaaccaaacaccgcgcaagaaatcgtttttagacaagctgcgcgatttgtttgattgattttaaggttcggaaacaagcagccgtatcggggaatctccttgatacggctgtttttatttgtttaaaaatagtttttattttcaatggggtatgaggcagggtgggataactgtttttaactgttctttttaaaacttgacatcatggcgtgatgccaacaatatgtgaacgtctgttgtcaaaggaagaataatgaataaatctttatccagttcggtagaagaataccgcgagctgacgctccgaggcatgatactcggtgcattgatcactgtaatttttactgcgtccaatgtttacctcggtttgaaagtcgggctgacctttgcctcgtcgattccggcggcggtgatttcgatggcggttttaaagtttttcaaaggcagcaatattttggaaaacaacatggtgcagacccaagcctcggctgcgggtacgctttcgaccatcatcttcgtcctgcccggtttgctgatggcgggctactggagcggtttcccgttctggcagacgacgcttttatgtattgccggcgggattttgggggtgattttcaccattcctctgcgttacgcaatggtggtgaaaagcgatttgccttatccggaaggtgtggcggctgctgaaattttgaaagtgggcggtcatgaagaaggggataaccgtcagggcggcagcggcatcaaagagctggcggccggcggtgcgttggcgggattgatgagcttttgcgccggaggtctgcgcgtgattgccgacagcgcgagttattggtttaaaagcggtacggcgattttccagctgccgatgggcttttcactggcattgttgggcgcgggctatttggtcggactgacgggcggtatcgccatcctgttgggcatttcgattgcttggggcattgccgtgccgtatttctcctcacacattccgcaaccttccgatatggaaatggcggcgtttgcgatgaagctgtggaaggagaaagtgcgttttatcggtgcggggactattggcattgcggcggtttggacgctgttgatgctgctcaagccgatggtggaaggcatgaagatgtcgttcaagagttttggcggcggtgcgcccgctgcggaacgcgccgaacaggatttgtcgcctaaggctatgattttttgggtgctggcgatgatgtttgttttaggcgtgtcgttttaccactttatcggcgattcgcacattacgggcggcatggcttggcttttggtggtcgtttgcacgcttttggcttccgtcatcggctttttggtcgccgccgcctgcggttatatggcaggtttggtcggctcgtcttccagcccgatttccggcgtgggcatcgtgtccgtcgtcgttatttcactggttttgctgctggtaggcgaatccggaggtttgttggcggatgaggctaaccgcaaatttttgctggcactgactttgttttgcggctcggcagtaatctgcgtggcttcgatttccaatgacaacctgcaagacttgaaaaccggctacctgctcaaagccacgccttggcggcagcaagtcgccctgattatcggctgtatcgttggtgcgctggttatttcgcccgtgttggaactgctttacgaagcctacggctttaccggcgcaatgccgcgcgaaggcatggacgcggcgcaggctttggcagcccctcaagcgactttgatgacgaccatcgcgtcgggcattttcgcccacaaccttgaatgggtctatatctttaccggtatcgtgattggagcagtattaatcgtcgtcgatttggtgttgaaaaaatcatcaggcggcaaacttgccctgcccgtccttgcggtcggtatgggtatttatctgccgccgtccgtcaatatgcccatcgtggcaggcgcggtgttggcggcggtgttgaaacacatcatcggtaaaaaagcggaaaaccgcgaaggccgtctgaaaaacgccgagcgcatcggaaccttgttctccgccggcctgattgtcggtgaaagcctgatcggtgtgattatggcgtttattattgccttctccgtgaccaacggcggctcggatgcgccgctcgcgttgaatctgcaaaactgggatgccgccgcttcttggctgggtttggcgttcttcgttaccgggatgtttttctttgcacagcgcgtactgaaggcgggcaagtaggctgtcggaaaaaatgccgtctgaaacgttcagacggcattttttatcggtaaagcggaaggcggagcttttcggcttgcgcccacgttttgccggcaaggtctttgggcgacagcagcggcgcggtttgaagcggccagcctatgccgactgtcgggtcgttccatattaaaacctgttcggcttcaggcttgtaatagtccgtgcatttatagacgaactcggcttcatcgctcagtacatagaagccgtgtgcgaaaccttcgggtacccacagttggcgtttgttttctgcggacagaatttcgcctacccatttgccgaaagtgggggagtctttacgcatatcgacggccacgtcgaatacttcgccgacaaccacgcgtacgagtttgccttgtgtgttttcagtttgatagtgcaggccgcgcaatacgcctttgccggatttggagtggttttcctgcacgaaggtgcgttcgcagacttgggttttaaaccactcgtcgcggaaggtttccataaaaaagccgcgcgcgtcgccgaagacttggggctcaagcagttttacgtcaggaatggcggtatcaatgatgttcatctttttatctttcatctaaaggccgtctgaaaagtttcagacggcctcaaacattattttttcaacaggcgcagcaaatattggccgtattggtttttcgccatcgggcgcgccaattcttccagtttttcatcggaaagccaaccgttgcgccaagcgatttcttcgaggcaggcgatgtgcaggttttggatattttgcacggtttggacgaatgaagcggcttcgtgcaggctctcgtgggtgccggtgtccagccacgcgaaaccgcgtcccaatatttgaacggagagcgagccgtcttccaaatacatccggttgaggtcggtaatttccaattcgccgcgtgcggacggtttgagctgtttggcgaactcgacggcgcggttgtcgtagaaatacaagccggttaccgcccaatcggatttgggccgttgcggtttttcttcgatggaaacggcgcggaagttttcgttaaattcaaccacgccgaaacgttcggggtttttgacctgataagcaaacacggttgcgccgtgcgtttgcgctgccgcctgtttcaatgtttgcgtaaacgactgaccgtaaaaaatattgtcgcccaaaaccaagcaaacattgtcgttgccgataaattcttcgccgatgataaatgcctgtgccaagccgtccggactgggttgcacggcataactgatggaaatgccgaaatcgctgccgtcgccaagcaggcgtttgaaagaggcgttgtcttcaggcgcggtaatcaccaaaatatcgcggattcccgccagcatcaaaaccgacaaggggtaataaatcatcggtttgtcgtacacgggcaggagctgtttggatacgccgcgcgtgatggggtagaggcgcgtgccgctgccgcctgccagtatgatgcctttcatcttttctttcttcctttgcgatgggttttcagacggcattgcgtcgggatgccgtctgaaaactattttccagtacctaaacgttccaaacgatagctgccgttcaatacattttgccaccaggttttgttgtccagataccattgcacggttttgcggaggccggactcgaaggtttccaaaggcagccagcccaaatcccgcctgattttggctgcgtcgacggcgtagcgtacgtcatggccggggcggtcttgtacgaaagtaatcaaatcttcataacgcgccacaccggccggtttttcgggagcgagttcttccagcagggcgcagatggttttgacgacttcaatattggctttttcattgtggccgccgatattgtaggtttcgccgacaacaccttcggtaacaacctgatacagtgcgcgcgcgtggtcttcgacaaacagccagtcgcggatttgcataccgtcgccgtacacaggcagcggtttgccgtcaagcgcgttcagaatcatcaaaggaatgagtttttccggaaaatggtaaggaccgtagttgttggagcagttggttacaatggtcggcaagccgtaagtacgcaaccacgcgcggacgaggtggtcgctggacgctttagaggcagagtaggggctggacggcgcgtagggcgcggtttcggtaaacaaatcgtccgtgccgcctaaatcgccatagacttcatcggtggaaatatggtggaaacggaaggcttcgtgctgttcagacggcatttgttgccagtaggcgcgggctgcttcaagcagattgaatgtgccgacgatattggtttggataaactcgcctgccgaaccgatagagcggtcgacatggctttccgccgccaagtgcatcacggcatcaggccggtattgcgcgaatacgcggtcgagttcggcgcggtcgcaaatatccacttgttcaaaagcatagcgaggattatcggctacctcagtcaaagattccaaattgccggcataagtcagcttatcgacattgacgacagcgtcccgggtgtttcggataatatgacggacaacggcagaaccgataaagcccgcgccgccggtaacaaggatttttctcataaatttcagaggatagccaaaaaatataaacagattatagcagacagaatgtgtgtttttcagataaagaggccgtctgaaaacatctctttcagacggcctgtatcaggtcaacttaatcgtcgtagccattcggattattactcacccagcgccatgagtcttccatcatttgggttaaatcacgctgggtttgccagccgatttgcgcctttgtataggaagggtcggcatagaagcacgccaaatcaccggcacggcgcggtttgacttcatacggaatcgtcaaacccgaagctgcttcaaatgcgcggatgatttccaacaccgaagaagcgcggccggagcctaagttcagcaaatgcgtgcctgctacattactttttgcctgcatagccgcgacatggccttctgccaaatccatcacatgaatatagtcacgcatccccgtgccgtcgggggtagggtagtcatcgccaaataccgccaattgcggcagtttgcctgccgccacttggcagatataaggcaacaaattattcgggatgccgtttggctgctcgccaatcaagccgctttcatgcgcgccaatcggattgaaataacgcaacaaaatcatgctccagcgcggatcggctttttgaatgtcagtgagaatgcgctcaaccatcgatttcgatgcgccgtaagggctggtggtgtcgcccggtggcatatcctcggtataaggcactttgcccggatcgccataaaccgtcgccgaagaactgaacacaatgctaaacacgcccgcacgcgccatttcttccgccaacaccaagctgccggaaacattattatcataatatttcatcggctcggccacactttcacccaccgctttcaagccggcaaaatgaatcaccgaatcaatgcggttttccgcaaaaatacggcgcaaaatctcacgatcgcggatatcgccttgataaaacggaatctcttggccggtaatcgttttcaagcgtggcaggatattgatgctggaattgcataggttatccaaaatcacgacttgatggccgcttttcagcaaagaaacaacggtatgcgagccgataaaaccggtgccgccggtaacgagaatttttttcatagaataaaatactaaaaatactttgatagattgataataatggttgtaaaatcttaatgaaataattatccctgaagtagcagtagatttcttcagatttttttggttaagtatatttgatatctaaggtaaaatactataattttattcatatggtgtagaattaagggaaaatagtgaaaaaagtattactaattgccagttatgactcgttccttaactcgggctatgctgttgcaaaagagataaaagatgctcaaattgatatttatatccacaaaagtcgagaaaacattctttcaaatcgacagttattagaatcagggatagataaagaccaagcaattttttttttcatattgatgattactttattaagaatatgcatcaatattatgacgcagtaattttatcggttggaaatgggttgttaaaaaggttctttaagcagaatgcgcaattaaatattgcttcaaggccattgattattaccttgtttccaggtgtagtattcggtgatcaggcaagtattctatctcgtatgggggctgatattgttttatataataataagcatgattttagaattgcagaggaatataagaaacaatataaattaagttgtcaaaatatactttatggttatccaatttttcgccatgcttcgaaaggttgtcatggagagaaaatttactttattgaccaagttaaaatcccatttaaaaaagaagaaagaatttatacattaaaaaaattgattgccttggctgaaaaataccctgagaaagaatttactattttgctaagggttgcagataaagatattactgtgcatcaggataaacattcgtatatagagctggcaaagcagtttcagttgccgagtaatttgacaatagagcgaaaaagtaccgcgcaagccttccaagaaatggggtattgtttatcttattcatctactatgctttttgaagctgaatgtaagggtatccctgttggtgttgttgcagacttaggcttttctaaatcctatgcaaatcagcattttttaggtagtggggttttagtttattttgatcaaatagatttcacttccccaaaaatagcagatccggattggcttgattgctatgctactaaaaaggtgattacaactgatgagtttaataagctattaaagcaggttgtgccattgcaacatgattaccaagaatatttatctgcaggaattcgatatcaagctttggctaacacacacgccattccaaccaatagttttctcggcataaagccatgctctgacgcttaaatgcactaatgccttaaaaaaacattaaagtctaacacactagacttatttacttcgtaattaagtcgttaaaccgtgtgctctacgaccaaaagtataaaacctttaagaactttcttttttcttgtaaaaaaagaaactagataaatctctcatatcttttattcaataatcgcatcagattgcagtataaatttaacgatcactcatcatgttcatatttatcagagctcgtgctataattatactaattttataaggaggaaaaaataaagagggttataatgaacgagaaaaatataaaacacagtcaaaactttattacttcaaaacataatatagataaaataatgacaaatataagattaaatgaacatgataatatctttgaaatcggctcaggaaaagggcattttacccttgaattagtacagaggtgtaatttcgtaactgccattgaaatagaccataaattatgcaaaactacagaaaataaacttgttgatcacgataatttccaagttttaaacaaggatatattgcagtttaaatttcctaaaaaccaatcctataaaatatttggtaatataccttataacataagtacggatataatacgcaaaattgtttttgatagtatagctgatgagatttatttaatcgtggaatacgggtttgctaaaagattattaaatacaaaacgctcattggcattatttttaatggcagaagttgatatttctatattaagtatggttccaagagaatattttcatcctaaacctaaagtgaatagctcacttatcagattaaatagaaaaaaatcaagaatatcacacaaagataaacagaagtataattatttcgttatgaaatgggttaacaaagaatacaagaaaatatttacaaaaaatcaatttaacaattccttaaaacatgcaggaattgacgatttaaacaatattagctttgaacaattcttatctcttttcaatagctataaattatttaataagtaagttaagggatgcataaactgcatcccttaacttgtttttcgtgtacctattttttgtgaatcgataccgtcgacctcgagggggggcccggtacccaattcgccctatagtgagtcgtattacgcgcgctcactggccgtcgttttacaacgtcgtgactgggaaaaccctggcgttacccaacttaatcgccttgcagcacatccccctttcgccaggcaaaaaaccggttatatttttttgcattaaatatttttttagcatattcaggaaaggggacatgcaatatgtcaaaatgatctatatatcctttaatattaagattatttccaatcaaataacgttctaattttgttggatgatatgaaaatgattctaataaaggagcatatgttccagtcccttcatcaattaaatgagtcgtaatattctttttttttgcaatactaatcagataggagtagtggcctgtaaaagacagcatatagagatgagcaggctgtataatattaaggatttttttgtaacttctataaatataaagtaattttttaggagttatattattagggcttctaggaagctcaaatagataaatagattcaaatagattcttgttagctgattgatgaactaacttaggcatttttaagtttttagaagtatataaaattactagtaaattattggttaatttttgtattttaattaggctttggacttggttaagctgacctaaattagatatgacaaataaattgttacgtgggggggtaagataaaatggagatgttgtcaaccacattgaatcttgaaaaaactttttaggctgaaaaagagctttttttattttctttagcattattgtatctcttaaaaattaatgagaattagctatatgtaatagccaatcctctgttaataaagtaactaagttaataagcattattcaatatcagtttttttgatttgagcacctttgcgaatattgcaagcagcgaccttaccaaataatgtttcatattcgttgacgctgaagtctccattgcctgggcgtttaacccataggttatctccggacaacagttctccttttttaatgtctttatctgctacgacagatgcaaaggcgaaatctttagttggcttttctcccgcgataatcgtgtcttttttgccgccgcgtgccaattttaaagcatgagcgccttgcttgagctctttaaaagtatccggattcatagagcatacaatatccggacctgggcgatccatgcggtcagtaaagtgacgctctaaaatcgaaccgcctaaagctactgctcctaagcaagcatagttatctaaggtatggtcagacaggccaatgattgcgtctggaaaggcttcagataaatcgttcataccacccaatcgaacatcttcgtaaggggttgggtagatgttggtacagtgaagcaaagcataaggtacccctgcttctcgaataatttctaccgactttttgatgctttcaatagaattcatgccggtagagagaataataggcttaccaaaagaggccaccagtttaattaatgggtagttattacattcgccagagccgattttatatgctggaatatccatacgttgtaatcgtaaagcagctgcacgagagaaaggagtactgataaaaatcatacccttactctctacgtattcttttaatttaatctcatcttcttcattcagggcgcaacgttccataatttcataaatagagacatctgcattgcctggaatgacttgtttggcctcatcagacatttcgtcttcaacgatgtgtgtttgatgtttaacaacttcagcgcctgcattataggcagcatcaaccatttcaaaagctgtttttaaagagccttcatgattgatgccgatttcacagataatcaatggttcgtggttgtaacctactgaacgattaccaattttaaattcgttgttgttttgcatttagctttccttgtgattaagaatgttttctgcctgttgtaaatcaagctcagtatcaatatcgatagagtcttgatgagacataatataaagtttggttggggcgataaaaaaacaattatttgcaattagtgaagcagtatcattaatgtaaattgcaccattaggcctaaatgcctgaggtaattgttggcgaggctgctccaaatcgcttagatggcgcatgggggcatattcgccattattgatttgaagcagggtttttagtggatgatgctccattgggcatgcagagacaacggatccttttattttctcatcaaatagagaaaaagcttcacgaatatgagcccctgtgcgtaatggactggttggttgtaatagggttactgtgccggaattactgccaattgtttctaaagcatgtattacacctgaaatagagctggctgtatcggaggccagctctgcagggcgtaggacgacttcgacaccgaaatttttagcttcttctgcaattaacccgccatcagtcgaaacaattatgcggtcaaaacactttgatgatatagcagcattaattgtatgaccaagtaatgatatgccattcattttccggagattttttaatggcaatcctttggagttttggcgcgcaagtataaccgcaatattttgtttttccataatttaaagattcaaatcgataaaacgtttttgagcagaaacattccacgtttcaggattgttgattacttcagcaaatctttctgtgctggtgcgagtatctccgccattaaaggtatcatctgcttcaaatttgcctaaactgcatgcttgttgaatcgcatcaaagatatttttagtttcataatctgtatgaataatagattttcccatatggcggttactttggcgtgtaccaacatcaattgaagggacaccgtagagaggagcttctctaatacctgcacttgagttgccgaccataaatttagcatgtttcaataagactaaaaaatattcaaatcgaatggaaggaaatgcaataaatttatcagattgatattttaataattcttgcagaatactttcagtgccagtgtcattattagggtagatgctaatgatattttggccacttaattctaatgctttgaaatattgggccgcatattgtggcattaaatgtgcttctgtagtcacggggtgaaacatagaaataccataattttcgtatggtaaaccgtaatattctttgacttcttctaaggatgggagggtggaagaggccataacatctaaatcgggggagccgatgatgtgaatatgctttcttttttctcccatttgcactaggcgagtgacagcttgttcatttgctaccaagtggatatgagaaagtttactaatagaatgacgaatggagtcatctactgtaccagatagttcaccaccttcgatatggcaaactaaacggctgcttaatgcacctacagctgcgcctgctagtgcttctaaacggtcgccgtgaatcatgaccatatcaggttcaatttcatcagatagacgagagataaacgtaatggtattgcctaaaacggcacccattggttcaccttggatttgatttgaaaacagatatgtatgttgatagttttctcgagttacttccttgtaggttctgccatatgttttcatcatatgcataccagttacaatcaaatgcaattcaaggtctgggtgattttcaatataggctaataaaggttttagcttgccgaagtcggctctggtacctgtaatgcaaagaattcttttcatgattttagaatctataagtatataagtataaggaagttggaaagaagaatactaattatactctacgtactcataaatttatttcgattaagtgctataattaggccatttataattatattaggatttggcttgtgtttaaagtgaaattttatattcgtcacgcagtattattattgtgtggaagtttaattgtaggatgctctgcgattccttcatcaggccccagcgcaaaaaaaattgtctctttagggcaacaatctgaagttcaaattcctgaagtggagctgattgatgtgaatcatacggttgctcagttattatataaggctcagataaatcagtcattcactcagtttggcgatggttatgcttcggctggtacgctaaatattggtgatgtattggatattatgatttgggaagcgccgccggcagtattgtttggtggtggcctttcttcgatgggctcgggtagtgcgcatcaaactaagttgccagagcagttggtcacggcacgtggtacggtttctgtgccgtttgttggcgatatttcggtggtcggtaaaacgcctggtcaggttcaggaaattattaaaggccgcctgaaaaaaatggccaatcagccacaagtgatggtgcgtttggtgcagaataatgcggcgaatgtgtcggtgattcgtgctgggaatagtgtgcgtatgccgctgacggcagccggtgagcgtgtgttggatgcggtggctgcggtaggtggttcaacggcaaatgtgcaggatacgaatgtgcagctgacacgtggcaatgtagtacgaactgttgccttggaagatttagttgcaaatccgcgacaaaatattttgctgcgtcgcggtgatgtggttaccatgattaccaatccctatacctttacgtctatgggtgcggtggggagaacacaagaaatcggtttttcagccagaggcttatcgctttctgaagccattggccgtatgggcggtttgcaagatcgccgttctgatgcgcgtggtgtgtttgtgttccgctatacgccattggtggaattgccggcagaacgtcaggataaatggattgctcaaggttatggcagtgaggcagagattccaacggtatatcgtgtgaatatggctgatgcgcattcgctattttctatgcagcgctttcctgtgaagaataaagatgtattgtatgtgtcgaatgcgccgttggctgaagtgcagaaatttttgtcgtttgtgttctcgccggttaccagtggcgcgaacagtattaataatttaactaattaatgtgagtaattaagatgtctgagcaacttcctgtggcagttgccactgaaaccaaagccgagcgtaaaaagccgaaaaagaaaagttggattaaaaagctaagccctttattttgggtaacggtgattatccctacggtaatttcgttggtgtatttcggcttcttcgcttccgatcgttttacgtcgcaatcgagctttgtggtgcgctcgcctaaaagccaatcttctctcaatggcctgggtgccattttgcagggcacaggttttgcccgtgcgcaagatgatatttacacggttggggagtatatgcgttcgcgctcgtctttggatgaactgcgtaaaatcttgccggtgcgtgagttttatgaaaccaaaggtgatgcgttcagccgctttaatgggtttgggttccgtggcgaggaagaggctttttatcaatactataaaaatcaggtgatgatcaattttgatacggtttcgggtatttccacgttgaatgtaacttcctttgatgcgctggaatctaagaaaatcaatgaggctttgttaaaacaaggtgaagcattgattaaccagttgaacgatcgtgcacgtgctgatacggtgcgctatgcggaagaagtagtgaaaacggcggcagagcgggtaaaggaagcctctcagaatctgacggattaccggattgccaatggcgtttttgatttgaaagcgcaatcggaagtgcaaatggggttggtttccaagctgcaagatgaattgattgtgattcaaacccagctggatcaggtgaaagcagtcactccggagaatccgcagattccgggtttgcaggcgcgtgagcagagcttgcgtaaagaaattgaccaacagttacgtgccatttcgggcggtgggcattcttcgttgtctaatcaggctgccgaatatcagcgtgtgtatttggaaaaccagttggcagagcagcagttggcagccgccatgacttctttggaaagtgccaaggttgaagcagaccgtcagcagctttatttggaagtgatctcgcaaccgagcctgccggatttggcacatgagcctaaacggttatacaacattgttgccactctgattatcggcttgatggtttatggtattttgagcctgttgactgccagcattcgtgagcataaaaactgatgaaagccttgcataaaacatcattttgggaatctttagccattcaaaggcgcgtaatcggtgcgctgttgatgcgggaaattatcacccgttacggtcgcaataatattggctttttatggctgtttgttgagccgttgctgatgacattcgttatcgtcttgatgtggaaatttttaagggcagaccgatattcaactttgaatattgtcgcatttgcgattactggctatccgatgttgatgatgtggcgtaatgcctcaaaacgggcagttgggtcgatttcttcaaatgccagcttgctttatcaccgcaatgtaagagttttggataccatcttggcgcgcatgattttggaaattgctggtgcaaccattgcgcagattgtgattatggcggtattgattgcgattggctggattgaaatgccggcagatatgttttatatgctgatggcttggcttttgatggctttttttgcgattggtttgggtttggtgatttgttcgattgcctttaatttcgagccgtttggcaagatttggggcacattgacttttgtgatgatgccgttatccggtgcgttcttttttgtgcataatttgccgcccaaggtacaagaatatgcattaatgattccgatggtgcatggcacagaaatgttccgtgccggatattttggcagcgatgtaattacctatgaaaatccttggtatatcgtattgtgcaatctggtgttgttgttgtttggcttggcgatggtcagtaaattcagtaaaggagtcgagccgcaatgatttcagttgaacacgtttccaaacgctatctgacccgccaaggttggcggacagtcttgcacgatattagcttcaaaatggagaagggcgagaaaatcggtattctcggccgcaacggtgcaggtaaatcgacgctcatccgtttgatcagtggcgttgagccgccgaccacgggtgaaatcaagcggacaatgagtatttcttggcctttggcattctccggtgcgtttcaaggcagtctgaccggtatggacaatttgcgtttcatctgccggatttacaatgtcgatatcgattatgtgaaagcgtttacggaagaattttcggagctggggcaatatttgtatgagccggtgaaacgctattcttcaggtatgaaagcgcgtttggcttttgcgctgtcgttggcggtggagtttgactgttacctgattgacgaagtgattgcagttggtgactcgcgttttgccgataaatgtaagtacgagttgtttgaaaagcgcaaagaccgttccatcatcttggtgtcgcacagccacagcgccatgaagcaatattgcgataatgcgatggtgctggaaaaagggcatatgtaccagtttgaagatatggacaaagcctacgaatattataattcgctgccttaaagcgattgtttttaaatcaggccgtctgaaatttcagacggcctgtccgttggaattctattgatgaacattactcaaattctttcccaagaactctccgcgactgccgcgcaaatcaccgccgccgtcgagcttttggacgacggcgcgaccgtgccgtttatcgcccgctaccgcaaggaagcgacgggcgggttggacgatacgcagttgcgccggcttgccgagcggctgcaatatctgcgcgagttggaagagcgcaaagccgttgttttaaaaagcattgaagagcaaggcaagctttcagacgacctcagggcgcaaatcgaagccgccgataacaaaaccgcgctggaagacctgtatctgccctacaaacccaaacgccgcaccaaagcgcaaatcgcgcgcgaacacggtttgcagccgctggcggacgtgttgcttgccgagcagtcgcaggacgtggaagccgccgcacaaggctacctgaacgaaaacgtccccgatgccaaagccgcgttggacggcgcgcgtgcgattctgatggagcagtttgccgaagacgcggaacttatcggcacgctgcgcgacaagctgtggaacgaagccgaaatccacgcgcaagtcgttgaaggcaaagaaaccgaaggcgaaaaattcagcgattatttcgaccaccgcgaacccgtccgcactatgcccagccaccgcgcgctggcggttttgcgcggccgcaacgaaggcgtgttgaacatcgcgctcaaataccagcccgacgacacgccgattacccggcaaagcgaatacgagcaaatcatcgcctgccgcttcaaggtttcagacggccacaaatggctgcgcgataccgtgcgtctgacttggcgcgcgaaaatctttttgtcgttggaacttgaagccctaggccgtctgaaagaagccgccgacaccgacgcgattaccgtgttcgcccgcaatctcaaagacttgctgctcgtcgcgcccgccggacggctgaccacgctgggtctcgaccccggctaccgcaacggcgtgaaatgcgccgtggtggacgacaccggcaagctgctggataccgtcatcgtctatttgcatcaagaaaacaatatgttggcaacgctgtcgcgcctgattaagcaacacggcgtgaagctcatcgccatcggcaacggcaccgccagccgcgaaaccgacaaaatcgcgggcgaactggtgcgcggaatgccggaaatggggctgcacaaaatcgtcgtgtccgaagccggcgcgtcgatttattccgcgtccgaactggcggcgcgcgagttccccgacttggacgtttccctgcgcggcgcggtgtccatcgcccgcaggctgcaagacccgcttgccgagttggtcaaaatcgaccctaaatccatcggcgtgggccagtatcagcacgatgtgaaccaaaaccagctcgccaaatcgctggacgcagtggtcgaagactgcgtgaacgccgtcggcgtggacgtgaataccgcctccgccccgctcttggcgcggatttccggcttgaatcaaacccttgcccaaaacatcgttgcctaccgcgatgaaaacggcgcgttcgacagccgcaaaaaattgctgaaagtaccgcgtttgggcgaaaaaaccttcgagcaggcggcaggctttttgcggattaacggcggtaaagagccgttggacgcgagcgccgtccaccccgaagcctatcccgtcgtcgccaaaatgctggcgcaacaaggcattagcgccgccgaactcatcggcaaccgcgagcgcgtgaagcaaatcaaagcgtccgacttcaccgacgaacgcttcggcctgccgaccattttggacatcctgtccgaactggaaaaacccggccgtgatccgcgcggcgagtttcagacggcatcgtttgccgaaggtatccacgaaatcagcgacttgcaagtcggtatgatactcgaaggcgtggtttccaacgtcgccaacttcggcgcgttcgtggacatcggcgtccatcaggacggcttggtgcacatctccgccctgtccaacaagttcgtccaagacccgcgcgaagtggtgaaagctggcgacgtggtgaaagtgaaagtgctggaagtcgatgctgcacgcaaacgcatcgcgctgaccatgcgcttggatgacgaaccgggcggcgcaaaacataaaatgccgtctgaaaaccgcagccgcgaacggacagccggccgcaaaccccaacgcaacgaccgcgccccagccaattcggcgatggcggatgcgtttgcgaagctgaagcggtaaaataatcgaagagtttatggattttgacttatgcacacaccacttacctatattgaccttttctcaggagcaggaggcctatccttgggttttgaacaagccggattccaacaattgctttctgttgaaatggagtctgattattgtcagacttaccgtaccaacttcccccatcatcaattactgcaaaaagatttaaccacactaaccgaacaagatttaatcaattgtcttaacggacaagcagttgatttgattattggaggaccaccttgtcaaggttttagtatggcaggaaagattggacggacatttacagatgacccacgcaaccatttatttaaagagtttgtccgaatagttaaaattgtccaaccatatttttttgttatggaaaatgtagcgcgactctatacacacaattcaggtaaaacacgtattgagattattcaagcatttcagaatatcggttattcggtggaatgtaagatactgagtgcagccgatttcggtgttcctcagatacgtagccgagtgatatttatcgggaggagggataaaggcaaaatttcctttcccgaacctttgcagatttcccatcagactgttggatcagcaataggacattttccaaaactggctgctggcgaaagcaatccacacgttgcaaatcatgaagctatgaatcattcggcacaaatgttagaaaaaatggcatttgttaaaaatggaggtaaccgtaacgatattcctgaaccattacgtccgaaaacaggtgatatccgtaaatacatccgttacaacagcaacaaaaccagccgtttgtattacaggagatatgcgcaaagtttttcactatgaacagaatcgggcgttaaccgttcgtgaattagctgccttacaatctttccctgataattttattttttgcggcagcaaaattgcccagcagcagcaggttggtaacgccgtaccgcctttattggcaaaagctattgctgaaagtattttaaaaatgagtgaaaatgaataagcaatatccgaaaattaactatatcggtaataaagagaaaatagcttcctggatttgtgaccagcttccgtctgatgtagatacagttgcagatgtatttagtggaggctgttcctttgcctacgaagccaaaaaacgcggctatcgtgtgattactaacgatattttggcaattaattaccaaattgctttagcattaatagaaaacaaccatgaaacattaaatgacgatgatgtcgcaatgattttttcaggcagcccgcatgccggttttatgagtcagcgttatgccgaaaaattctattttcacgatgaataccaacaacttgatttgtaacgtaaaaatatagggaaactggataaccagtataaacgcgctttggcgtttactttaatgcgtcgcgccatgatacgtaaaatgccctatacggaagatatgcgcccaggcgataccgctaatccttatggtgcgtccaaagcgatggtggaacggatgttaaccgacatccaaaaagccgatccgcgctggagcatgattttgttgcgttatttcaatccgattggcgcgcatgaaagcggcttgattggcgagcagccaaacggcatcccgaataatttgttgccttatatctgccaagtggcggcaggcaaactgccgcaattggcggtatttggcgatgactaccctacccccgacggcacggggatgcgtgactatattcatgtgatggatttggcagaaggccatgtcgcggctatgcaggcaaaaagtaatgtagcaggcacgcatttgctgaacttaggctccggccgcgcttcttcggtgttggaaatcatccgcgcatttgaagcagcttcgggtttgacgattccgtatgaagtcaaaccgcgccgtgccggtgatttggcgtgcttctatgccgacccttcctatacaaaggcgcaaatcggctggcaaacccagcgtgatttaacccaaatgatggaagactcatggcgctgggtgagtaataatccgaatggctacgacgattaagttgacctgatacaggccgtctgaaagagatgttttcagacggcctctttatctgaaaaacacacattctgtctgctataatctgtttatattttttggctatcctctgaaatttatgagaaaaatccttgttaccggcggcgcgggctttatcggttctgccgttgtccgtcatattatccgaaacacccgggacgctgtcgtcaatgtcgataagctgacttatgccggcaatttggaatctttgactgaggtagccgataatcctcgctatgcttttgaacaagtggatatttgcgaccgcgccgaactcgaccgcgtattcgcgcaataccggcctgatgccgtgatgcacttggcggcggaaagccatgtcgaccgctctatcggttcggcaggcgagtttatccaaaccaatatcgtcggcacattcaatctgcttgaagcagcccgcgcctactggcaacaaatgccgtctgaacagcacgaagccttccgtttccaccatatttccaccgatgaagtctatggcgatttaggcggcacggacgatttgtttaccgaaaccgcgccctacgcgccgtccagcccctactctgcctctaaagcgtccagcgaccacctcgtccgcgcgtggttgcgtacttacggcttgccgaccattgtaaccaactgctccaacaactacggtccttaccattttccggaaaaactcattcctttgatgattctgaacgcgcttgacggcaaaccgctgcctgtgtacggcgacggtatgcaaatccgcgactggctgtttgtcgaagaccacgcgcgcgcactgtatcaggttgttaccgaaggtgttgtcggcgaaacctacaatatcggcggccacaatgaaaaagccaatattgaagtcgtcaaaaccatctgcgccctgctggaagaactcgctcccgaaaaaccggccggtgtggcgcgttatgaagatttgattactttcgtacaagaccgccccggccatgacgtacgctacgccgtcgacgcagccaaaatcaggcgggatttgggctggctgcctttggaaaccttcgagtccggcctccgcaaaaccgtgcaatggtatctggacaacaaaacctggtggcaaaatgtattgaacggcagctatcgtttggaacgtttaggtactggaaaatagttttcagacggcatcccgacgcaatgccgtctgaaaacccatcgcaaaggaagaaagaaaagatgaaaggcatcatactggcaggcggcagcggcacgcgcctctaccccatcacgcgcggcgtatccaaacagctcctgcccgtgtacgacaaaccgatgatttattaccccttgtcggttttgatgctggcgggaatccgcgatattttggtgattaccgcgcctgaagacaacgcctctttcaaacgcctgcttggcgacggcagcgatttcggcatttccatcagttatgccgtgcaacccagtccggacggcttggcacaggcatttatcatcggcgaagaatttatcggcaacgacaatgtttgcttggttttgggcgacaatattttttacggtcagtcgtttacgcaaacattgaaacaggcggcagcgcaaacgcacggcgcaaccgtgtttgcttatcaggtcaaaaaccccgaacgtttcggcgtggttgaatttaacgaaaacttccgcgccgtttccatcgaagaaaaaccgcaacggcccaaatccgattgggcggtaaccggcttgtatttctacgacaaccgcgccgtcgagttcgccaaacagctcaaaccgtccgcacgcggcgaattggaaattaccgacctcaaccggatgtatttggaagacggctcgctctccgttcaaatattgggacgcggtttcgcgtggctggacaccggcacccacgagagcctgcacgaagccgcttcattcgtccaaaccgtgcaaaatatccaaaacctgcacatcgcctgcctcgaagaaatcgcttggcgcaacggttggctttccgatgaaaaactggaagaattggcgcgcccgatggcgaaaaaccaatacggccaatatttgctgcgcctgttgaaaaaataatgtttgaggccgtctgaaacttttcagacggcctttagatgaaagataaaaagatgaacatcattgataccgccattcctgacgtaaaactgcttgagccccaagtcttcggcgacgcgcgcggcttttttatggaaaccttccgcgacgagtggtttaaaacccaagtctgcgaacgcaccttcgtgcaggaaaaccactccaaatccggcaaaggcgtattgcgcggcctgcactatcaaactgaaaacacacaaggcaaactcgtacgcgtggttgtcggcgaagtattcgacgtggccgtcgatatgcgtaaagactcccccactttcggcaaatgggtaggcgaaattctgtccgcagaaaacaaacgccaactgtgggtacccgaaggtttcgcacacggcttctatgtactgagcgatgaagccgagttcgtctataaatgcacagactattacaaccccaaagccgaacactcgctgatttggaatgatccgaccgtcggcatcgactggccgttgcaaggcgagccgaacctgtcgcctaaagacttggcaggcaaagtattgtctgaagcggtaacgttttaaaaataattcaggccgtctgaaagaatgttcctcttttcagacggcctacaatccattaataacaataatcgacgaaaacgcattgtgaaaaacgcctacatcccctctcgcggcatccgcaaaatcccccatctctccaccctattgcctgaatttcatatctgcaaagacgggaaagaagcagaggctgttgtcggctggggtttgcgcccgacgacacacaaagcgcgtgcttttgccgctgaacaccagcttccctttattgctttggaagacggctttttacgatcgctcggactgggtgtcgccggttatccgccctactctatcgtctatgacgacatcggcatctactacgacaccacacgtccttcgcgtttggaacaactgattcttgccgccgataccatgccgtctgaaaccttggctcaggcgcagcaggcgatggatttcatcctgcaacaccacctgtccaaatacaaccacgcgcccgaactttcagacgaccatcctttacgttccccatccaaacccgaaaccgtcctcatcatcgaccaaaccttcggcgatatggccatccaatatggcggcgcagacgcctctacgtttgaactgatgtttcagacggccttaaatgaaaacccgcaagccgatatctgggtaaaaacccatcccgatgttttgtgcggcaaaaaacaaggctatctgacccaactggcgcagcaacaccgcgtccatcttttggcagaagacatcaatccgatttctttgttgcaaaacgttgataaagtttattgcgttacctcgcaaatgggttttgaggcgcttttgtgcggcaaaccgctgaccactttcggcctgccgtggtatgccggatggggtgtaagcgacgaccgccatcctgaaatcaaccgccttgttcaaacccaacgccgcgccacccgcaacttgctgcagctcttcgccgcagcctatctgcaatacagccgctacctcaaccccaataccggcgaagcaggcagcctctttgatgtcatcgactatctggcgacggtcaaacgtaaaaacgacaaattgcgtggcgagttatattgcgtcggtatgtctttgtggaaacgcgcggttgccaaaccgttctttaacgtaccctcttgccgtctgaaatttatctcttccacccaaaaactggcaagggtcaaactgtccgacgatgcacgcatcctggcttggggcaacggcaaagaggccatcgtccgctttgccgaacaacaccacatccccctgctgcgcatggaagacggctttatccgctcggtcggactcggctccaacttagtgccgccgctgtcgctcgttaccgacgatatgagcatttatttcaatgccgaaaccccgtcccgtcttgaatacatcctacaaaaccaaaacttcgacgatcaagactttcagacggccttgaagctgcaaaaaatgctgaccgaaaaccacatcagtaaatacaacgtcggcagctcagacttcaccgccccgtcaaccgacaaaaccgtgatcctcgttcccggccaggttgaagatgatgcgtctatccgctacggttcgccccaaatctaccgcaatctggatttgctccgtaccgtacgcgaacgaaaccccaatgcctatatcatctacaaaccgcatcccgatgtagtcagcggtaaccgcatcggccatatttcccctgaagatgctgcacgatatgccgaccaaaccgccgaacaagccgacatcctgacctgtctccaatacgcagacgaaatacataccatgacttcgctgaccggttttgaagccttgttgcgcggcaaaaaagtcagctgctacggcctgcctttttacgcaggctgggggcttacccaagatctgctccccatcccgcgccgtagccgcagacttgagctttggcagctgattgccggcacgctcatccactatcccgactacatccaccccgaaacccatcaggccataaatgcagaaaccgcagcccaaatcctgatacgacaaaaaaatatgcaaaaaaacaacaacggattacatcgcgggtgctttgccaaaaaattaggtaaaatcaaacaactatatcgatctttcaaataaataccatcaaagttaacgatgcgtcataaacttgcctctattgcggcatcattgcctttgcatcgttaattctcttggcgtatgcttgaaagttcaacctaaaactattacataaaaaacaaaaccacattgcaacatgaaacagaccgtcctcaaaaataacctgcaaaacctgcttgaaagcgcagaaaatatcctgctgcttcaaggccctgtcggcgatttttttctgcgccttgccgactggctgactgcaaacggcaaaaccgtacataaattcaactttaatgcaggcgacgactatttttatccgcccactcaagcgcataccgttgtttttaacgacaactacgatgcctttcctgagtttttgcaagaatacatcactcaacatcacatccaggccgttgtctgctttggcgacacacgcccttatcacgtcattgcaaaacgcattgcaaacgaaaaccaagccagtttctgggcgtttgaagaaggctatttccgcccctactacatcaccttagaaaaagacggcgtcaacgcattttccccgttgccgcgccgtgccgacttttttcttgaacaattccctaagcttgcccagcaagaatataaagcgccaacgccggtacacggcggttttacgcccatggcaaaaaacgctatccgttactatatcgagttgttccgcaatccacgcaaataccccgactacatccaccaccgcgcacccaatgccggccattacctcaaaccgtggtcgctctccatcctcaagcgtttgaactactatattgaagacatccaaatcgccaaacgtgtggaagcaggcaaatacggcaagttttttattgttcccttacaggtattcaacgacagccaagtccgtatccattgcgactttcccagcgtccgcagcttcctgctccatgttttgagttcatttgccgagcacgcgcctgccgataccaacatcatcatcaagcatcatccgatggaccgcggttttatcgactactggcgcgacattaaacgctttatcaaagaacaccccgaactcaaaggccgtgtgatttatgtccatgatgtccccctgcccgttttcctgcgccacggtctcggcatggtcaccatcaacagcaccagcggcctgtccggactgattcacaatatgccagttaaggttctcggccgtgcctattatgatattcccggcattactgaccaaaataccttggcagaattttggaatcatccgacaccgcctgacaaagagctgttccatgcctaccgaatgtaccacctcaacgtgacccaaattaacggcaacttctacagtcaggtgtttttccccaacaaaaaaacctccaactcttccacaccagtaatctgacttagcgaaggaagttcaggccgtctgaaaacatttcagacggcctgaaacaatcaataccttagctactgccatgtaaataaaacacaaaaatctgcatttatcattaacaataaattacaaaaacagtataatgaccgagctgccatgagcgcataccgactcaacctgagccctttgtaacacacaaaatatggatatatccctaggcaaaacaatataacaagccaaacatcctaaagataagccggcaaggcaatacactctataaaactatgccgagcaaaatttttacaaagccctcaaccggtatcgccgcccatatgccgcagcatccgtcttccactttatatccgcccgcaaaccatgaccgccgctcctgatatcctctaccggcaagccgccgcccttttggaacaatccaataccgcccaagccctgcccctgttgcaacaggcggcagagcaaggttatgcggaagctgctttcgtattgggcaaccatctgctgcaaaacggccaaccggagcaggcactttcatggttggaagccgccgcggcccaacgccatcccaaagcactcttctccctgctgcaacaacgcgaacacaacggcaccccgaccggacagcttctcaacgactatgcctggctgggtgagcaggggcactcagaagcccaattaatcctcatgcgttaccacgcgcaacgcaacgatccacaatcgctctactgggcggaacttgctgccgcccgatatgccgcacctgcgtattaccatctggcacgccatcatcaacgccaaggcgacgttgaaacagccatcgaacaatacgaaaaagcggcagcactcggcgtaactgccgcctgctggcaacttggtcaaatctacttctacggtacaggtgtcagccccaaccacgcacaagccgaacactatctcgaaccagccgcacaagccggccacatcgccgcacaaacgctgctggctgaccttcttgccgcccaacgcaaacctgaagccttggaatggtatcgtcgtgccgccgataaggaacaagcggaagcacagtctaagctggcccaatacgccctgaccggcgaactttccgaacgcgatccgttccaagcggcacgatatgccaaagccgctgccgagaaaaaccatcctgaagccctgaaaatcatgggcgacctctaccgctacggtctcggtatcaaagccgacaaccatatcgcgcaagattactaccaccgtgccgccgcgctgggttctgccgccgcagcacaaaaactcatcagcgacgccgcgctgtaccatccgcaacaatacgaacaaatcaaaactgccgcctgcaacaacaacaaaccgaaaccatctaccgtttggcggaagcacaagcctgcgccatcggccgtcccgccgactacaatgccgcgcgaaaaaattacatggaagctgccgggttccaccataaaaacgcagcggcagccttaggccgcatctaccattacggcctcggtacggcgcaagatcctcgggcggctgcacactggtacgccattgctgccgaacaaaaccacccttccgcccaataccacctcgcctgtttttactatcacgggcaaggtgtcggctgtcatgttccgaccgcctgctactggctgcaggccgccatcggcaacggccacacttcggccgaatcattaatatccctattagaacaatggcgacgcgaagcacaccatgccatcggacaaaaggccgtctgaaaagatttacactcgcattttttgacaatctttaactattcccctaatatttgccagttatttttcacggacacgccattgttttcatttctttctgaaaacaccttgtccgcgcatcaataccatgacactcggcggataacgccaagcgttgaaacacactacatccggaacaaaaacggatgctcggaaaaatatttctaggaggtgaaacaacatggaatgggaattcaacagttattacacactgattgccgccacgctcgtgttgctggttggtaaatttctggttcaaaaaatcaaattcttacgagacttcaatattcccgagccggtagccggcggtttgattgccgctatcgtcctgttcgccctgcacgaggcgtacggcgtgagcttcaaatttgagaaaccgctgcaaaatgcgtttatgctgatttttttcacgtccatcggcttgagcgcggatttttcccgtttgaaggcgggcggtttgccgctggtggtttttaccgcgattgtgggcggatttatcttggtgcaaaactttgtcggggtcggactggctacggctttgggtttggatccgctcatcggtctgattaccggttcggtgtcgctgacgggcggacacggtacgtcaggtgcgtggggacctaattttgaaacgcaatacggcttggtcggcgcaaccggtttgggtattgcatcggctactttcgggctggtgttcggcggcctgatcggcgggccggttgcgcgccgcctgatcaacaaaatgggccgcaaaccggttgaaaacaaaaaacaggatcaggacgacaacgcggacgacgtgttcgagcaggcaaaacgcacccgcctgattacggcggaatctgccgttgaaacgcttgccatgtttgccgcgtgtttggcgtttgccgagattatggacggcttcgacaaagaatatctgttcgacctgcccaaattcgtgtggtgtctgtttggcggcgtggtcatccgcaacatcctcactgccgcattcaaggtcaatatgttcgaccgcgccatcgatgtgttcggcaatgcttcgctttcgcttttcttggcaatggcgttgctgaatttgaaactgtgggagctgaccggtttggcggggcctgtaaccgtgattcttgccgtacaaaccgtggtgatggttttgtacgcgacttttgttacctatgtctttatggggcgcgactatgatgcggcagtattggctgccggccattgcggtttcggcttgggtgcaacgccgacggcggtggcaaatatgcagtccgtcacgcatactttcggcgcgtcgcataaggcgtttttgattgtgcctatggtcggcgcgttcttcgtcgatttgattaatgccgcgattctcaccggttttgtgaatttctttaaaggctgattttccgcctttccgacaaagcacctgcaaggtttaccgcctgcaggtgcttttgctatgatagccgctatcggtctgcaccgtttggaaggaacatcatgtatcggaaactcattgcgctgccgtttgccctgctgcttgccgcttgcggcagggaagaaccgcccaaggcattggaatgcgccaaccccgccgtgttgcaaggcatacgcggcaatattcaggaaacgctcacgcaggaagcgcgttctttcgcgcgcgaagacggcaggcagtttgtcgatgccgacaaaattatcgccgccgcctacggtttggcgttttctttggaacacgcttcggaaacgcaggaaggcgggcgcacgttctgtatcgccgatttgaacattaccgtgccgtctgaaacgcttgccgatgccaaggcaaacagccccctgttgtacggggaaactgctttgtcggatattgtgcggcagaagacgggcggcaatgtcgagtttaaagacggcgtattgacggcagccgtccgcttcctgcccgtcaaagacggtcagacggcatttgtcgacaacacggtcggtatggcggcgcaaacgctgtctgccgcgctgctgccttacggcgtgaagagcatcgtgatgatagacggcaaggcggtgaaaaaagaagacgcggtcaggattttgagcggaaaagcccgtgaagaagaaccgtccaaacccacgcccgaagacattttggaacacaatgccgccggcggcgatgcgggcgtaccccaagccgcagaaggcgcgcccgaaccggaaatcctgcatcctgacgacggcgagcgtgccgataccgttaccgtatcacggggcgaagtggaagaggcgcgcgtacaaaaccagcgtgcggaatccgaaattaccaaactttggggaggactcgataccgacgtgcaaaaagagttggtcggcgaacaacgcaagtgggcgcaggaaaaaatcagcaactgccgacaagccgccgcgcaggcagaccggcaggaatacgccgaatacctcaagctgcaatgcgacacgcggatgacgcgcgaacggatacagtatcttcgcggctattccatcgattaggggcaaaccgatgaataccgtcccaaaaagcaggattcccgtcaaaccgctgcccgaaaaaaccacagacgaagccaaagtcgaaaaatggcggcagctcggtgcggaacacggtttgtcgggcgaatgggcagttgccgtcagattgggcgaaaacggttttaccgaagaacagatggaaaatatcgccaacctgttcggcagataaagagaaaattgacggaaatgccgtctgaaaccctgttatcggtttcagacggcattttgaccaatacggtacgcaggcgcaaaacagccggcttttcctgtgttgcctatgctgatgtttcaacacacaggacgatacaaaaaacgtcgccctatgtgccgtcctgattcggaagggttacgctccttccaaatatagtggattaacaaaaaccggtacggcgttgtctcgccttagctcaaagagaacgattctctaaggtgctgaagcaccaagtgaatcggttccgtactatctgtactgtctgcggcttcgttgccttgtcctgatttttgttaatccactataaatcgagcctaaaacaatgccgtctgaaacggaaatctgtttcagacggcattgttacattcaaacggcgggccgtttatttgaatttgtaggtgtattgcagaccgatgatgtcggcgtggtttttgaaacgtgcggaagacgcgcctttgctgtccacatcgttgccgcttgccttcgccgtgcggtagctggtgtcgttgatgtggatgtgggtgtaggcggcatcgacgacgtggtttttaccgatatggtatttcataccggcggagaaccagatgcggttgccgtcgggtaggctgttcatgcggtagtcggcgttgcggacgggcgatttgtcaaaagcgatgccggcgcgcagttgcagcggttcgctgatttgataagaaccgccgaagccgactttgtaggtgttgcgccagttgggggtgatggtggtgcggtcggatttgcctttgacgacggttttttctttttcaaaaaccagttccgccttatcgaagcggctgtggcgcgtccaagttacgtcgccgaacaggtcggctttatcggacactttgtacataccgtgtacggacaaagactcaggcgtaacgattttaacgcgggctttttcattcgccgtgtagccgtttgctgcaagcatcgtactccacattgctttcgccgccgcgccgtctgccgcccattcggcatcgcctttgagcgtgtgcgagactttggaacggtagttcacgcccacgcgcgcacggtcgttgatgtcccacatccacgccagttggtagccgaagccccaatcgctgcctttgacatcggcgtgtccgtcggcctgaatttttgcagcttcggctacaccgttaggtttgggcggttttgccgtcaatatctctgctttactcttaatcccccagtcggcatatttgcgcagttcggcggaagtatgttgggcgatgatgcctgcgccgaaggaatggcggtcgttgagtttccacgcggcgacaggttcgacggcgatgctggtcagaccgagtttgttgatgttgtggcgcaacacggaatctttttcgtattcggtggcagagccgaaggggacgtacacgcccaagcccacggtcagattgtcgttgactttgtatgcgccgtagatgtggggcgcgaccgtggttttggtgattttgccgcttttcgaaccttggacgggaagcccggtaaagtcggtggcggaatccgcctcataatgaatgctgggcagcacgatgttggcgttgacggaaatctggctgctgtcgagtttggtcaggccggcagggttgtagaagatggtcgatgcgtcggcggcttctgcggcggcggcatttgccgtgctttgcgcgttgaccgactgtgtgccgaagtggtagccggatgcgtggacggatgcggcggcaaaggcagtgccgagcagcaggacggtttttttcagtgcggaaggggtcatttcggtttccgtaaaaaggcggacggtggataaatatagtggattaacaaaaatcaggacaaggcgacgaagccgcagacagtacagatagtacggcaaggcgaggcaacgctgtactggtttaaatttaatccactataaaaaaggcagtcggaaatgccttgtttcgctttagtataggtactcgattttatccgatgttgccggatttgcacaattttttcagagtttgcccgaaccgccgcgccgccgcaaaaaatgccgtctgaagcctcgggcatcggcttcagacggcattttccactcagggcggattatttgacgcgcagcacttccagtgtgttggtcgaaccggattcgcgcatttgcgaaccgctggtaatgatgtattggtcgccggaatgcaggatgttgtgttccaccagcatcgtttcgacttcgtttaacgccgtgtcgtggtcggtactggttgccaaaatcagcgggcgcacgccccggtacatcgccatacggcgttgggcggaaacgctcggggtcagcgcgaaaatcggcagggtgatgttgtggcggctgatttcaaaggcggtcgaaccgctttcggtcagggcgacgatggctttggcgtgaaccgcgcgcgccacgctgaccgcaccgccggcaaccgccaggttggtgctgaccgcttcgggatactcgacctgttcggcaacgccgttgagcgaatcctgctctttttccgcagccgcgcagataatcgccatttggctgacggtttcaaacggatacgcgccgacggcggtttcggcggaacacatcaccgcatcggtaccgtccaataccgcgtttgccacatcgctgacttccgcgcgggtcggtacggggttggtaatcatcgattccatcatttgcgtcgccgtaatgctgaagcggcgcaactcgcgggcgcggcggatcatccgtttttgcagggcggggacggcggcgtgtccgacttcgaccgccaagtcgccgcgcgcaaccataatgccgtcgccggcgaggatgatttcgtccaagttttcaatcgcttccacgcgttcgattttggaaaccaaaccggggcgcacggccgtgctgcccttcatttcttcttcgactttggcgcgcgcgatatgcaaatcttcggcggatttcacaaagctgatggcgaggtagtcgcaaccgatggcaatcgcggttttcaggtcgcggaagtctttttcggtcaacgcgcctgcggacagaccgccaccgcgtttgttgatgcccttgttgcttttcaggacgtggctgttttccacccttgtgataatcctgctgccttcgacggattccacggtcagggtcagcaggccgtcgtccagccacaagacatcgcctgcggcaacgtcgtcgggcaggtcgcggtagtccaaaccgaccgcctcgcgcgtgccttcgccttcgagcgcggcatccagtaccagcgtttcgcctttgttcaattcgatgccgccgccggcgattttgcccacgcggattttcgggccctgcaggtcggcaatgatggcgatttcctgtccggcgcgttttgccgcctcgcgcacgatgagggcgttttcctgatggaattcgggcgtgccgtggctgaagttgaagcggacgacgttcagaccgccgacgcggatcatgtcttccaacagttcgacgttgttgctgcccggcccaagggtggcgacgattttagtgttgtggctgatgcgggtcagatcgcggcttgtctggttcatatgaaagtccttttggtctcaatcgggtgttttgcggtattttgttacaaaattacagaaatttggaaccggtttgatgtccatttgatgaacgcggcggaatattctgtaaaaatatgatttaaattaatagtttgatattttacctgcaaaccgccttttttggcgcaaaattacacggttttatgacttaggctaaatttattttggggctgtcctagataactagggaaattcaaattaagttagaattatccctatgagaaaaagtcgtctaagccggtataaacaaaataaactcattgagctatttgtcgcaggtgtaactgcaagaacagcagcagagttagtaggcgttaataaaaataccgcagcctattattttcatcgtttacgatgacttaatttatcaaaacagcccacatttagaaatgtttgatggcgaagtagaagcagatgaaagttattttggcggacaacgcaaaggcaaacgcggtcgcggtgctgccggtaaagtcgccgtattcggtcttttgaagcgaaatggtaaggtttatacggttacagtaccgaatactcaaaccgctactttatttcctattatccgtgaacaagtgaaacctgacagcattttttatacggattgttatcgtagctatgatgtattagatgtgcgcgaatttagccattttagcttcgctgaaacttcgttttcgtatcaatcacagcacacattttgccgaacgacaaaaccatattaatggaattgagaacttttggaaccaggcaaaacgtcatttacgcaagtctaacggcattcccaaagcgcattttgagctgtatttaaaggagtgcgaacgacgttttaacaacagtgagataaaagttcttgttccattttaaaacaattagtaaaatcgagtttatcttagttatctaggacagccccgtttgtgtactgaaatgcttcaaaacaccaaaccaagtttcgttttctaaaatacgaaaccattactgctgcctaaatttttttggattgctaaattatggcagtatgattttggattttaaattgaaaggcaagaaaaatgtcaaaaaatgatgtagttaaagtaattggtatattccccctattgtccgaacaatagagcagacttcccggcaggctgcccacatcagaacgcccgttcgctggtttgtacgtcctgaaaaagctcttgcattaagttaatcataatgggaaatttaaatttttttaatgcttacttaaacaaaagccccactccaccattaggagtttctttttcagtatacaagtaaatatttttaaaatattgatttaatttaaaataaaatacttgcaaaaaaagtattaaattaaacttaagaaaggttaattctgatttacatttccaaccatacttctttacaggagaaaatcatgaaagagttacacacctctgaattagttgaagtgtcaggtggcaaattccatatctttgcacagggtggcggcaacctaggtaaaaaagatatggttgctgttggtaaaattggtgcttcctattcccctaacaatagtggagtagagttttctgttagcaagcaatttggatatgtacaaggtcttggtgtacagttttcgaaacctacttttggtattagtaaaaaatggtaagattttttgttttatcctttctgacattaataaatctatgctcattaagcgcatgcaatagccactttacaggaaatatcaatccattaggtactcacaataaagttgctaatcccaattgtgccaatagtgccaatagtcatatcagacaacccagtaggaaaaactatgatccaactgaatatagtgcttggttacagtatatgcatgattgcaaataatgagtaacgatgaaaatttacttttttctcaaccacacttaacaaaggtgaatattatgcaagttttgactttgaatgaaatttaacaagtttctggtgctgcttgtaactggcgtgatttctcaaaaaataccattggtagtgcattaggtggagcagctggtggggcaattgttggttcatttgcaggtggtattggtgctattccaggtgcgaaattcggagctattggtggtgcaatcactggtgctgtacaatatggaagcacttgttggtggtaatattccttaataaaactagggtattttgatattttctattcaaaataccctagtttttcataagaacttaaatacaaaaaggaacaaataatgaaaaaatatagtgattattttaaatatttaatcttttttttgattttactcccaacaaattatctcgtatctcattatgtggtacaaacctcaatgagtatgttaagcattttaagttcttctataataacaacttgccttttttttgtttttacaaatttatcccaatcaaagaaacataaataagtacacatgtctaacaatcactcatttttcagaccagaagtctttgtagctcaacggaacaagtggacaggaccagtaggctgggttgacgcaatgggagctggtattttctctgttgctggcggatacaatatcggtcgtggcatgatgaagccataagataattacatcattaaggaaaaggtaatttcagttacagcaatatgtattgaagttacctttttctatttagattgaacaattttgaaagagaaaaattatgaatactgaaaccatttacgccactgtcttttgcattttagctgcaaccatttctggattattggttaaatttaatgtaattaaaatagaaacatcaatcaatagcaaatttatgttattaggcataagtattttaattattggtatttttctatccatttttttttaagaaataataataaatgtcccacttattccgaaaagaagtctttgtagcccaacaaaataagtggacaggtcaggttatcttgacccgtccattctcttttttatttctgactttttgcgcttttctcattgctctgtgtatcattatctttttgatttttggtagctataccaataaaacaaccgttgaaggtcaattacttccaactatgggggtggttcgtgtttactcttccgatatcggcacgattacgcataaatttgttgaagatggtaactttgtcaaagctggcgaaccattgttcaaactttccacatcgcgttttggcgaaaaaggaaacgtacaagccaaattggcagcagaagccaaccttaaaaaaactttggcattacaagaattggaacgtttaaagcgcattcatcaaaatgagcaaaaaaatgttcataacaacattcatcgtttaaacaatcaattagagaatattaaacagcaaattacagggcaaaatcgtcaaattcgtttagcggaaaaaacccttaacaagaacaagtttttagccagtcaaggcgcagtatcccaacaagataagatgaccgccgaaagccatttattggaacaacgctcacgtttggagagcctaaaacgtgaacaaaataatgcaatcagggaacttgatgaacagaaaatcacattaagcagcctgcctgaacgccataaaaccgaattgagccaactcaaccgtgcgattacggaaatgaaccaagaaattttggattttgatttgaaatccgaacaaaccatacgagctagtaaatcaggttgagacctttgcaaaaataatctgttaacgaaatttgacgcataaaaatgcgccaaaaaattttcaattgcctaaaaccttcctaatattgagcaaaaagtaggaaaaatcagaaaagttttgcattttgaaaatgagattgagcataaaattttagtaacctatgttattgcaaaggtctcaggttatatatcaacaattaatgttgatatagggcaacaagttgaaccgtctaaattgctgttaagcattgtccctgaacaaactgaattggtcgccaatctttacatacccagtaaagctgttggttttattaaaccgaaagataaagttgttttacgttaccaagcgtacccttaccaaaaatttggacatgccacaggagaaattatttcagttgccagaactgctctcggtaaacaaaagctatcaggtttaggtatcattttcactaacccaaccttattaaatgaacctgcctatcttgtgaaagttaaattggaaaaacaaacgattaaagcatacggagaaaacaagccgcttcaaattggcatgattttagaagcagatattctccatgaacgaaaaaattgtacgaatgggtacttgacccactttacagcatttcaggaaaaatcaattaaaaatggattatttatcaagactgtcctttggatttaacaaaaagctacctgtcattctgcaaacagaagttgctgaatgtggtttagcatgcctgacatccatcttgtcctattatggctttcacactgatttaagaacgttacgccaaaaatacaccctgtcattaaagggcgcaaatcttgcagacatcatgagatttggcaatgaaatgaatttaacgccacgagctttgcgtttagagttagatgagctgtcaaatttacaactaccctgcattctccattggaacttaaaccattttgttgtactttgttccatttccaaagacagtatcgtcattatggaccctgctgtcggtatgcgaaaaatcaaaatggacgaagtttcacaaaaattcacagggattgccctagaattattccccaatacccattttgaagagaaaaaagaaacaaagaaaatcaaaatattatctctattaagggggggtcaggcttaaaacgctctttaattcaaatgcttatattagctatttctttggaagtctttgcattggttagtccattctttatgcaatgggtaatagaccatgtcattgtaactgctgataaaaatttattattgacccttactttgggatttggtttactgactatcctgcaacagttaattagcctgttacaagcatgggtaggtatgcacctatctacaactcttaatttacaatggaaagccaatatatttaaaaggttacttgacttacctaatgactatttcagtaaacgacatttaggagatgtgatttcaagatttggttcaatagatcatatccaagaaacactaacttctactttttttgttttagttttaaatagcttaatggctgtttttactttcgtgttaatgacaatttacagcactcaattatcgctgattgttcttttaacacttgttttgtacatactaattcgttggcttgcatattacccattaagaaatgcaacagaagaaaatattgttcatgaagccaaacaaaactcatatttcatggaaaccattcgtggtatccaatcagttaaattatttgataaacattatcaaagacatggcacttggatgagcctatttgtgaatacagtcaataccaagctgacaacagataaactctctgctttatttgaattttcaaataaactgttgtttagcatggaaaatgttatcataatttatcttggtgcaagcgcaattttagatggttcatttacagtcggtgttctgatggcttttttggcttataaagggcaatttgaaagcagaacagcttctctcgttgaccaatacatccaaatcaaaatgttagggcttcatgctgaacgtttggctgacattactttaaatgaaacagaaactgaaattattaagtataatcatatacctaaattagataatgaacaactggttcttaaagttgaaaacgtctcattcagatatgctgataatgagccatatctttttgaaaacattaatttggaatttaaagataatgaagcagttgttttaacaggacaatctggtcgggggaagtccactttgttaaacattttaacaggtagcctaaaacctgaaactggtacagttagtattaatgggcatgatatatatcaagtttctccatcctttattaggggattgagcgggattgttcgccaagatgatgtcctttttgcaggttctattggggaaaatatttcattttttgatgaaagcccaaatatggagctcattgaacaatgtgcaaaaatggcacaaatacatgacgatatacttaaaatgccaatgggctatgagaccttgattggcgatatgggaaatatcttatcaggtggacaaaagcagagagttatcttggctcgtgcattgtataaacgacccaaaattctatttttagacgaagcaagtagccatttagatgtagaaaatgaacaaaaaattaaccataacctaaaaagtcttggtattatgaaaataatggttgcacaccgccaagaaacaattcaatcggcagataaaattctgaatttaggttgaacagaacaagacttcatttttctttaacaaaaagtgaagtcttttttcaaataatttaatagaatacatgaaaatagcggtttaacgttccatttcccaatcatcacgactggctttgtgttttggcgatttttcagtttcctttttctgttgaatttgttgttttttctgctcttgttcccatttttgggctaatttcacggtctcattttcagcccattccatcacggcacaacgatgtagcttttctccgatatcgccattaaagccagctccacgaacttcaccataaattcttgaatatttttgattatattcaatttcttttccattttctttaaaggatttctcccacttttcacaaacttcatcaaaatctttcaaagggatattttttaaggggctgtcctagataactagggaaattcaaattaagttagaattatccctatgagaaaaagtcgtctaagccagtataaacaaaataaactcattgaactgtttgtcacaggtgtaactgcaagaacggcagcagagttagtaggcgttaataaaaataccgcagcctattattttcatcgtttacgattacttatttatcaaaacagtccgcatttggaaatgtttgatggcgaagtagaagcagatgaaagttattttggcggacaacgcaaaggcaaacgcggtcgcggtgctgccggtaaagtcgccgtattcggtcttttgaagcgaaatggtaaggtttatacggttacagtaccgaatactcaaaccgctactttatttcctattatccgtgaacaagtgaaacctgacagcattttttatacggattgttatcgtagctatgatgtattagatgtgcgcgaatttagccattttagcttcgctgaaacttcgttttcgtatcaatcacagcacacattttgccgaacgacaaaaccatattaatggaattgagaacttttggaatcaggcaaaacgtcatttacgcaagtttaacggcattcccaaagcgcattttgagctgtatttaaaggagtgcgaatggcgttttaacaacagtgagataaaagttcttgttccattttaaaacaattagtaaaatcaagtttgtcctagttatctaggacagccccttgttttttgttcggcggcttgcgtggtcgggtaaaatgaaagttttgaacggttggtcggacaggaagatgtggcgggttttgagtgctttgccgataggcgtggtgttttttgatttgatctacggttttgtgttgaatgtgttgcagggtttggatttgcagcgtgccgtgccggattcggaaggcgtgttggcggttacgcccgatattgcattcaacagtttgcagattgtcgccaacggcggtatggcggcggtggtctgtttcgggttggcggttgtgtttttgctcaaccgttcggtgcggcggcggcaggtgttggaaatcggggtgttccggatgttggggctggtggcggtattggcgttcagcgcgccgtcggtgtgggagtgggcgaacgcgctgccgctgctgctgaagggcgcggacgtggtcaatacggggaatgcgcgttatgtgctgacggctttgtgtatgccctttccggcggtgtcgtgcgtcatcgggctggtggggcggttcaggcttcagacggcatcgggcagggcggcaaagtcagggggtgcgggcaaggcggacggataggacgcatttttcagcgggtgcgtcgagaagcagccgatgtgtttggcagccgcagcttggggggtgtagtgctaatggcggtttctttgcttttatagtggattaacaaaaaccagtacggcgttgcctcgccttagctcaaagagaacgattctctaaggtgctgaagcaccaagtgaatcggttccgtactatttgtactgtctgcggcttcgtcgccttgtcctgatttttgttaatccactatataaaataaatgggcaaaaatcggtttattatcgtttttgccgcatttggatttgttctaccgtaaaacgtgtttgacgaacgggattcttattaaaaaacatctgatttctaacaaaatcagtattttttggcacgatggctaaaatttttccttccatttcgccatcacgtgttttccatgcgctcaagaattgtgatttgctcattgagacgtgccccagcgatggatcagccagcaaaacagtttctccgttaataccgttcaataccgaaaaatggttgtttttacggtattttaaatacacaattacaggaatttttagttgtaccaactgttcaaatggcaaagcataaccttgtgcttcaaaacccagttcgggcattatgcgttgcatatcgtcaaaagaagcacgcatttgggttttatccattttgtctaagatttccgcttcagaataatgtctgccataaaaattattcagtaacgtggcaatcgaagccgcgccgcaagaaaaatccaaatcttgttttactatgccggaatctcgccgtgctttccaactccgtacatggatgttttggtaagaagcggggggtcaacaaacataggccaagcaaaaactatatttggggcgaaaccaatcaaagccgcataatttatcaatttataaagattttttatcataatatgtatacgcggaataaacgcatgaaacataaaaaaataaaatcatatgcaattttattgcatgaataaatatgaataaaatagataatgatgggagtaaatacgccatgtattttggaagtttaaatttattaataataaaataatttatcgtagcgcaaataaatcccaaaattggaacgattagaaaaaaaattaatacacccatcatcatgcaaactctatattaataaatagctaactaattctattgtggaaattagttagctaactaaaagttattaatgattattttcgagaattgactgcattgttggcagcattggcaccaaaacctagtgcatgaatacccggtctccatgccaaattcccagccaatccgcctccggcagcagcagccagccctgttttgccgctactcctgttgccgcaccgattcctgtcgcagtagccgcgccttgcgcagttcctaatttaccatgattatacaaattagcaccatgatacccccatgcacctaatgcaccgccaaaagcagcggctgcaataatgggaacaaattcaccttgtgtttctttcatttcagcctgtgataattgaattgctttcacattttggctgtcaaaaacttggctgtctaaattttgcgccattacaggtgtaatcatcatagccattacagttgcaattttcgttgcgctggtttgcacataaataggattagcaaattcgctttgattgcgttcagtgttgatgtagctaatactgctttctagtttgaatttacccttgtcagtcaataattcttccaaacttaaaggtaagtcagcataagcaatttggctggcaacagtcaaaataaaatctattagacatttgtgtttttgcatcatttcgtttgattttctaggttttgagaatgatacaaagttttttacaaagtaaagagtcactctgaaaaaacttttttcattataaatcaaaatattgatagaataaatagcgagcatcgattcacggtgcgctttagtgcaaagcgtacaacgcgagcctgaaccaccagccgcaacaggaaaagaaagccgatagagtgcaatgcttgccaacgtgcaagcgagcttgcaagaacgcttggctcaacgagagcaggcaagacagaaagcagaaagcaggataggagcggtaacgcaaaggtctcgggctttgatttcgccgtaaaccctgctgccgccttgtccggaaagggtgcaggcggcgagtgccgacagggtgcagatggggaggggggttttcatttggggtcgcaacggaagtggtatgcgcagatttcaaaaccgtttttgaaatacaggcggtgcgcgtcggcacggtcgtggttgacgtggacgttgaggtggattttggttacccctgtttccgcgccgattttgcggacttcttccaaaaggcgcgaggcgtagcctttgcggcggctttgcggcagggtaacgatgtcatcgatgtggatgtggcggccgctggcgagggtgcaggcttcgcggaagccgcagacggcgacggcattgtgtttgccttcttcaaaaatacccagcaggcggtagccttgggggcgttggactttgttgatctgttcggtaaagcggttgatgtcggtcagggcggaacgcaaaacgctcaaggctgcaaaggcggtggcggtgtcgtccgcgccgatttcgcgcaaaacgtaggatgcgcccgaggcggtctgttcctgtgctttctcggcggcgtgtttttcttcgattgcctgtgccagcatgacgtgttcgtcggcagggttgttttgtccgccctgttcgcgttcttcgagcagggctttgcagtcgatgacgcgcaggtcgttgtcggcggcaaagtccatcaggaagcggaacatttggggattgtcggtttccagttttttatcgacggcgacgcagcggatgttgtccaccagtatggggcgcacccatttcgaataggaaagcctgtggtctttggtgaacgaggacagaatgccgcacaggcgttccgcccagtcgctgggacggaaaatcttgccggaactcgttgtgccgtggatgacgacttcgtaggggttgcagactaacatggcggcttcctgaaaagaaatgtctagcgcgattataccttatgcttatgcgggcgtgtttggatatgccgtctgaaaagtacgggattcgtgcggtaaaactttgcggcggcaaatgtgcgataatacgcgccgtattgccgcttttgcgaagctgttccgcaaacatacgggcggcgtggacgacgtataaccggatacccgcctgacgcgggttttttacggaaggggggcaaaaatgcctaatccgctttacagacagcatatcatctccatttcggatttgtcgcgcgaacagttggaatgcctgcttcagacggcattgaagctgaaggcgcatccgcgcggcgacctgttggaaggcaaacttatcggttcgtgctttttcgagccgtccacgcgcacgaggctgtcgtttgaaacggcggtgcagcgtttgggcggcaaggtcatcggtttctcggacggcgcgaataccagtgccaaaaaaggcgagacgcttgccgataccgcccgcatcatttccggatatactgatgctatcatccaacgccaccccaaagacggcgcggcgcgcgtggcagcggagttttcgcgcgtccccgttatcaacgccggcgacggcacgaaccagcaccccagtcagacgctgctcgacctggttaccatttatgaaacacagggacgtttggacaagctcaaaatcgccatggcgggcgacttgaaatacggacgtaccgtgcattcgctttgtcaggcgttgaaacgctggaattgtgaatttgcctttgtttcgccgcccagcctagccatgcccgactatattaccgaagagttggacgaagccggctgccgataccgtatcctcggtagtttggaagaagcggcggaatgggcggatatcctgtatatgacccgcgtccagcgcgaacgtttcgacgaacaggaatttgccaaaatccaaggcaaattcaacctcgaagcgtctatgctcgcccgcgccaaaccgaacctgcgcgtgctgcaccccctgccgcgcgtggacgaaatccatcccgatgtcgatgccacgccgcacgcctattatttcgagcaggcgaccaacggcgtttatgcgcgtatggcgatattgtcgctggtgttgaacgaagaagtgtgaggaaccgatatggaaaccccgaaactcagtgtcgaagccattgaaaaaggtacggttatcgaccatattcccgccggcagggggctgaccatcctgcgccagttcaaacttttgcactacggcaacgcggtaaccgtgggcttcaacctgcccagcaaaacccaaggcagcaaagacatcatcaaaatcaaaggcgtgtgcttggacgacaaagccgccgaccgcctcgccctgttcgcccccgaagcggtggtcaacaccatcgacaatttcaaggtcgtgcagaagcggcatttgaacctgcccgacgaaatcgccgaagtgttccgctgtccgaacacgaattgcgccggccacggcgagccggtcaaaagccggttttatgttaaaaagcacaacgggcagacgcggctgaaatgccactactgcgaaaaaacctacagccgggattcggtggcggaagcctgacggattcccttaaaccgagtgggcggcatttcgtctgccgcctgttttgccaatctgaaatggaatgatgatgcacgcttctgtccaaagccgtttcgcaccgatactttatgttttgattttctttgccggttttttgaccgcgcaaatctggttcaatcagaaagcctatactgaagagctgcctccgcttctgtccgcattgtccgccgtcgcgctggtgtggctggcgtgggcgttcgtgtcggcgcgttcaaaggccaaggcggaaaagttctaccgcgaaaaaatgatacagaacgaaagcatacaccccgtcctgcacgcctctttgcaacacttggaacacaagccgcaaatactcgccctgctggtcaaaaaccacggcaaagggatggcggaacaggtcaggttcaaggcggaagtgctgcccgacgacgaagacgcgcgcacgattgccgccgagttggcaaaaatggatatgttcgcattggggacggacgcggtcgcctcgggcgaaacctatggacgcgtgttcgccgatattttcgagttgtcggcggctttggaagggcgcgcgttcaaaggaatgttgaaactgacggcggaatataaaaacatcttcggcgatgcctgccgttcggaaacggcgttggagttgggcgcactcaatcaggcgttgcaggagatttcaaaaacatcggaaaagtccaaacggatattttattgaagatggaaaaatgccgtctgaaacggaaggtgtttcagacggcatttttgtcggatgattaattattcggagcggttgaagccaaacttcacgcggctgcggccctgatccggtatattgtccaaatcgcgtcccggattggcggcggtgtcgcctacggaaatatcggagatgttttccaaaatgatggcggacgacaggtgttcggaggtgcggtaaaccattgccaagcccacttcttcggcaggagtggaaatcagctcgacggtatccctgcttttgaaattgttggagaggtcgacctgcatcgttttcttgcgtttgtagaggctcaaaaccgtgcctttgtccaaaccgtccgcctcgcctttgtcgatggtgatggtttgaaactggccggcaatccttgtgccttcaaacacggaaacgattttagcctgaaccgggcgggacggttcgtgcggcatcatgttgaagcggtcggtgtcttccggcattttcatcaggtagtcgccctgctgtatttcggaaatggcggtttcgaccaccagcggctgtatcgaaggggtgcgcagcggggtaatcaaaggatgggtgcgggtatggtattcgttgtctttcggccgttctccagcctgtttcgagcgttgttcgaggacagagtcggtatagtcgagggagcgcacgatgccgctgaatgcgacttcctgcccgaggaatttacccgtatccggatcggtgatgtttttattgattcggtaggtcaggtagcggcccggctctttcaggcctttggtgtaaaccctggtgcctttggtgtacagcagcctgccttccgggcccgagagcaggcgcggcgcggcagcggtttctttgcgggaaacgatttgcggatgccgcataaagatgcggtagaagttgacatcgatggcgggaataccgtatccggacacttccttatccggactcattttgacgacggggatgccgtctgtctgttccaagccgaggcgcggttcgccgtcaacgtggcgcaacaccaatacctggtccggataaatcaggtcgggattgtggatttgatcccggttcgcgtcccacaggcggccccattgccacgggctgtacaggtatttgcccgaaatgccccacagggtgtcgccctgtttgaccgtgtagcgttccggcgcgttcgggcgcacctccaaatttgccgccaaagtttgtgttgagaatgccatacctgccgcgcagagcagggttataatacgacgttgcataaccgttccccttatctgataaatttcggtttgtcttgcttgattgggttggaaaaagcggcggcagcccctcgggatgtgccgcgtgataaaaaatgttccgcattttaacatcgaattatccgcaccatcacggtaattatgaaaaacaggcggcgtatccgccgaaggaaagagaaaattatggctttattgaatatcttgcaatatcccgacgagcgtctgcacacggtggcaaagcctgtcgaacaagtcgacgagcgcatccggaagctgattgccgatatgtttgaaacgatgtacgaatcgcgcggcatcgggctggcggcgacgcaggtcgatgtgcacgagcgcgtggtcgtgatggatttgaccgaagaccgcagcgaaccgcgcgtgttcatcaaccccgtcatcgttgaaaaagacggcgaaaccacttacgaagagggctgcctgtccgtgccgggcatttacgacaccgtaacccgcgccgaacgcgtcaaggtcgaggctttgaacgaaaaaggcgaaaagttcacgctggaggcggacggcttgttggcgatttgcgtgcagcacgagttggaccacctgatgggcatcgtgtttgtcgaacgcctttcccaactcaagcaggggcggattaagaccaagctgaaaaaacgtcagaaacatacgatttgacccttttgccgtgccgtctgaacgctgcaaagttttcagacggcacggtcttgtccgacaattttacgcacgcgcaggaacacgctatgaaagtcatcttcgccggcacgcccgattttgccgccgccgccttaagagccgttgccgccgccggttttgaaattccgctggtgctgacccagcccgaccgtccgaaagggcgcggtatgcaactgactgccccgcccgtcaaacaagccgcgctggaactcggtttgcgcgtcgaacagcccgaaaagctgcgcaacaacgccgaagccctgcaaatgctcaaagaggtcgaggcagacgtaatggtggttgccgcctacggtttgattctgccgcaggaagtgttggatacgccgaaacacggctgcctcaacatccacgcttcgctgttaccccgttggcgtggcgcggcgccgattcaacgcgcgattgaagccggcgatgccgagacaggcgtgtgtattatgcagatggacatcggtttggacaccggcgatgtggtcagcgaacaccgctacgccatccaaccgaccgataccgccaacgaagtccacgacgcgctgatggaaatcggtgcggcggcggttgttgccgatttgcaacagcttcaaagcaaaggccgtctgaacgcggtcaaacagcccgaagaaggtgttacttacgcgcaaaaattgagcaaagaagaggcgcgtatcgattggagcaaaagcgcggcggttatcgaacgcaaaatccgcgccttcaaccccgtgcctgccgcgtgggttgagtatcagggcaagccgatgaaaatccggcgggcggaagtggtggcgcaacaaggcgcggcaggcgaagtgttgtcctgttcggcggacggtttggtcgttgcctgcggcgaaaacgcgctgaagattaccgaattgcagcctgccggcggcaggcggatgaatatcgcggcgtttgcagcaggacggcatatcgaagcaggggcgaagctgtaaatcccttcagacggcattccgatccgcaaacgggaatgccgtctgaaaccatcagtcgaagaaagcgaatcacataatatgagtatggcacttgcccaaaaacttgccgccgacagcattgcggcggttgccgaaggacgtaaccttcaggacgtgttggcgcaaatccgcaccgcgcatcccgaccttatggcgcaggaaaacggcgcgttgcaggacatcgcctacggctgccagcgttatttgggcagtttgaaacatatgctcgcgcagatgctgaaaaagccgattggcaatccgcagctcgaaagcctgcttttggcggcgttgtaccagctgcattacacgcgcaacgcgccccacgccgtggtcaatgaggcggtggaaagcatcgcgaaaatcggacgcgggcagtaccgttcgtttgccaacgcggttttgcgccgctttttgcgcgaacgcgacaagcttgtggcttcctgtaaaaaagacgatgtagcgaaacacaacctgccgctgtggtgggtggcttacttgaaaaaccattatccgaaacactggcacaacatcgccgccgcgctgcaatcccatccgccgatgactttgcgcgtcaaccgccgacacggcaatgccgaaagctatttggaaaaactggtggcggaaggtatcgcggctaaggcgttggacgaatatgcggttacgttggaagaagccgtgccggtgaaccgcctgcctggtttttcagacggcattgtttcggtacaggacttcggcgcgcagcaggcggcgtatttgttaaacccgaaagacggcgaacggattttggacgcgtgcgccgcgccgggcggcaagacggggcatatcttggaactggcggattgccgtgttaccgccttggacattgatgcaggccgtctgaaacgggtggaagacaatatcgcgcgtctgggctttcagacggcatcgacggcgtgtgccgatgcacaggacctgtcggcatggtatgatgggaaaccgtttgatgccgtccttgccgacgtgccgtgtaccgcctcgggcgtggcgcggcgcaatcccgacgtgaaatggctacgccgtccgaccgacgcgctcaaaaccgcccgccagcaggaagccctgctagatgcattgtggcaggtgctgaaaagcgggggaaggatgttgatcgctacctgttccgtgttcgtcgaggaaaacgacggacaattgcaaaaattcctcaaccgccatgccgatgcagaactgatcgaatcgcgggtactcttaccgaacaaacaccaagatggcttttattacgcgcttattcaaaagcagtaaatggctgattgtgccgctgatgctccccgcctttcagaatgtggcggcggaggggatagatgtgagccgtgccgaagcgaggataaccgacggcgggcagctttccatcagcagccgcttccaaaccgagctgcccgaccagctccaacaggcgttgcgccggggcgtgccgctcaactttaccttaagctggcagctttccgccccgataatcgcttcttatcggtttaaattggggcaactgattggcgatgacgacaatattgactacaaactgagtttccatccgctgaccaaccgctaccgcgttaccgtcggcgcgttttcgacagactacgacaccttggatgcggcattgcgcgcgaccggcgcggttgccaactggaaagtcctgaacaaaggcgcgctgtccggtgcggaagcaggggaaaccaaggcggaaatccgcctgacgctgtccacttcaaaactgcccaagccttttcaaatcaatgcattgacttctcaaaactggcatttggattcgggttggaaacctctaaacatcatcgggaacaaataatgcgccgttttctaccgatcgcagccatatgcgccgtcgtcctgttgtacggactgacggcggcaaccggcagcaccagttcgctggcggattatttctggtggattgttgcgttcagcgcaatgctgctgctggtgttgtccgccgttttggcacgttatgtcatattgctgttgaaagacaggcgcgacggcgtattcggttcgcagattgccaaacgcctttctgggatgtttacgctggttgccgtactgcccggcgtgtttctgttcggcgtttccgcacagttcatcaacggcacgattaattcgtggttcggcaacgatacccacgaggcgcttgaacgcagcctcaatttgagcaagtccgcattgaatttggcggcagacaacgccctcggcaacgccgtccccgtgcagatagacctcatcggcgcggcttccctgcccggggatatgggcagggtgctggaacattacgccggcagcggttttgcccagcttgccctgtacaatgccgcaagcggcaaaatcgaaaaaagcatcaacccgcacaagctcgatcagccgtttccaggtaaggcgcgttgggaaaaaatccaacgggcgggttcggtcagggatttggaaagcataggcggcgtattgtacgcgcagggctggctgtcggcgggtacgcacaacgggcgcgattacgccttgtttttccgtcagccggttcccaaaggcgtggcagaggatgccgtcttaatcgaaaaggcaagggcgaaatatgctgagttgagttacagcaaaaaaggtttgcagacctttttcctggcaaccctgctgattgcctcgctgctgtcgatttttcttgcactggtcatggcactgtatttcgcccgccgtttcgtcgaacccgtcctatcgcttgccgagggggcgaaggcggtggcgcaaggcgatttcagccagacgcgccccgtgttgcgcaacgacgagttcggacgcttgaccaagttgttcaaccacatgaccgagcagctttccatcgccaaagaagcagacgagcgcaaccgccggcgcgaggaagccgccaggcattatcttgaatgcgtgttggaggggctgaccacgggcgtggtggtgtttgacgaacaaggctgtctgaaaaccttcaacaaagcggcggaacagattttggggatgccgcttacccccctgtggggcagcagccggcacggttggcacggcgtttcggcgcagcagtccctgcttgccgaagtgtttgccgccatcggcgcggcggcaggtacggacaaaccggtccatgtgaaatatgccgcgccggacgatgccaaaatcctgctgggcaaggcaaccgtcctgcccgaagacaacggcaacggcgtggtaatggtgattgacgacatcaccgttttgatacacgcgcaaaaagaagccgcgtggggcgaagtggcgaagcggctggcacacgaaatccgcaatccgctcacgcccatccagctttccgccgaacggctggcgtggaaattgggcgggaagctggatgagcaggatgcgcaaatcctgacgcgttcgaccgacaccatcgtcaaacaggtggcggcattgaaggaaatggtcgaagcattccgcaattatgcgcgttccccttcgctcaaattggaaaatcaggatttgaacgccttaatcggcgatgtgttggcattgtatgaagccggtccgtgccggtttgcggcggagcttgccggcgaaccgctgacggtggcggcggatacgaccgccatgcggcaggtgctgcacaatattttcaaaaatgccgccgaagcggcggaagaagccgatgtgcccgaagtcagggtaaaatcggaaacagggcaggacggtcggattgtcctgacggtttgcgacaacggcaaagggttcggcagggaaatgctgcacaacgccttcgagccgtatgtaacggacaaaccggcgggaacgggattgggtctgcctgtggtgaaaaaaatcattgaagaacacggcggccgcatcagcctgagcaatcaggatgcgggtggcgcgtgtgtcagaatcatcttgccaaaaacggtaaaaacttatgcgtagcagcgatattttaattgtagacgacgaaatcggcatccgcgacctgctgtcggaaatcctgcaggacgaaggttattcggtcgcattggcggaaaacgccgaagaggcgcgcaagctgcgccatcaggcgcgccccgcgatggtgctgctggatatttggatgcctgattgcgacggcatcacccttttgaaggagtgggcgaaaaacgggcagctcaatatgccggtggtgatgatgagcgggcatgccagcatcgataccgccgtggaagccaccaaaatcggcgcgatcgattttttggaaaaaccgatttccctgcaaaagctgctgtctgccgtcgaaaacgcgttgaagtacggtgcggcgcaaaccgaaacggggcctgtattcgacaagctgggcaacagtgcggcgattcaggaaatgaaccgtgaggtaggggctgcggtgaaatgtgcctctcccgtacttttgacgggcgaggcgggttcgccgtttgaaacggtggcacgctatttccataaaaacggtacgccgtgggtcagcccggcaagggtcgaatatctgatcgatatgccgatggaactgttgcagaaggcggagggcggcgttttgtatgtcggcgacatcgcccagtacagccgcaacatccaagccggtattgcctttattgtcggaaaggcggaacaccgccgcgtcagggtggtcgcatcgggcagcagggcggcaggttcagacggcattgcctgcgaggaaaagctggcggaactgctgtcggaatcggtcgtccgtattccgccgctgcgtatgcagcatgaagacattcccttcctgatacaggggattgcctgcaatgtggcggaaagccaaaagattgcgcctgcctcattcagtgaagaggcacttgccgcattgacccgttacgactggccgggaaatttcgaccaactgcaaagcgtcgttgcaacgctgttgttggaggcggacggacaggaaatcggcgcaggggcggtttcttcccttttggggcagaatgtgcctgccgagggggcggaagatatggtgggcgggtttaatttcaacctgcccctgcgcgaattgagggaggaggtggagcggcgttatttcgagtaccacatcgcccaagaaggtcagaatatgagccaagtggcgcagaaagttggtttggaacgcacgcacctttaccgcaaactcaaacagctcggcatcggcgtttcgcgccgggcgggggaaaaaaccgaagaataggcccggacggccggtttaccggctgcgggcttttgttttcagacggcatttggtgcaaatgccgtctgaaatcgtaaggggacggattttatgacagaggacgaacgtttcgcgtggctgcaattggcgtttacgccctatatcggcgcggaaagtttcctgctgctgatgcgccgtttcggcagcgcgcaaaatgccctgtccgcaccggcggaacaggtggcggcactgatacggcacaaacaggcgcttgaggcttggcgcaatgcggaaaaacgcgctctggcgcggcaggcggcagaagcggcattggaatgggaaatgcgggacggatgccgcctgatgctgcttcaggatgaagattttcccgaaatgctgacgcaggggctgaccgcgccaccggttttgtttttgcgcggcaacgtgcaactgctgcacaaaccttccgccgccatcgtcggcagccgtcatgccacgccgcaggcgatgcggattgccaaagatttcggcaagtcgttgggtgggaaaggcattcccgttgtgtcgggtatggcttcgggcatcgataccgccgcccatcagggtgcgttgcaggcagaaggcggcaccatcgccgtgtgggggacgggcatagaccgcatttatccgccggtcaacaaaaaccttgcctatgaaatcgccgaaaaaggattgattgtcagcgagttccccatcggcacgcggccgtatgccggcaattttccgcgccgcaaccgcctgattgccgccctgtcgcaagtaacgctggtggttgaagccgcgttggaatccggttcgctgattactgccagattggcggcggagatggggcgcgaagtgatggcggtacccggctcgatagacaatccacacagtaaaggctgccacaaactgattaaagacggcgcaaaattggtggaatgcctggacgacatcctgaacgaatgcccggggctattgcaaaatacgggtgcttcatcatattctataaataagggaatacctgaaaagcgcatcactgccgttcagacggcatccgaccagctgtctctgcctgaaggcaaaatgccgtctgaaaagacggagaaccgacccgtcggcggcagtatcttggacaggatgggtttcgacccagttcatcccgacgtgcttgccggacagttggctatgcctgccgcagatttgtatgccgcactgttggaattggaattggacggcagcgttgccgcaatgcccggcggcagataccagcgtatccgaacttgaacgcactttatattaaggaacacgaatgaccgaagtcatcgcctacctcatcgaacatttccaagatttcgatacctgcccgccgcccgaagacttgggtatgctgcttgaagaagcgggtttcgatacgatggaaatcggcaacaccctgatgatgatggaagtattgctcaacagctccgaattttccgccgaacccgccgacagcggcgcattgcgcgtgtacagcaaagaagaaaccgacaacctgccgcaggaagtgatggggctgatgcagtatctgattgaagaaaaagccgtcagctgcgaacagcgggaaatcatcatccacgcgctcatgcacattccgggcgacgaaattaccgtagataccgccaaagtgctgaccctgctgcttttatgggcaaacaagagcgagctgcccgtgttggtcggcgacgagctgatgagcgcgcttttactcgacaacaaacccacgatgaactgaagcggcttcagacggcccgcccgagtccgtctgaaacgtcggcatcaaaaccaccatccagagaacgacaaatggcgaaaaacctattaatcgtcgaatccccgtccaaagccaaaaccctgaaaaaatatttgggcggcgattttgaaatccttgcatcctacggacacgtccgcgacctcgtccccaaaagcggcgcggtcgatcccgacaacggctttgcgatgaaataccaactcatcagccgcaacggcaaacacgtcgatgccatcgtcgccggtgccaaagaagctgaaaacatctacctcgccaccgacccggatagggaaggcgaagccatttcctggcatcttttggaaatcctcaaatccaaacgcggcttgaaaaacatcaagccgcagcgtgtcgtgttccacgaaatcaccaaaaacgccgtgctcgatgccgttgcccatccgcgcgaaatcgaaatggacttggtcgatgcgcaacaagcccgtcgcgctttggactatttggtcggtttcaacctttcgccattgttgtggaaaaaaatccgtcgcggtttgagcgcgggccgtgtacaaagccccgcactgcgtttgatttgcgaacgcgaaaacgaaatccgcgcgtttgaagcgcaggaatattggacggtacatctagacagccacaaaggccgcagcaagttcaccgccaaactcgcccaatacaacggcgcgaaactcgaacaattcgacctgccgaacgaagccgctcaagccgatgtgttgaaagaactcgaaggcaaagaggccgtcgttaccgccatcgaaaagaaaaagcgcagccgcaaccccgccgcgccgtttaccacatccaccatgcagcaggatgctgtgcgcaaactcggcttcaccaccgaccgcaccatgcgtaccgcccagcagctttacgaaggtattgacgtagggcagggtgccatcggtctgattacctatatgcgtaccgacagcgtgaacttggcggatgaagccttaaccgaaatccgccattacattgaaaacaaaatcggcaaagaatatctgccgagtgccgccaaacaatacaaaaccaaatccaaaaacgcccaagaagcgcacgaagccatccgcccgacttccgtgtaccgcacgcccgaaagcgtcaaacccttcctgagcgccgaccagttcaaactctatcaaatgatttggcagcgtaccgtcgcctgtcagatgacgcccgccaaattcgaccaaaccaccgtcgatattaccgtcggcaaaggcgtattccgcgtaaccggacaagtgcaaaccttcgcaggcttcctcagcgtttacgaagaaagcagcgacgatgaagaaggcgaagacagcaaaaaactgcccgaaatgagcgaaggcgacaaattgcccgtggacaaactctacggcgaacaacactttaccactccgccgccacgctacaacgaagccacgctggttaaagccctcgaagaatacggcatcggccgcccctcgacctacgccagcatcatctccacgctcaaagaccgcgaatacgttacccttgagcaaaaacgctttatgcccaccgacacaggcgacatcgtcaataaattcctgaccgaacacttcgcccaatacgtcgattaccacttcactgccaaactcgaagaccagcttgacgaaattgccgacggcaaacgccaatggattcccttgatggacaaattctggaaaccgttcatcaaacaagtggaagaaaaagaaggcatcgaacgcgccaaatttaccacgcaggaacttgatgaaacctgcccgaaatgcggcgaacacaaactgcaaatcaaattcggcaaaatgggtcgttttgttgcgtgtgccggttatcccgagtgcagctacacgcgcaatgtcaacgaaaccgccgaagaagctgccgaacgcatcgccaaagccgaagccgaacaggccgaactcgacggacgcgagtgcccgaaatgtggcggtcgcctagtgtacaaatacagccgcaccggcagcaaattcatcggctgcgtcaactatccgaaatgcaaacacgtcgagccgctggaaaaaccgaaagataccggcgtccagtgtccgcaatgcaaaaaaggcaacctcgtcgagcgcaaatcccgctacggcaaactgttttacagttgcagcacctatcccgactgcaactacgccacttggaacccgcccgttgccgaagaatgcctgaactgccattggccggtcttgaccatcaaaaccactaaacgctggggtgtagaaaaagtctgcccacaaaaagaatgcggctggaaagaacagattgaaccgcccgcgccgaaggagtaagattaggttggtttgaaagagaaaaggtcgtctgaaaaattttcagacgacctttgcttttctgtgattggtttatttgaatccgcgtgttgttttaaagtccgataaaatccggttcatttcaggcgcaaacaaggcgatgtaatcgtaagatagaccgcgactggcactgggatggggaaagcagacgacttcgcaatcttcaaacgattggaatttgacattgaaacgtgtaccgtcaaattctttttgcaccgtctccagcggtttggtctgcttaccgaccaactgctcgaagcgtggcagtacattttggttgttcagaaaatccgccaacctgctgcccatgaagaggatgactttcggacgcagtttttcgatgtggtagagaaaattatcgatgtgctcgggttgtgtgaacttgtcgggattgtcgatagtgttgccctgtgtagcagcccagttggtttgaaccagggatttttcaaatgcaccgcccaatccattttcgtctaaggggtgtccccacatttcaaaccaattttttatcgtattgtcgtaacgccacttttttgcctgctctccgaaatagagggatttgtttgcaaatgtatggtcgattttgttttcagggagtttgtattcacctgctacataagcagcctcatcggctttactccaaccccattcatagccacaaatcattaagccatgtttgtcgttgtagcctttgaacaggctgttgctcaaattcaaatccttcatcatgaactcttccttttaaaatttaagagcgattgacttcaatgtttttagatggggtggaaaaatccttgtgtaggcaacataaattcaataaatttcttgataattcgaaacctactaatagcgcacctataaaagctttttcattacgttcagcatgacggtcacgtcgttcatattttttacgcttgctgttccctgttattacagctaagccaagtgatatggcgagaattgcccaaacaatagtacttaataacaattttccccatactatcaataaggaaagaaaaaaccttttagtattagatcgataggttataatccatgcccatgaaaatgcaataagagttatacataagatacaagctgacaggatttctttatttttaattaaataacttagagcgatgaggatgacaggtgtcaagaaaataatagttacatcccgatagctataaaagaaaactgccctattttgaatgtggagatgtgcacagaatccaatatagctaaggataatagttaatataataaaaaaagaccaccaagggtgaagagataggaattccatgttttccctttttttgtaaaaaggaaaaaatcttatctaatagttaattgcctaaccagccagaagaagtttaaaatctatcccaataattcaaccatctatacagaaagttcagcttatggaaacccacgaaaaaatccgcctgatgcgcgaattgaataaatggtcccaggaggatatggcggaaaagctggcgatgtcggcaggcgggtatgccaaaatcgaacggggcgaaacgcagttaaatatcccgcgtttggagcagttggctcagattttcaaaatcgatatgtgggacttgctcaaatcgggcggtggtgggatggtgtttcagattaatgaaggtgatagtggtggcgatattgcgttgtatgcgtcgggtgatgtttcgatgaaaatagaatttttaaaaatggagttgaaacactgcaaagaaatgttggaacaaaaagacaaagaaatcgagctgctccgcaagctgaccgaaaccgtttaaacagatatgccgtctgaaaaaagttttcagacggcatattctttgacaggtcttgtataataccgtttgaacttacaggtttttgattatggcggcaggcaaacataccaaacacagcaaccgggtacgcattatcggcgggcaatgccggggcaggaaattgagtttcacatccgccgacggactgcgtccgacacccgacagcgtgcgtgaaaagctgtttaactggctgggacaggatttgacgggtaaaacggttttggatctcttcggaggcagcggcgcactcggtatagaagccgcttcgcgcaacgccaaacgcgtgctgatttcggataacaaccgccaaaccgtgcagaccttgcagaaaaacagtcgcgaactgggtttggggcaggtgcaaatcgtcttttcagacggcatcgcatatttgaagaccgtatccgaacagtttgatgttgtctttctcgacccgccgtttgcatggcaggactggcaaatcctgttcgatgccttgaagccgtgcctgaacccccgggcattcgtctatctcgaggcgggtacgctgccgaatattcccgattggctgacggaatatagagaagggaaatcggggcagagtacatttgaattaagggttttccaagtggctgaataatatgcgctttgataatcatttccgagttgtaaacattcgtttgcaaccgtccggttcaaaaaaaccttgtgctataatccgcgcccgcccggttttgataatttagtggaaaaggaaaagaaatgtcgctttttattaccgacgagtgcatcaactgcgacgtatgcgaacccgaatgccccaatgatgccatttcccaaggcgaggaaatttacgaaatcaaccccaacctctgcacgcagtgcgtcggacactacgatgagccgcagtgccagcaggtttgcccggtggactgcatcctgattgacgaagaacatcccgaaacccatgacgagttgatggcgaaatacgaaaagattatccagtttaaataaattctttttaaaacatcaaattatgtctgttttgaaataaaatcaaaaaaaaacttgacggaaaagcaagccgctaataaactaacgttctcttttggagggattcccgagcggtcaaagggggcagactgtaaatctgttgcgaaagcttcgaaggttcgaatccttctccctccaccaaaattcttacttggggcagtagcgagtaatgcgggtgtagctcaatggtagagcagaagccttccaagcttacggtgagggttcgattcccttcacccgctccaaacaattaggcccatgtagctcaggggtagagcactcccttggtaagggagaggtcggcagttcaaatctgcccatgggcaccatctctcgattattcatttctttaaggcttagatatataggatattgccatggctaaggaaaaattcgaacgtagcaaaccgcacgtaaacgttggcaccatcggtcacgttgaccatggtaaaaccaccctgactgccgctttgactactattttggctaaaaaattcggcggtgctgcaaaagcttacgaccaaatcgacaacgcacccgaagaaaaagcacgcggtattaccattaacacctcgcacgtggaatacgaaaccgaaacccgccactacgcacacgtagactgcccggggcacgccgactacgttaaaaacatgattaccggcgccgcacaaatggacggtgcaatcctggtatgttccgcagccgacggccctatgccgcaaacccgcgaacacatcctgctggcccgccaagtaggcgtaccttacatcatcgtgttcatgaacaaatgcgacatggtcgacgatgccgagctgttggaactggttgaaatggaaatccgcgacctgctgtccagctacgacttccccggcgatgactgcccgattgtacaaggttccgcactgaaagccttggaaggcgatgccgcttacgaagaaaaaatcttcgaactggctgccgcattggacagctacatcccgactcccgagcgagccgtggacaaaccgttcctgctgcctatcgaagacgtgttctccatttccggccgcggtacagtagtaaccggccgtgtagagcgcggtatcatccacgttggtgacgagattgaaatcgtcggtctgaaagaaacccaaaaaaccacttgtaccggtgttgaaatgttccgcaaactgctggacgaaggtcaggcgggcgacaacgtaggcgtattgctgcgcggtaccaaacgtgaagacgtggaacgcggtcaggtattggctaaaccgggtactatcactcctcacaccaaattcaaagcagaagtatacgtactgagcaaagaagagggtggtcgtcacactccgttcttcgccaactaccgtccgcaattctacttccgtaccaccgacgtaaccggcgcggttactttggaagaaggtgtagaaatggtaatgccgggtgaaaacgtaaccatcaccgtagaactgattgcgcctatcgctatggaagaaggcctgcgctttgcgattcgcgaaggcggccgtaccgtgggtgccggcgtggtttcttctgttatcgcttaagtttagaggccaatagctcaattggtagagtatcggtctccaaaaccgagggttgggggttcgagaccctcttggcctgccaaataaaaaattaaccggccttgtgtcggttaatttttttgtatttgttatttagtaaactctcttgccatttacatggattgagaatagacagatgctatgatggataaataatatgacagaacatacgcctgaaaaaaagaacgttaaagtggatcaactggttgttcaagataaagaatctgcatctaattccggtaaggaagggttttttgcatatttctcaaattcttggtccgaattcaaaaaggtggtttggcctaagcgtgaagatgctgtcagaatgactgtatttgttatagtgtttgttgctgtgctttctatatttatctatgcggcagatacagcaatttcgtggttattttttgatgtattgctgagaagggaaggttgagatgtcgaaaaaatggtatgttgtacaggcgtattcggggtttgagaagaatgtccaacgaatattggaagagcgcattgcccgtgaggagatgggagattatttcggacaaattctggtgcctgtagagaaagttgttgatatccgcaatggtcgtaagactattagtgaaagaaagtcatatcctggttatgtgctagttgagatggaaatgacagatgactcttggcatcttgtaaaaagcaccccccgtgtttccggttttattggagggagggctaatagacctacgccgattagtcagagagaggctgaaattattttacagcaggttcagaccggcatagagaagccgaaaccaaaagttgaatttgaggtcggtcaacaggttcgtgtaaatgaagggccgtttgcggattttaacggggtggttgaggaggtcaattatgaacggaataagttacgcgtgtctgttcagatatttggtagagaaacacccgttgagctggagttcagccaggttgaaaagattaactgatttttatacttgaaaaaaaagcaataagaggatagaatcaaaaattaacttggggagcggaaatggttccgcgtcttacccgtttttaggagttcgttaagtggcaaagaaaattatcggctatattaaactgcaaattcctgcaggtaaagccaatccatctcctccggttggtcctgctttgggtcagcgcggtttgaatattatggaattttgtaaggcatttaatgctgcaacccaaggtatggagcctggcttaccgattccggttgtgattactgcatttgcagataaatcattcacatttgtgatgaaaaccccgccagcttctatcttgttgaaaaaggctgccggtttgcaaaaaggtagttctaatcctctgaccaacaaagtgggtaaattgacccgtgcccagttggaagaaattgctaaaactaaagatcctgatttgactgctgctgacttggatgcggctgtccgtactatagcaggttctgctcgctcaatgggcttggatgtggagggtgttgtataatggctaaagtatctaaacgcttgaaagctcttcgctcttctgtggaagccaataaattatatgcaattgatgaagcaattgctttggtaaaaaaagcagcgactgctaaatttgacgagtctgttgacgtatctttcaacttgggcgttgatccgcgtaaatctgaccaagttatccgtggttcggtcgttctgcctaaaggcaccggtaagataacccgtgtggctgtatttactcaaggtgcaaatgcagaagctgctaaagaagctggtgcagatatcgtcggtttcgaagatttggctgctgaaatcaaagcaggcaatctgaactttgatgtcgttattgcttctcccgatgcaatgcgtattgttggtcagttgggtactattttgggtcctcgaggcttgatgccaaaccctaaagtaggtacggttactcctaacgttgctgaagcagttaagaatgcaaaagcaggtcaagtacaataccgtacagataaagcaggtatcgttcatgcaacgattggtcgtgcttctttcgctgaagctgatttgaaagagaactttgatgcgttgctggatgctatcgttaaagccaagcctgctgccgctaaaggtcagtatctgaaaaaagttgctgtgtctagcaccatgggtttgggtattcgcgttgatacatcaagcgtaaataactaatcttaaggaattttcaagcagtttggttttctgggctgcttgaatttgggctacttaaaattaagtagatgtccaagaccgtagggatcgtaagatttaatcgtaactgccctacgcagacggtagtcctgaaacacattgcaagattgcttgtaagatgtctttttaggttaccgcgctggtgggatatcgttttggtatcctgtttataaacagtgggaggtagaccttgagtctcaatattgaaaccaagaaagtggcggtcgaggaaattagcgcggcaattgctaatgctcaaaccctcgtagtcgctgaatatcgcggtatcagtgtttccagtatgactgagcttcgtgcgaatgcacgtaaagaaggcgtttatttgcgcgttctgaaaaatactttggctcgtcgtgcagtgcaaggtacttcatttgcagaattggccgatcaaatggttggtccgttggtttacgctgcttctgaagatgctgttgctgctgctaaagtgttgcaccaattcgcgaaaaaagatgacaaaattgtcgttaaagccggttcttacaatggcgaagtaatgaatgctgctcaggttgctgagttggcttctattccgagccgcgaagagctgttgtccaaactgttgttcgttatgcaagctcctgtatcgggctttgcgcgcggtttggctgctttggcagagaaaaaagccggcgaagaagccgcttaatcgattttgtttctgttaatcaattattttttaatacaatatttggagtaaaatagcatggctattactaaagaagacattttggaagcagttggttctttgaccgtaatggaattgaacgacttggttaaagcttttgaagaaaaattcggtgtttctgctgctgctgttgcagttgcaggtcctgctggtgccggtgctgccgatgctgaagaaaaaaccgaatttgatgtcgttttggcttctgccggcgatcaaaaagtcggcgtgattaaagttgtccgtgcaattaccggtttgggtctgaaagaagctaaagacatcgttgacggcgcacctaaaaccattaaagagggtgtttctaaagctgaagccgaagacatccaaaaacaactggaagaagcaggcgctaaagtcgaaatcaaataatttgatgcttcttatgaaggctggcagttttctgccagccttattttgcttcttaaaataaacatcaagtattgtttacatttatttgcatagtttttatcaagtcattgcaaataaatgtaaatatcagattgatgcgtaccgttgtttcagacggcctattattgaaaattacttttcggagtgtgtatgaactattcgtttaccgagaaaaaacgtatccgtaagagttttgcaaagcgggaaaatgttttggaagttcctttcttgctagcaacccaaattgattcttatgcgaagtttttgcagctggaaaatgcttttgacaaacgtaccgatgacggtctgcaggcggcatttaattctattttcccgattgtgagccataacggttatgcgcgattggagtttgtgcattacacattgggcgagcctttgttcgatattcccgaatgtcagttgcgcggaatcacttatgcagcccccttgcgcgcgcgtatccgtttggtgattttggataaggaagcatctaaaccgacggtaaaagaagttcgtgaaaacgaagtgtatatgggcgaaattccgttgatgaccccgagcggttcttttgtgattaacggcacagagcgtgtgattgtctcccagttgcaccgttcgcccggcgtattcttcgagcatgacaaaggtaagacgcactcttccggcaaattgttattctccgcccgcatcattccctaccgtggttcatggttggattttgaatttgatccgaaagatttgctgtatttccgtatcgaccgccgccgtaaaatgccggtaacgattttgttgaaggctttaggctacaacaatgagcaaatcttggatattttctacgacaaagaaacgttctatttgtcttcaaacggtgttcaaaccgatttggttgcagaccgtctgaaaggcgaaactgccaaggtcgatatcttggataaagaaggcaatgtattggttgccaaaggtaagcgcattactgcgaaaaatatccgtgatattaccaatgcaggcctgacccgtttggatgtagaaccggaaagcctgctgggcaaagcattggctgccgatctgattgattcggaaaccggcgaggtattggcttctgccaatgatgaaattacagaagagttgttggccaaatttgatatcaacggcgtaaaagaaattacgaccctttatatcaatgagctggatcagggtgcttatatctccaataccttgcgtacggatgagactgccggccggcaggcggctcgtgttgcgatttaccgtatgatgcgtccgggcgaaccgcccaccgaagaggcggtcgagcaattgtttaaccgcttgttcttcagtgaagacagctacgatctgtcccgcgtaggccgtatgaaatttaatacgcgcacatacgaacaaaaactgtccgaagcccaacaaaactcttggtacggccgcctgctgaacgaaacgtttgccggtgctgccgacaaaggcggttatgtcctgagcgtcgaagatattgtcgcctcgattgcgactttggtcgagttgcgtaacggccatggcgaagtggacgatatcgatcacttgggcaaccgccgagtacgttcggtaggcgagctgactgaaaaccaattccgtagcggtttggcccgtgtggaacgtgccgtaaaagaacgtttgaatcaggcggaatcagaaaacttgatgccgcacgatttgattaatgcaaaacctgtttctgccgctattaaagaattcttcggctccagccaattgagtcagtttatggatcagaccaaccccttgtctgaagtaacccataaacgccgtgtatctgcattgggtccgggcggtttgacccgcgaacgtgcaggatttgaggtgcgggacgtgcatccgacccactacggtcgcgtatgtccgattgaaacgcctgaaggtccgaacatcggtttgatcaactcattgtccgtttatgcgcgcaccaatgattacggtttcttggaaacgccttaccgccgcgttatcgacggcaaagtaaccgaggaaatcgattacttgtctgccatcgaagaaggccgctatgtgattgcacaggcgaatgccgatttggattcagatggcaatctgattggcgatttggttacctgtcgtgaaaaaggcgaaaccattatggcaacgcccgaccgcgtccaatatatggacgtggcaactggtcaagtggtatccgttgcagcatccctgattccattcttggaacatgatgacgcgaaccgcgcattgatgggtgccaacatgcaacgtcaggcagtgccttgcttgcgtcctgaaaaaccgatggtcggtaccggtatcgagcgttccgttgccgttgactctgctactgcaatcgttgcccgccgaggcggcgtggtcgagtatgtcgatgccaaccgcgttgtgatccgtgtccatgacgacgaagcgactgccggtgaagtgggtgtcgatatttacaacttggttaaattcacccgttccaaccagtctaccaatatcaatcagcgtcctgccgtcaaagccggcgatgttttgcaacgcggcgatttggtggccgacggcgcgtccaccgattttggcgaattggctttgggtcaaaatatgaccatcgccttcatgccgtggaacggttacaactacgaagactcgattctgatttccgaaaaagtggctgcggacgaccgctatacttcgattcacattgaggaattgaatgtcgttgcccgcgatactaagctgggtgcggaagacattacccgcgatattccgaacttgtccgagcgtatgcaaaaccgtttggacgaatccggtatcgtttacatcggtgcggaagtagaagccggcgatgtgttggtaggcaaggtaacgcctaaaggcgaaacccaactgacgccggaagaaaaactgctgcgcgccatcttcggtgaaaaagcatctgacgtaaaagatacttcattgcgtatgcctaccggcatgagcggtaccgttatcgacgttcaagtcttcactcgtgaaggtattcaacgcgacaaacgtgctcaatccattatcgattccgaattgaaacgctaccgtttggatttgaacgaccaattgcgtattttcgacaacgacgcattcgaccgtatcgagcgtatgattgtcggtcagaaagccaacggtggtccgatgaagctggccaaaggcagcgaaatcacgaccgaatatctggcgggtctgccgagcaggcacgattggttcgatatccgtctgaccgatgaagatttggccaagcagttggaactgattaaagtgagcctgcaacaaaaacgcgaagaagcggacgagttatacgaaatcaagaagaaaaaactgacccaaggcgacgaattgcaacccggcgtacaaaaaatggtgaaagtttttatcgccatcaaacgccgtctgcaagccggcgacaaaatggcgggccgccacggtaacaaaggcgtggtatcgcgcattctgccagtggaagacatgccttacatggcggacggccgtccggtagacatcgtactgaacccattgggcgtaccttcccgtatgaacatcggtcagattttggaagttcacttgggttgggcagcaaaaggtatcggcgagcgtatcgaccgtatgctgaaagagcaacgcaaagcaggcgagttgcgcgagttcttgaacagactctacaacggcagcggtaagaaagaagatttggatgccctgactgatgaagaaatcatcgaactggcctccaacctgcgcaaaggtgcatctttcgcctctcctgtattcgacggtgcgaaagagtctgaaatccgcgaaatgctgaacttggcttatccgagcgacgatcctgaggttgaaaaactgggcttcaacgacagtaaaacccaaatcacgctgtatgacggccgttcaggcgaagcatttgaccgcaaggttacagtaggtgtgatgcactatctgaaactgcaccacttggttgacgaaaaaatgcacgcgcgttctaccggtccgtacagtctggttacccagcagcctttgggcggtaaagcccagttcggcggccaacgtttcggcgagatggaggtttgggcattggaagcatacggcgcggcatacacgctgcaagagatgctgactgtgaagtctgacgacgtgaacggccgtaccaaaatgtacgaaaacatcgtcaaaggcgaacacaaaatcgatgccggtatgcccgagtccttcaacgtattggtcaaagagattcgctcactgggcttggatatcgatttggaacgttactaaacaaaagttttcagacggcctttcagggtcgtctgaaaaagtggtttcagaataagaatgaagcaatcggcatttaggccgtctgaaatcaaaagtaccgtttcccaatatcgaaaatccgccatgcggtaaaaatacttccttcaaggagcaaaaatgaatttgttgaacttatttaatccgttgcaaactgccggcatggaagaagagtttgatgccattaaaatcggtattgcctctcccgaaaccatccgctcatggtcttatggcgaagtcaaaaaacctgaaaccatcaactaccgtacgttcaaacctgagcgtgacggtttgttctgtgccaaaatctttggcccggtcaaagactacgaatgcttgtgcggaaaatacaaacgcttgaaatttaaaggcgtaacgtgtgaaaaatgcggcgtggaagtaaccctgtccaaagtgcgccgcgaacgcatgggtcatatcgaattggctgcgcccgtcgcacatatttggttcttaaaatccctgccttcccgcttgggtatggtgttagacatgactttgcgcgacatcgagcgcgtattgtactttgaagcatttgtggtaaccgatcccggtatgactccgctgcaacgccgccaattgctgactgaagacgattactacaacaagctggacgaatacggcgacgatttcgatgccaaaatgggtgcggaaggtatccgcgaattgctgcgtaccctgaatgtagcgggcgaaatcgaaatcctgcgccaagagttggaatcgaccggttccgacaccaaaatcaaaaaaatcgccaaacgcttgaaagtattggaagccttccatcgttccggtatgaaactggaatggatgattatggatgtgctgccggtattgccgcctgatttgcgtccgttggttccattggatggtggtcgttttgccacttccgatttgaacgatttgtaccgccgcgttattaaccgtaacaaccgtctgaaacgtctgttggaactgcatgcgcctgacatcatcgtccgcaacgaaaaacgtatgttgcaagaagcagttgactcgctgttggataacggccgtcgcggtaaagccatgaccggcgccaacaaacgcccgctgaaatcattggcagacatgattaaaggtaaaggcggtcgcttccgtcaaaacctgttgggcaaacgtgtggactactccggccgttccgtgattaccgtaggcccgtacctgcgtctgcaccaatgcggtttgccgaaaaaaatggctttggaactgttcaaaccgttcattttccacaaattggaaaaacaaggtttggcctctaccgttaaagcagcgaaaaaattggtagagcaagaagtaccggaagtatgggacatcttggaagaagtcatccgcgaacatccgattatgctgaaccgtgcgccgaccctgcaccgtttgggtattcaagcgttcgaacctatcttgattgaaggtaaagcgattcagttgcacccattggtgtgtgctgcgttcaacgccgactttgacggcgaccaaatggcggtacacgttccattgagcttggaagcacaaatggaagcacgcacgctgatgctggcttcaaacaacgtattgtctccggccaacggcgaaccgattatcgtaccttcccaagacatcgtattgggcctgtactatatgactcgcgatcgtatcaatgccaaaggcgaaggcagcctgtttgccgatgtgaaagaagtgcatcgcgcataccataccaaacaggtcgagctgggtacgaaaatcaccgtacgtctgcgcgaatgggtgaaaaacgaagcaggtgagtttgagcctgtcgttaaccgttacgaaacaaccgtcggccgtgcattgttgagcgaaatcctgccgaaaggcctgccgtttgaatatgtcaacaaagcgttgaagaaaaaagaaatttctaaactgattaacgcatcgttccgcctgtgcggcttgcgcgatacggttatctttgctgaccacctgatgtacaccggtttcggatttgcggcaaaaggcggtatttccattgccgttgacgatatggaaattccaaaagaaaaagcggccttgctggctgaagccaatgccgaggttaaagaaatcgaagaccaataccgtcaaggtttggttaccaacggcgaacgctacaacaaggtggtcgatatttggggtcgtgccggcgataagattgctaaagcgatgatggacaacttgtccaaacaaaaagttatcgaccgtgccggcaacgaagtcgatcaagagtcattcaactccatttatatgatggcggactccggtgcccgtggttctgcagctcagattaaacagttgtccggtatgcgtggcttgatggcaaaacctgacggctcgattattgaaacgccgattacctcaaacttccgtgaaggtctgaccgtattgcaatactttattgcgacccacggtgcgcgtaagggtttggcggataccgcattgaaaaccgcgaactccggttacctgactcgtcgtctggtagacgtaactcaagatttggtcgttgttgaagacgattgcggtacttcagacggctttgtcatgaaggcagtggtacaaggcggtgatgtgattgaagcattgcgcgatcgtattttgggtcgtgttaccgcgtctgacgttgtcgatccgtcaagtggcgaaaccttggttgaagccggtacgttgctgactgaaaaactggtggatatgatcgaccaatccggtgtcgatgaagtcaaagtccgtacgccgattacttgtaaaacccgtcacggcctgtgtgcacactgttacggtcgtgacttggcacgcggcaaactggttaacgccggtgaggcagtcggtgtgattgctgcacaatccattggcgaaccgggtacccagttgaccatgcgtacgttccacatcggtggtgcggcatcccgtgcggcagcagccagccaagtggaagccaaatccaacggtacggcacgattcagcagccagatgcgctacgttgccaacaacaaaggcgagttggttgtcatcggccgttcttgtgaagtcgtgattcacgacgatatcggccgtgaacgcgaacgccacaaagtaccttacggtgccatcctgctggtacaagacggtatggccattaaagccggtcaaaccttggcaacctgggatccgcatacccgtccgatgattaccgaacacgcaggtatggtgaaattcgaaaacgtggaagagggcgttaccgttgccaaacaaaccgatgatgtaaccggtttgtccactttggtggtgattgacggtaaacgtcgttcctctagtgcttccaaactgctgcgtccgactgtgaaactcttggacgaaaacggcgtggaaatctgtattcccggtacttctactccggtatccatggcattccccgttggtgcggtgattaccgtacgcgaaggtcaggaaatcggtaaaggcgacgtattggcgcgtattccgcaagcctcttccaaaacccgcgacattaccggcggcctgccgcgcgttgccgaattgtttgaagcacgcgtgccgaaagatgccggtatgttggcggaaattaccggtaccgtttccttcggcaaagagaccaaaggcaagcaacgtctgattgttactgacgtggacggtgtagcatacgagaccttgatttccaaagagaaacaaattctggtacacgacggtcaagtggtaaaccgcggtgaaaccatcgtggacggcgcggtcgatccgcacgatattctgcgtttgcaaggtatcgaagcactggcacgctacattgtccaagaggtgcaagaggtttaccgtctgcaaggtgtgaagatttctgataaacacatcgaagtcatcatccgtcaaatgttgcgccgtgtgaacattgcggatgccggcgaaaccgggttcattaccggagagcaggtcgaacgcggcgatgtgatggcggccaatgaaaaagctttggaagaaggcaaagaaccggcgcgttacgaaaacgtattgctgggtattaccaaagcttccctgtccaccgacagcttcatttctgccgcatcgttccaagaaacgacccgcgttctgaccgaagccgcgattatgggcaaacaagacgagttgcgtggtttgaaagaaaacgtcatcgtcggtcgcttgattcctgccggtaccggtttgacttaccaccgcagccgtcatcaacaatggcaagaggtggaacaggagactgccgaaacccaagtaacggatgaataatctttggtgcatccattcaataaaaaaccgcaagccttgagcttgcggtttttctttgtccgattaaggcaaaaacaagcgttttcgtcattttgaggcgtgtggattattccttaggtattttcgggccggagaccaacgaggtggcgggtgtcgtcggtacgtccggagaccaaaataactttgccagggatgttggtttcggcggtcaaaaaaagtagcgtcttaatgttttccatttaaacaaatgtcgtctgaaacttcagacggcatttcctttaagaaataaatatgaaacccagaaatctcttttttgcaggctgcctgctgacttcggcgacgtttgccgaggatatcggcgtacctgtcgaactgattaacgtcggtaatcggattgcgatgccgtctgaaggggaaagcctcgccctcctgccgtttgccgaggatgtaccgccggttcgcgatgcaatgccgtctgaagttcctaaaagcgcggcaggcggcgatgttcggggtgaccggatgagaatgccgattaacatcggatgagcgcggctttatggcataaaaaactgtcgtggaaaggatttacaccccaaataaatttccgttacaacaagatcaacagcaatatgcccgccttttattcgcgcagcggcaaggaacggtttgtcagtatagaaaaaacgtattgacagtattttcttcagtcgtccgactgattgtgagggatgtcggtaaatatttatcggcaaacaagaaaatcatctttcttcttgtcgttatgcttgactgtctgcttgcaataaaaatataattccactcttgccgacatggtgtcggcaagtatttaactcaacaggacgagaaaatatgccaactatcaaccaattagtacgcaaaggccgtcaaaagcccgtgtacgtaaacaaagtgcccgcactggaagcttgcccgcaaaaacgtggcgtgtgcacccgtgtatacacaactacccctaaaaaacctaactctgcattgcgtaaagtatgtaaagtccgcctgaccaacggttttgaagtcatttcatacatcggcggcgaaggtcacaacctgcaagagcacagtgtcgtattgattcgcggcggtcgtgtaaaagacttgccaggtgtgcgttaccacactgtacgcggttctttggatactgcaggtgttaaagaccgtaaacaagcccgttccaaatacggtgctaagcgtcctaaataattactgggacttaaataggcacgtcggccgcctaagctgaacaacggccgagtaagtgaatactcaattgggtattcatgggaatagacccgactgaatagattaaaggaaattaaaatgccaagacgtagagaagtccccaagcgcgacgtactgccagatcctaaattcggcagcgtcgagttgaccaaattcatgaacgtattgatgattgacggtaaaaaatccgttgccgagcgtatcgtttacggtgcgttggaacagattgagaaaaaaaccggcaaagtagcaatcgaagtatttaacgaagccattgcaaacgccaaacctatcgtggaagtgaaaagccgccgtgtaggtggtgcaaactaccaagttcctgttgaagttcgtccttcacgccgtttggctttggcaatgcgctgggttcgcgatgcggcccgcaaacgtggtgagaaatccatggacctgcgtttggcaggcgaattgattgatgcgtccgaaggccgtggcggtgcgttgaaaaaacgtgaagaagtacaccgtatggctgaagccaacaaagcattctctcacttccgtttctaattttgaaaggctaataaaatggctcgtaagaccccgatcagcctgtaccgtaacatcggtatttccgcccatattgacgcgggtaaaaccacgacgacagaacgtattttgttctataccggtttgacccacaagctgggcgaagtgcatgacggtgcggctactaccgactacatggaacaagagcaagagcgcggtattaccattacctccgctgccgttacttcctactggtccggtatggcgaaacaattccccgagcaccgcttcaacatcatcgacaccccgggacacgttgactttaccgtagaggtagagcgttctatgcgtgtattggacggcgcggtaatggtttactgcgcggtgggcggtgttcaaccccaatctgaaaccgtatggcggcaagccaacaaataccaagtgccgcgcttggcgtttgtcaataaaatggaccgtcagggtgccaacttcttccgtgttgtcgagcaaatgaaaacccgtttgcgcgcaaaccctgtacctatcgtcattccggttggtgcggaagacaacttcagcggtgtggttgatttgttgaaaatgaaatccatcatttggaatgaagtcgataaaggtacaacctttacctatggcgatattcctgccgaattggtcgaaactgccgaagaatggcgtcaaaatatgattgaagccgcagccgaagccagcgaagaactgatggacaaatacttaggcggcgacgagctgaccgaagaagaaatcgtaggcgcgttgcgtcaacgtactttggcaggcgaaattcagcctatgctgtgtggttctgcatttaaaaacaaaggtgttcaacgtatgttggacgcagttgtagaattgctgccagctcctaccgatattcctccggttcaaggtgtcaacccgaataccgaggaagccgacagccgtcaagccagcgatgaagagaaattctctgcattggcgttcaaaatgttgaacgacaaatacgtcggtcagctgacctttatccgcgtttactcaggcgtagtaaaatccggcgataccgtattgaactccgtaaaaggcactcgcgaacgtatcggtcgtttggtacaaatgactgccgcagaccgtactgaaatcgaagaagtacgcgccggcgacatcgcagccgctattggtctgaaagacgttactaccggtgaaaccttgtgtgcggaaagcgcgccgattatcttggaacgtatggaattccccgagccggtaatccatattgccgttgagccgaaaaccaaagccgaccaagagaaaatgggtatcgccctgaaccgcttggctaaagaagacccttctttccgtgtccgtacagacgaagaatccggtcaaaccattatttccggtatgggtgagctgcacttggaaattattgttgaccgtatgaaacgcgaattcggtgtggaagcaaatatcggtgcgcctcaagtggcttaccgtgaaactatccgcaaagccgttaaagccgaatacaaacatgcaaaacaatccggtggtaaaggtcaatacggtcacgttgtgattgaaatggaacctatggaaccgggtggtgaaggttacgagtttatcgatgaaattaaaggtggtgtgattcctcgcgaatttattccgtctgtcgataaaggtatccgcgatacgttgcctaacggtatcgttgccggctatcctgtagttgacgtacgtatccgtctggtattcggttcttaccatgatgtcgactcttcccaattggcatttgaattggctgcttctcaagcgtttaaagaaggtatgcgtcaagcatctcctgccctgcttgagccaatcatggcagttgaagtggaaaccccggaagaatacatgggcgacgtaatgggcgacttgaaccgccgtcgcggtgttgtattgggtatggatgatgacggtatcggcggtaaaaaagtccgtgccgaagtacctttggcagaaatgttcggttactcgaccgacctgcgttctgcaacccaaggccgcgctacttactctatggagttcaagaaatattctgaagctcctgcccacatagctgctgctgtaactgaagcccgtaaaggctaatcagaaaaggccgtctgaaactgaaaataaattttcagacggccattgttctttaatcgatctttatatgtaaaggaattagctcatggctaaggaaaaatttgaacgtagcaaaccgcacgtaaacgttggcaccatcggtcacgttgaccatggtaaaaccactctgactgctgctttgactactattttgtctaaaaaattcggtggcgctgcaaaagcttatgaccaaatcgacaacgctcctgaagaaaaagctcgtggtattaccattaatacctcacacgtagaatacgaaactgaaacccgtcactacgcacacgtagactgcccggggcacgccgactacgttaaaaacatgattaccggcgccgcacaaatggacggtgcaatcctggtatgttccgcagccgacggccctatgccgcaaacccgcgaacacatcctgctggcccgccaagtaggcgtaccttacatcatcgtgttcatgaacaaatgcgacatggtcgacgatgccgagctgttggaactggttgaaatggaaatccgcgacctgctgtccagctacgacttccccggcgatgactgcccgattgtacaaggttccgcactgaaagccttggaaggcgatgccgcttacgaagaaaaaatcttcgaactggctgccgcattggacagctacatcccgactcccgagcgagccgtggacaaaccgttcctgctgcctatcgaagacgtgttctccatttccggccgcggtacagtagtaaccggccgtgtagagcgcggtatcatccacgttggtgacgagattgaaatcgtcggtctgaaagaaacccaaaaaaccacttgtaccggtgttgaaatgttccgcaaactgctggacgaaggtcaggcgggcgacaacgtaggcgtattgctgcgcggtaccaaacgtgaagacgtggaacgcggtcaggtattggctaaaccgggtactatcactcctcacaccaaattcaaagcagaagtatacgtactgagcaaagaagagggtggtcgtcacactccgttcttcgccaactaccgtccgcaattctacttccgtaccaccgacgtaaccggcgcggttactttggaagaaggtgtggaaatggtaatgccgggtgaaaacgtaaccatcaccgtagaactgattgcgcctatcgctatggaagaaggcctgcgctttgcgattcgcgaaggcggccgtaccgtgggtgccggcgtggtttcttctgttatcgcttaattgaaggatattgataaatggcaaaccaaaaaatccgtatccgcctgaaagcttatgattacgccctgattgaccgttctgcacaagaaatcgttgaaactgcaaaacgtaccggtgcagttgtaaaaggcccgattcctttgccgaccaaaatcgagcgtttcaacattttgcgttctccgcacgtgaacaaaacttcccgtgagcaattggaaatccgcacccacttgcgcctgatggacatcgtggattggaccgataaaactaccgatgcgctgatgaagctggatttgccggccggtgttgatgtagaaatcaaagtccaataattcggactataaaaaatccccaagcaatcaatgcttggggattttttatgttatgccgagacctttgcaaaattccccaaaatcccctaaattcccaccaagacatttaggagcaccttcttccagcaaaccgcccaagccatgattgccaaacacatcgaccggttcccactattgaagttggaccgggtaattgattggcagccgatcgaacagtacctgaatcgtcaaagaacccgttaccttagagaccaccgcggccgtcccgcctatcccctgttgtccatgttcaaagccgtcctgctcggacaatggcacagcctctccgatcccgaactcgagcacagcctcatcacccgcatcgatttcaacctgttttgccgctttgacgaactgagcatccccgattacagtcatcaaccatattccggtttgtcggagaaagatgcatacgctgtgatgaccggataccgacccgttaaaagagtccgaccctatgccgtctgaaaattcaaaacgcttcagacggcatattgaagatatttctgatatttctgttgatatttctttgacttgtcagatataatgccgagcttggtacatttgtgccaagtttaactttgtctgaaagacaggccaatcgtagcctgtccctttactttaaaaggaaaataatcatgactttaggtctggttggacgcaaagttggtatgacccgcgtgttcgacgaacagggtgtttctgttccggtaaccgttttggatatgtctgccaaccgcgttacacaagtaaaatccaaagatactgacggctatactgccgttcaagttacctttggtcagaaaaaagccaatcgtgtcaacaaagccgaagccgggcactttgcaaaagcaggtgttgaagccggtcgcggtttgattgagtttgctttgactgaagaaaaactggctgaattgaaagctggtgacgaaatcaccgtttctatgtttgaagtcggtcaactggtcgatgtaaccggtacctctaaaggtaaaggtttctccggcacgattaaacgtcataacttcggtgcccaacgtacttcccacggtaactcccgttctcaccgtgttccaggctctatcggtatggcgcaagacccgggtcgcgtgttccccggtaaacgcatggccggccaatacggcaacaccaaagcaactgttcaaaaattggaagttgtccgtgttgacgcagaacgccaactgctgttggttaagggtgctgttccgggtgcggtcaacagcgatgttgtagttcgtcccagcgtgaaagtaggtgcgtaatggaattgaaagtaattgacgctaaaggacaagtttcaggcagtctgtctgtttctgatgctttgttcgcccgcgaatacaatgaagcgttggttcatcagctggtaaatgcctacttggcaaacgcccgctccggtaaccgcgctcaaaaaacccgtgccgaagtaaaacactcaaccaaaaaaccatggcgtcaaaaaggtaccggccgtgcccgttccggtatgacttcttctccgctgtggcgtaaaggtggtcgcgcgttcccgaacaaacccgacgaaaacttcactcaaaaagtaaaccgcaaaatgtaccgtgccggtatggcgactattctgtcccaattgactcgtgacgagcgtttgtttgcgattgaggcgttgactgccgaaactcctaaaaccaaagtttttgccgaacaagtgaaaaatctgggtctggagcaagtgttgtttgtaaccaaacagctcgacgagaatgtttacttggcttcacgcaacttgccaaacgtgttggttttggaagctcaacaagttgatccttacagcttgctgcgttacaaaaaagtaatcatcactaaagatgcagttgcacaattagaggagcaatgggtatgaatcaacaacgtttgactcaagtgattttggcacctatcgtttctgaaaaaagcaacgtattggctgaaaaacgtaaccaaatgacgtttaaagttttggcaaatgcaaccaaacctgaaattaaagcggctgttgagctgctgttcggcgttcaagttgcagacgttactactgttaccattaaaggtaaagttaaacgttttggtcgcactttaggtcgtcgcagcgatgttaaaaaggcttatgtaagcttggctgccggtcaagagttggatttggaagccgctgctgcagctgcagataaggaataaacaaaatggcaatcgttaaaatgaagccgacctctgcaggccgtcgcggcatggttcgcgtggtaacagaaggtttgtacaaaggtgcaccttatgcacctctgctggaaaagaaaaattctactgccggtcgtaacaacaatggtcatattactacccgtcataaaggtggtggtcataaacatcattaccgcgtcgtagattttaaacgtaacaaagacggtatccctgcaaaagtagagcgtatcgaatatgaccctaaccgtactgcatttatcgcactgttgtgctatgcagatggtgagcgtcgctacattattgctcctcgtggtattcaagccggtgcagtattggtttccggtgctgaagctgcgatcaaagtaggtaacactctgccgatccgcaatattcctgttggtacaactattcactgtatcgaaatgaaaccaggtaaaggtgcgcaaattgcacgttctgccggtgcttctgcggtattgctggctaaagaaggcgcgtacgctcaagtccgcctgcgctctggcgaagtccgtaaaatcaacgtagattgccgtgcaaccatcggtgaagtcggtaacgaagagcaaagcctgaaaaaaatcggtaaagccggtgccaatcgttggcgcggtattcgtccgactgtacgtggtgttgtcatgaaccctgtcgatcacccgcatggtggtggtgaaggccgtacgggcgaggcccgcgaaccggtcagcccatggggtactcctgctaaaggctaccgcactcgtaataacaaacgcacggataacatgattgttcgtcgccgttactcaaataaaggttaatttagtatggctcgttcattgaaaaaaggcccatatgtagacctgcatttgctgaaaaaagtagatgctgctcgcgcaagcaacgacaaacgcccgattaaaacctggtctcgtcgttctaccattctgcctgattttatcggtctgaccattgctgtgcacaacggccgcacccatgtgcctgtgtttatcagcgacaatatggttggtcataaattaggcgaattctcattgacccgtacctttaaaggccacttggccgataaaaaggctaaaaagaaataaggtgaatcatgagagtaaatgcacaacataaaaatgcccgtatctctgctcaaaaggctcgtttggtagctgatttgattcgtggtaaagacgttgcccaagctttgaatattttggctttcagtcctaaaaaaggtgccgagctgattaaaaaagtattggagtcagctattgctaatgccgagcacaataacggtgcggacattgatgaactgaaagtggtaactatctttgttgacaaaggcccaagcttgaaacgttttcaagctcgcgccaaaggtcgcggtaaccgcatcgaaaaacaaacttgtcatatcaatgtgacagtgggtaactaaggaaaagctatgggacaaaagattaaccctacaggctttcgcctggcggtaactaaagactgggcttcaaaatggtttgctaaaagcaccgacttttctactgttttgaagcaggatatcgatgttcgcaattatttgcgtcaaaaattggccaatgcttcggttggtcgagtggttattgaacgccctgcaaaatctgcacgcattaccattcactccgctcgtccgggtgtggttatcggtaaaaaaggtgaggatatcgaggttttgaaacgtgacttgcaagtcttgatgggtgtacctgttcatgtaaatattgaagagattcgccgtcctgagttggatgctcaaattattgctgacggtattgcccagcagttggaaaagcgcgttcaattccgtcgtgctatgaaacgagcaatgcaaaatgcaatgcgttctggtgctaaaggcattaagattatgacttcaggccgtctgaatggtgcggatattgcccgtagcgaatggtatcgtgaaggtcgcgtgccactgcatactttacgtgcaaatgtagattatgcaaccagcgaagcgcacaccacatatggtgtattgggtctgaaagtttgggtttatacggaaggcaatattaaatcttccaaacctgaacatgagagtaaacaaagaaaggcaggtagacgtaatgctgcagccaactagactgaaataccgtaagcaacaaaagggtcgcaataccggcatcgctactcgcggtaataaggtaagtttcggtgagttcggcttgaaagccgtaggtcgtggtcgtttgactgcccgtcaaatcgaagctgctcgtcgtgcaatgacccgtcatatcaaacgtggtggtcgtatttggattcgtgtattccctgataaaccgattactgaaaagcctattcaagttcgtatgggtggcggtaaaggtaacgtggaatattacattgccgaaattaaaccaggtaaagtgttgtatgaaatggatggcgttccagaggaactggctcgtgaagcattcgagttggctgctgccaaattgcctattcctacaacctttgtagtaagacaggtgggtcaataatgaaagcaaatgaattgaaagacaaatccgttgagcagttgaatgcagatttgttggacttgttgaaagctcagtttggcttacgtatgcaaaacgctaccggtcaattaggcaaaccaagtgaattgaaacgtgtacgtcgcgatattgctcgtattaaaaccgttttaactgaaaaaggtgctaagtaatgagcgaaactaaaaatgttcgtactttgcaaggcaaagtagtaagcgacaaaatggataaaaccgtaacagtattggttgagcgtaaagtaaaacatccgctgtatggtaagattattcgattatctactaaaatccatgcccatgatgaaaataatcaatatggaattggtgatgtggttgttatatcggaatcccgtccattgtcaaaaactaaatcttgggttgtcagtgagctggttgagaaagcacgttctatttaagaattaaagcaacgtgcttggaatgggaaacgaagtattgcagcaaatttaatttgcgtgtaaacttcgtttcctgtctttcagtttcttctggaagtttcttccctttcggggtccaagactggtttacttgaaccgcaaggtttcatttaataagcagcggctttgctgtaagttatctgaaagtggtaaattaagttggttaatttaaaggtaataacatgattcaaatgcagaccatcttagatgtggctgataactctggtgcgcgtcgcgtaatgtgtatcaaggtattgggcggatctaagcgtcgctacgcttctgttggcgatattattaaagtggcagttaaagatgcggctccgcgtggccgtgtcaaaaaaggcgatgtatataatgcggtagttgttcgtactgctaagggtgtacgtcgtcctgatggtgcgttaattaaattcgataacaatgccgccgtgttactgaataataaacttgaacctttgggtactcgtatctttggtccggtaacccgtgaattgcgtactgagcgatttatgaaaatcgtttcattggcacctgaagtattataaggaatggcacgatgaataaaatcattaaaggcgatagggttgtagtaattgctggtaaggataaaggtaagcagggtcaagtagttcgagtgttgggtgataaagttgttgttgagggcgttaatgttgtaaaacgccatcaaaaacctaatccaatgcgtggcattgagggcggtattattactaaagaaatgcctttggatatttctaatatcgcaatcctgaatccggaaactaataaagcggaccgtgttggtattaagctgattgaaaatgaaggcaaagttaaacgcgttcgtttcttcaaatcaaatggctctatcattggggcataaggagataacatggctcggttgagagagttttataaagagacagttgttcctgaattggttaaacaatttggttacaaatcagtaatggaagtcccgcgtattgaaaaaattaccttgaatatgggtgtgggtgaggctgttgctgataaaaaagttatggaacatgctgtttccgatttagagaaaattgccggtcaaaaaccggttgttactgttgcccgtaaatctatcgcaggttttaaaatccgtgataactatccggttggttgcaaagtaacattgcgtcgtgatcaaatgtttgaattcttggatcgtttgattactattgcattacctcgcgtacgtgacttccgtggtgtgagcggtaaatcatttgatggccgtggcaattacaatatgggtgttcgtgagcaaattatttttccggaaattgaatacgataaaattgatgctttgcgtggtttgaatattactattactactacagcaaaaaccgatgaggaagcgaaagctttattgtcattgtttaaatttccgttcaaaggataatcatggctaagaaagcacttattaatcgtgatctgaaacgtcaagctttggctaaaaaatatgcggctaaacgcgcggcaattaaagcggtaatcaatgattcgaatgcaactgaggaagagcgttttgaggctcgtttgaggtttcaatccattcctcgtaatgcggcacctgtgcgtcaacgtcgtcgttgtgctttgacaggtcgccctcgtggtactttccgtaaatttggtttgggtcgtattaaaatccgtgaaatcgccatgcgtggcgaaattccgggtgttgttaaagccagctggtaataggagtaattaagaatgagtatgcatgatcctatttccgatatgttgactcgtatccgcaatgcgcaacgtgctaataaagcagcggttgcaatgccttcttcaaaattaaagtgtgctattgcaaaggtattgaaagaagaaggatatattgaggacttcgcagtttcatctgacgtaaagtctatattggaaattcaattaaaatactatgcaggtcgtcctgtaattgaacaaatcaagcgtgtatctcgccccggtttgcgtatttataaagcgtctagtgagattccaagtgttatgaatggcttgggtattgctattgttagtacttctaaaggtgtaatgactgatcgtaaagcacgttctcaaggtgttggtggtgagttgttatgcattgtagcctagtggaggaaaagaaatgtcacgtgtcgcaaaaaacccagtgactgttcccgctggtgtagaagtaaaatttggagcagaggcattagttattaagggtaagaacggtgaattgtcttttcctttgcattctgatgtagccattgaatttaatgatggcaaattgacttttgttgcgaataacagcagtaaacaagcaaatgcaatgtctggtactgctcgcgcattagtcagcaatatggttaaaggtgtttcagaaggttttgagaaaagattgcaattgataggtgtgggttatcgtgctcaagcacaaggtaaaatcttgaatctgtctttgggtttttctcatccgatcgtatatgaaatgcctgaaggtgtctccgttcaaactcctagccaaacagagattgttttaaccggctcggataaacaagttgttggtcaagttgctgctgagattcgtgcgttccgtgctcctgagccttataaaggtaaaggtgttcgctatgtaggagaagtagtggtaatgaaagaagccaagaaaaaataattgaggttcactaatggataaacatacaacccgactccgtcgtgcacgcaaaacccgtgctcgtattgcggacttgaaaatggtaagattatgtgtgttccgaagcaataatcatatttatgctcaagtaattagtgctgaaggtgataaagtattggctcaagcctctacattggaagctgaggtgcgcggtagtctgaaatctggaagcaatgttgaagcagctgcaatagttggtaaacgtatcgctgaaaaagctaaagcagcaggtgtagaaaaggttgcttttgatcgttcaggtttccaatatcacggtcgtgtgaaggctttggctgaagctgctcgtgaaaatggtttaagcttctaaatatttggagactttcagatggcaaaacatgaaattgaagaacgcggtgacggtctgattgaaaagatggtcgctgttaatcgcgtaactaaagtagttaaaggtggccgtatcatggctttctcagcactgactgttgttggtgatggtgatggtcgcattggtatgggcaaaggtaaatcaaaagaagtaccagttgctgttcaaaaagcaatggatcaagctcgacgctctatgattaaagtacctttgaaaaacggtactattcatcatgaggttattggccgtcatggtgctactaaagtatttatgcagcctgctaaagagggtagtggcgtaaaagccggtggacctatgcgtttggtttttgatgctatgggcattcataatatctccgccaaagtgcacggatctactaacccatataatatcgtacgtgcaacattagatggtttgtctaagttgcatactcctgctgatatcgcagccaaacgtggcttgacagtggaagacattttgggagttaaccatggctgaacaaaaaaagattagggttacattggttaaaagcctgattggtacaattgaatctcatcgtgcatgtgcacgcggtttaggtttgcgtcgtcgcgagcatacggtagaggttttagatacccctgaaaaccgtggtatgattaataaaatcagctacttgttgaaagtggagtcttgatatgtttttgaatacaattcaacctgctgttggtgctacgcatgctggtcgtcgtgttggacgcggtattggtagtggtcttggcaaaacgggtggtcgtggtcataaaggtcaaaagagccggtctggtgggtttcataaggtgggtttcgagggtggtcaaatgcccttgcaacgacgcctccctaaaagaggttttaaatctttaacagcatcagctaatgcacagcttcgtttaagtgaactggaatcaattgctgttaatgagattgatattttggtcttaaagcaagcgggtctgattgcatctacagtctctaatgttaaagttattgcttctggtgaaatttctaaggcagttgctttgaagggtattaaagttaccaaaggtgcgagagctgctatcgaggctgttggtggtaagattgaaatgtaaggtttaatattgtggctaatcaacaaacgtcatcaggttcatccaaatttggagatcttaagaaacgtcttttgtttctatttggagcattgattgtttttcgaattggtgcccatatacccgtacctggagttgatgctgttgctttagctaaattatacgaaagcgctggaaacggcatcctgggaatattgaatatgttttccggtgggtcgttagagcgctttagtatatttgcaataggaattatgccatatatttcagcttctattattgtacagctcgcttctgaaattttgccatcattgaaggctttaaaaaaagaaggggaggctggtagaaaggtaattacgaaatatactaggtatggtactgttttgttagcaattcttcaaagtctaggtgttgcatctttcgtatttcagcaaggaattgttgtaacaagttcatttgagtttcatgtttccacggtagtttctttggtaacgggaaccatgtttcttatgtggcttggggagcaaattactgaaaggggtatcgggaacggtatttctttaatcattacggcaggtattgcttcaggtattccttcgggtattgcaaagctggttacactgacgaaccaaggttctatgagcatgcttacggcgttgtttattgtatttggtgccttattattaatttatttggttgtatactttgaaagtgcacagcggaagattcctattcattatgcaaaacgccagtttaatggtagggcgggtagtcaaaatacgcatatgcctttcaagttgaatatggctggtgttattcccccaatttttgcttccagtattattctatttccatctactcttttaggttggtttggttcggctgatacaaatagtgttttgcacaaaatagctggattgttacaacacggtcaattgctgtatatggctttatttgcagcgacagttattttcttttgttatttttatacggctttggtttttagccctaaagaaatggcagagaatttaaaaaagagtggtgcttttgttcctgggattagacctggtgagcagacctctaggtatttagaaaaagttgtattacgtttgacattgtttggagctctttatattacaactatttgtttaattccagagttcttaactacggttttaaatgtacctttttatttgggtggcacgtctttgttgattctagttgttgtaacgatggattttagtacacaaataaattcgtataggcttactcaacagtatgataagttaatgactcgttcagaaatgaaatcattttctcggaaatagaattatggcgaaagaagatactatccaaatgcaaggtgaaattcttgaaactttacctaatgcaacatttaaagtaaaacttgagaatgaccatattgtattgggtcatatttctgggaagatgcggatgcattacattcgtatttctccgggagataaggtcacagtagagctgacaccttatgatctaactagggctcgaatcgttttcagagcaagataaaccaataaaaggaaaataaaatgcgtgtacaaccatctgttaagaaaatttgccgaaattgcaagattattcgtcgaaatcgtgtagttcgtgtaatttgtactgatctccgtcacaaacagcgtcaaggttaatggaatatttcttttaatgtgattctgtgatatagtgacacactttgccctaaaaaggaaaaaatatggctcgtattgcaggggtaaatatccctaataacgcacacatcgtaattggtcttcaggctatttacggtattggtgctactcgtgctaaattgatttgtgaggctgcaaatattgcgcctgatactaaagcaaaagatttggacgagactcaattagatgctttgcgtgaccaagttgccaagtatgaagtagaaggtgatttgcgtcgtgaggtaactatgagtatcaagcgattgatggacatgggctgctatcgtggcttccgtcatcgtcgcggcttaccatgccgcggtcaacgcactcgtacaaatgcgcgtacccgcaaaggtccgcgtaaagcgattgctggtaagaaataaattttaaggaattttattaatggctaaagcaaacacagcttcacgtgtacgtaaaaaagtacgtaaaaccgtgagtgagggtattgtgcacgttcatgcatctttcaacaataccatcattacaatcactgaccgtcaaggcaatgcgttgtcttgggctacctctggcggcgctggttttaaaggttctcgtaaaagtacaccatttgcagcacaagttgcagcagaagcagctggtaaagttgcccaagagtatggcgttaaaaatttagaggttcgtattaaaggtccaggtccaggtcgtgaatcctctgtacgtgctttgaatgctcttggtttcaagattaccagcattactgacgttaccccgttgcctcataacggttgccgtccgcctaaaaaacgtcgtatttaatattggagtgatttgaaacatggcacgttatattggccctaaatgtaagttggcacgtcgcgaaggtacggatttgtttttgaagagtgcgcgccgctctttggattctaaatgtaaaattgattccgctcctggtcagcatggtgcaaaaaaaccgcgtttgtcagactatggtttgcagttgcgtgaaaaacaaaaaatccgccgtatttatggcgtattagaacgtcagttccgtcgttatttcgcagaagctgatcgtcgtaaaggttctaccggcgagttgctgttgcagttgctggaatctcgtttggataatgtcgtttatcgtatgggtttcggttctacccgagctgaagcaagacagcttgtttctcataaggcgatagttgtgaatggacaagttgtcaatattccttctttccaagtgaaagctggtgatgttgtctcagttcgtgaaaaagccaaaaaacaggtacgtattcaagaagcattgggtttggcaactcaaatcggcttgccgggttgggtttctgtagatgcggataaacttgagggtgtgttcaaaaacatgccggatcgctcggaattgaccggtgatattaatgaacagctggtggtagagttctactctaaataatgctagctcagtgagggacagttaaatgcagaatagcacaaccgaatttttgaaacctcgtcaaattgatgtaaatactttttctgcaactcgtgcaaaagtatctatgcagccatttgaacgtggtttcggtcataccttaggtaatgctttgcgccgtatcttactgtcatccatgaatggttttgctcctactgaagtagctattgccggtgtattacacgaatattctactgttgatggtattcaggaagatgttgttgacattttgctgaatattaaaggtattgtgtttaaactccatggtcgtagccaagttcaacttgtgttgaagaaatcaggttcaggtgtcgtatctgccggtgatattgagttgccgcatgatgtagaaattctgaatcctggtcatgtcatttgtcatttggctgataacggtcaaattgagatggaaattaaagtagagcaaggtcgtggttatcaatctgtttcaggtcgtcaggtagttcgtgatgagaaccgtcagattggtgcaatccagttggatgcgagcttttcgcccatcagccgtgttagctttgaggttgaacctgcacgtgtagagcagcggacggatcttgataagttggttttggatatcgaaaccgacggttctattgatcctgaggaagctgtacgcagtgcggcacgtattttgattgatcagatgtctatttttgctgatttgcagggtacgcctgtggaggaggttgaagaaaaagcacctcctatcgaccctgttcttttgcgtccggtggatgatctggaattgacagtacgttcagctaattgtttgaaagctgaggatatttattatattggcgatttgattcaacgcactgaaaccgagcttcttaaaacgccgaatttgggacgtaaatctttgaatgagattaaggaagtattggcatctaaaggtttgacactgggttctaagttggaagcatggccacctgtaggcttggaaaagccttaatgaagaattaaaggataattgatatgcgtcatcgtaatggcaatcgcaaattaaaccgtaccagcagtcatcgtgctgcaatgctgcgtaatatggcgaattcattattgactcacgaagctattgtaacaactctgcctaaggccaaggaattgcgccgtgtagtagagccgttgattacattgggtaaaaagccgtcattggcaaaccgccgtttggcatttgaccgtactcgcgaccgtgatgttgtagtaaaactgtttggcgatttgggtcctcgttttactgctcgtaacggtggttatgttcgggtgttgaaatacggattccgtaaaggtgataatgcacctctggcactggttgaattggttgacaaaccggctgctgagtaattttagtcatataacgccatctgccgaaaagcaggtggcgttatttttgcaatatctgataggtaatagggtattggctatcatgtttaaaatattaattgaatagctaaggtttgcgcggtaaacttacatcattaaaaaattctatgatggtttatataatgaatgctttcgatataaagtcgacaaagatggacgtattgtctatatctttgcatacgtcagacttgtttgatttggaagatgtgctggtcaaattgggcaagaagtttcaagagtctggtgttgttccatttgtgctggatgttcaagagtttgattatcccgagtctttggatcttgctgcattggtttcgttgttttcaaggcatggtatgcaaattttgggtctgaagcattctaatgaacgttgggctgctgcggctatgaagtatcatttgctgttttgtctgtctcattcggaaaatgttaaagaactgggtcaggttgaggtgcagaaaacggaggatggtcagaaagcaaggaaaacagtattgattacatcccctgtccgtaccggtcagcaggtttatgccgaagatggcgatttgattgttacgggggcggtcagccagggggcggaattgattgcggatggcaatatacatatttatgcgccgatgagggggcgtgctttggccggtgccaagggtgatacttctgcccgcatatttatccactccatgcaggcagaactggtttctgtggcgggtatttaccgtaattttgaacaggatttgccgaaccatctgcacaagcagccggtacagatattgttgcaggataaccgattggttatcagtgcaattggctcagagtaattgtttgatatttaaaaaggaaatattgtggcaaaaattattgtagtaacttcaggtaagggcggtgtcggtaaaacgactaccagtgccagtattgcgacaggtttggcattacgcggatataaaactgcggtaattgattttgatgtgggtttgcgtaacctcgacctcattatgggttgcgagcgtcgtgtcgtttatgacctgatcaatgtcattcagggggaggcgacgctcaaccaagctttgattaaagataaaaattgtgaaaacctgtttattttgccggcttcccagactcgggataaagacgctttgacacgcgagggcgtagaaaaagtgatgcaggagctgtccggcaagaaaatgggctttgagtatattatttgcgactctcctgccggtattgagcagggtgcattgatggcgttgtattttgctgatgaagccattgtaacgaccaatcctgaggtttccagtgtgcgtgactccgacaggattttgggaattttgcaaagcaaatcccataaggcagagcaaggcggttcggttaaagaacatctgttgattacgcgttattctcccgaacgtgtggcaaaaggcgaaatgctgtctgtacaggatatttgcgatattctgcatattcctttgctgggtgtgattcctgaatcccaaaacgtcttgcaggcatccaattccggagaaccggtcatccatcaggacagcgtggcggcttccgaggcatataaggacgttattgcccgtcttttgggcgagaaccgtgaaatgcgtttcttggaagctgagaaaaaaagcttcttcaaacgtctgtttggaggataaggtatgtcattaatcgaatttttattcggcagaaagcagaaaacggcaaccgttgcccgcgaccgccttcaaatcatcattgcccaagagcgcgcccaagaaggtcaggctccggattacctgccgactttacgtaaagagttgatggaagtcctgtccaaatatgtgaatgtttcattagacaatatccgtatttcccaagaaaagcaggatggtatggatgtgcttgagttgaacattactttgccggaacagaaaaaggtataggacatgaccttaaccgaattgcggtacatcgtcgcagtcgcccaagaacgtcatttcggcagggcggcgcggcgttgttttgtcagccagcccactttgtctattgccattaagaaattggaagaagagcttgccgtctctttgtttgaccggagcagtaacgatattattacgaccgaggcgggggaacgtatcgttgcacaggcgcgtaaggtattggaagaggcggagcttatcaggcatttggcaaatgaagaacaaaacgagctggagggtgcgttcaaactcgggctgatttttacggttgcgccgtacctgctgccgaaactgattgtttcgttgcgccgtactgcaccgaaaatgcctttgatgttggaagagaattacacgcatactttgaccgagtcgctcaaacgcggggacgttgatgcgattatcgttgccgaaccgtttcaagagccgggcattgttaccgaacccttgtatgacgaaccgtttttcgtgattgtcccgaaagggcattcatttgaggaactggatgccgtttcgccccggatgctgggtgaggagcaggttttgctgctgacggaaggcaactgtatgcgggatcaggtactctcaagctgttccgaattggcggcgaaacaacgtatacaggggttgaccaatacattgcagggcagctcgattaatacaatccgccatatggttgccagcggtttggcaatcagcgtgttgccggcaaccgcactgaccgaaaacgatcatatgctgttcagcattattccgtttgagggtacgccgccaagccggcgggtcgtattggcgtaccgccgcaattttgtccgtccgaaggcgttgtcggcgatgaaggcggcgattatgcagtcgcagcttcacggggtaagttttatctgcgactaggcgcaggcattgttttcaaaacgccatttccctgagccgacaacacggtatgccaagatattgccgtcatcatcgattttgagtatagcatcgccacggaaactgccgtcctgaagatattcgacttttgcatcactgtgaatgttttcatcagtgccgatgcaatgccatgtatagtggattaacaaaaaccagtacggcgttgcctcgccttgccgtactatttgtactgtctgcggcttcgtcgccttgtcctgatttttgttaatccactataaaagaggccgtctgaaaaacatttttcagacggccttgtttattcaatcaaatcagtctttcaacttcgccaactgattttgaacttttgccattttgtcttccaattccgccaaatcggctttgtctttttccaccagatgcgcaggggctttttcggtgtagccgggtttggagagtttggcgttgagtttgtccaaggctttttgcagcttctcggcttctttgctcaaacgggcggtttcggcggctttgtcgatttcgactttcaacatcaggcgcgcgccgttgcagacggcgacgggcgcgtcttcgctttcgggtagggcggcgacttgctgtgcttcggtcaggcgggtcatcatcggcaggtatttgaggtagtccgccaagtcgtccgtgctttcgacaaacagcggggcttttacgttgggctggatgcccatttcgccgcgcaggttgcggactgcgccaatcaaatcctgcaacacggtcatttgctcgaatgccgtctgaacaatctcgccgctgtcggcttcggggaagcgggcgagcatgatgctgtcggcggttttcgcgtcgcacataggagcgacggtttgccacagttcttcggtgatgaacgggataatcgggtgcagcaggcgcagggcggcttcgagtacgcgcaataaggtatggcgtgtggcgcgttggcggctggcgcagccggtttgaagctgcactttggcgagttccaaataccagtcgcaatagtcgttccatacgaagctgtacagggtttccgccgccaaatcaaagcggtaggtttcgtaggcttgcgtaacctgttcgatggtctgattcagacggcctacaatccacatatcggggaaggagtagccgcgcggttcggcagcggttgcgccgtaaccgcagtcttggttttcggtgttcatcaagacgaagttggtggcgttccagattttgttgcagaagttgcggtagccttcggcgcgtttgaagtcgaagttgaccgaacgccccaagctggcgtagctcgccatagtgaagcgcaaagcgtccgcgcccatactcggaatgccttcggggaagagttttttcgtggcttcttccactttcggcgcggtttcgggtttgcgcaggccggtggtgcgttttaccagcagtttttccaagccgatgccgtcgatcaaatccacagggtcaatgacgttgccttcggatttggacatttttttgccttcgtggtcgcgcacgatgccgtggatgtacacgtctttaaacggtactttgccggtgaagtgggtggtcatcataatcatacgcgccacccagaagaagatgatttcgtagccggttactaagacattggacggcaggaaggctttgagttcgtcggtttcagacggccagccgagtgtggagaacggcacaagcgcggaggagaaccatgtatccaatacgtcttcttcgcgagtcaagcctgttttgccggcttgtttttcggcttcttcctgattgcgggcaacatacacattgccttcgttgtcgtaccatgcagggatttgatggccccaccacagttggcgtgagatacaccagtcttggatgttgttcatccattggttgtaagtgttgacccagttttcagggataaagcgtaccgcgccgctatcaacggcttttttggctttatcggcgaggctcaagcctttgaactcgctgtccggctcgccgccgtttggggtggcggacatggcgacaaaccattggctggtcagcataggttcaatcaccgaacctgtacggtcgcctttcggcgtcatcagcgtgtgtggtttgatttcgaccaagaaaccttgttcctgcaaatcggcaaccatttgtttgcgcgcggcaaagcggtctaagcctgcgtatttttcaggcagggcaaagcctagttgcgcttcgcctttgaagttgaacacttcggcgtttgccagcactttggcttccaagttgaacacattaatcaggcgcgtgtcgtggcgtttgccgacttcgtagtcgttgaagtcgtgtgcaggcgtgattttcacgcagcctgtgccgaagtctttttcaacgtattcgtcggcaatcacggggatagtacggccggtcagcggcaggattaattccttgccgattaagtgggtataacgttcgtcttcaggattgacggcaacggcaacgtcgcccagcagcgtttcaggacgggtggtcgccacgataacggcttcggcgggattgtccgccagcggatagcggatgtgccacatagagccttgttcttccacgctttccacttccaaatccgataccgccgtgccaagcacgggatcccagttcaccaagcgtttgccgcggtaaatcaagccttgctcatacaggcgcacgaacacttcggttacggtttcggcgcgcacgtcgtccatcgtgaaatactcgcgcgtccagtcggcagagcagcccacgcggcgcatttgttgggtaatcgtgccgccggaaacttctttccattcccacactttctccaaaaatttttcgcgacccaagtcatggcgggacacgttttgcgcagcaagctgacgctcaaccacaatctgcgtggcgatgcccgcgtggtctgtgccgggaatccaggcggtgttgcagcctttcatgcggtagtagcgggtcagaccgtccataatggtttggttgaaggcatgacccatgtgcagcgtgccggttacgttgggcggcggcagttggatggagaaagacggtttcgtcaaatccatatcaggttggaaatagccctgctcttcccagttttgataatgtttggattcgatttcggctggattgtatttgtctaacatgatggaactttgtgaaattaaggttatttttgatgtgcggattataacgcaaaaaggccgtctgaatcatttcagacggcctttggcatacaggttttaaaaatggaacaataccaggctgacggcaatcaccgccatacccgttgtcaggccgtaaacggtttcatggccgtctgaatagcgtttggcagccggcagcagctcgtccaacgccaaaaacaccatcacaccggctatcacgccgaataccgaaccaaacacggcaggcgacaaaaacggctgcaaaaccaaatagcccaaagccgcccccaacggctcggccaagccggatagcagacacgcccacaccgttttcttacggctgcgggtggcaaaataaaccggcgcggcgatggaaatgccctccggaatattatggatggcaatcgccaaggccaaaggcatcccgactgctggattttccaatgtggcaaaaaacgtcgccaagccttcggggaaattgtgcgcagtaatcgcaaacgccgccatcatgccgactcgcgcgatatggcggcgtttgctttcttgaaacgacgggtcttgcgcgtctaaagtttcatgcgggttcggcaccagacggtcaatcagcgcaatgccgcccatcccggccaaaaatgccatggtcgccgccgcaaacgcgtggtctttatcataaatttcagcgaacgcctcgctggacttactgaaaatctccgtcagggaaacatataccatcgcaccgccggcaaacgccaaaccaaacgacaacacacgcggattgggcgttttggaaaacatcaccaagccactgcctaatacggtaaacaaaccggcagccaatgtgatggaaaaggcaacggccaaattggacatcgaaaaatcgggcatgagaaaacctgcgctaaaagctgggacaggttcagactaacactttttaatgtatatgataatagttattatttattttattgattggatacacggattttgaaacaaaaggccgtctgaaaaatgattttcagacggcctttaaatttgaaatgccgctaaaccttagtgctttccagcttaagcctgataacgcgacaggctcaaatcgtcgctgcggatttcggtgtctttgccgctcacgatatcggcggttaattttgccgaacccagcgacatggtccagcctaaagtaccgtggccggtattcagaaacaggttgtcaaagcgggtgcgaccgattaacggcgtgctgtcgggcgtcatcggtctgaggccgctccagaacgatgcttggctcaaatcgccgccttccgggaacaagtcgttgacgaccaaagccaaggtttcgcggcgtttttcgggcagtttgatttcgtagcccgacaattccgccataccgccgacgcggattctgttgtcaaagcgcgtgatggcgactttgtagctttcatctaaaacggtggacaccggtgcgccgtctgaattggtgaccggcagggtcaaggaatagcctttgacgggataaatgggcagattgagatccaactgcgccaaaaccgtcctgctgaagcaaccgagcgcgcagacaacggcatctgcttcaaaccgccctgtttcggtttcaacggttttgatgcgcagcccgttgtggtcgatgcggctgatgttttggttgaaatgaaaccgtacgcccttttcctgacacaatttgtataggttttcagtgaagaggcggcagtcgccggtcgcatctgcaggcaggtgcaggccgccggcaattttggcggtaacgcgtgccagcgcaggctcaaattctgcacattcttcgggtttcagacggcggtacggcacgccgtagcgttccaaaacggcaatgtcttgttttgccgcttcgacttctttggtttggcggaaaatctgcaacgtcccttttttgcgtccctcaaaattcatgccggtttgcgcttcaaaacggcggaacatttcacggctgtattcggaaatcctgaccatgcgctctttattggtttgatagtgcgctgccgtgcagttttgcagcatttgccacagccattcgatttgatacaggctgccgtcggggcgaaacagcaaaggcggatggcttttaaacagccatttcagcgctttggtcgggataccgggtgcagcccaaggcgtggtatagccgtaagaaagctggcctgcgttggcaaaactggtttccatcgccacaccctcggcgcggtcgatgaccgttacttcatgtccggcctctgccagataccacgcggaagacacgccggcaacacccgcacctaaaacaagcactttcatgtttctccctccggctttttcaaaacagacttaatatgccgtgccgtctgaatattcggattcagacggcctcggatattaatgcggcaattcgccgtttgtgattttttgtttgaagtcgcgcgtttcattgacgatgactttcgccatcaataaaagtgcaatcaggttgggcaatgccatcaagccgttgaatgtgtccgaagccagccacaccaaatcaaggctcaacacggtacccagcataacggaagaaacataacccacgcggtacaaaccggcaaatttctcgccgaaaacatacaccgcgcatttttcgccgtaatagcaccagcccaaaatggttgagtaggcaaagaaaatcaggccgatggtaacaatccagccgccgatgccgggcagcattttttggaatgtgacggttgtcagtgccgcgccgctcacttcaggtttgacaaactcgccgcccgcgccgagcagtcccattaccaacacgatgccggtaatcgagcaaacgacgatggtatccaaaaacgtaccggtcatagaaaccaaggcctgacggacgggatggtcggttttcgcggctgcggcggcaataggcgcagaacccatacccgcctcattggagaacacgccgcgcgccacgccgtagcggatgaccgtaccgatagcaccgcccgccactgcctgcgcgctgaacgcatcggagaaaatcagcttgacggcaggcatcagtgcatcggaattaatcgcgataatggaaagaccgcccaacacataaaacaccgccatagcaggcacgatgaaagaagcggctttggcgatgcctttaataccacctaaaacgacaacggcagtcagaacggtcaacgtaatgccggtataggcaggttcgataccgaagctggtttgcaccgcctgtgcaaccgagttggactgcaccgagctgccgataccgaaggaagcgaatgtgccgaacagcgcaaacgcgacggccatccatttccagtttttgcccaagcctttttcgatgtaatacatcgggccgccggacatttcgcctttggaattgttgacgcggtatttcaccgccaacacgccttcgccgtatttggtggccatgccgaaaatggcggtcatccacatccaaaataccgcgcccgggccgccggttaccaccgcagtcgccacgccggcgatgttacccgtgccgatggtggcggacagcgcggtcatcaacgccgcaaaatgggaaatatcgccttcgtggccttcgccgcttttatgcttctttggcggcataaacgcctgtttcagcgcataacccaacatcgtgaactgcaaaccttttaataaaacagtcagcaaaatacccgtgccgaccagcagcatcagcatcaaaggtccccaaacccagccgctgacggtttcaaaaaaggctttgggattgtctaaaaacacttgcatggctttctcctttgtctgttttatttttaaaacaccacttttgtagtgtccagtaatttcagcacagaatatccaataagacaatatgttcttttgaaaaatacttttggttttttcgccgaaaacaggacggttcaagttgcggaaattgtttgcaattctttaaaagcagcggcggaggtcacaatgaaatgtccgaatggggatgtggcgggcggcagaaatcatcaatgctgccgactgccatacttctgaaatctacaaaatgatgcatcgatcaaacaatataccgctttaaaaaaaccgatgccgtctgaaacgctttcggggtttcagacggcatcaaaagggtacggtcagcggatgatgccgcgcgccgattgtgcgaaaaagtctcggaatacggcaagctcggcttgggtttcggcgcggcggagaatgtctgccttggcttcttcaaacggaatgccgcgatggtagagggttttgtacacgtctttgacggcggaaatctgctctgcggtaaaaccgttgcggcgcatgccttcgctgttgagccccgccggttcggcgcggtagcccgatgccataaagtagggcggcacgtctttgtgtacgcctgcggcaaacgcggtcatggcgtagtcgccgatgcggcagaattggaaaaccagcgtgtagccgcccaaaacgacgtagtcgccgatggtaacgtgtccggcaagcgaggcgttgttggcgaaaatggtgtggttgccgatgacgcagtcgtgcgcgaggtggcagtacgccataatccagttgtcgtcgccgatacgggtttcgccgatgccggttaccgtacctaaattaaaggtggtgaattcgcggatggtgttgccgttgccgataatcagcttggtcggctcgtcgcggtattttttgtcctgcgggatttcgccgaggctggcaaattggaaaatgcggttgttttcgccgatgctggtgtggccgttgatgacggcgtgcggaccgatttcggtattcgcgccgatttggacgttggggccgataacggtgtacgcgccgactttgacgccggagtcgagttcggctttggggtcgatgacggcggtcgggtggatgagggtcatgtttttcctttcctgtcgtgttgccgcgaagatgcgcgacggcaacaggttgtctgaaaactttcagacgacctttttctgaacactcaaaccacgcgtttggcacacatgatgatggcttcgacggcaacttgcccgtccactttggcaacggcgttgaatttgccgatgccgcgccggctggtcagcagctcgacttcaaagacgagttggtcgccggggatgacttggcgtttgaaacgggcttcgtctatgccggcgaagaagaagaattcgttttctttgcgcccgccttcgctcaaaatcgccaacgtgccgcacgcctgcgccatcgcttcgatgatgagtacgccgggcatcacgggcaggtcggggaaatggccttggaactggggttcgtttatggtgacgtttttaatcgcggtcagggttttcatcggctcgaaggcggtgatgcggtcgagctggagaaacggatagcggtgggggatgagtttttggatgtctttggcttcgatggggagttgtacgtccatgtctgtcgtattccttgaataaagtcggtttggttatttgctgtcttgaccggcatctgaaagctgctgctccagtgttttgagccgtttgttcatttcgcttaagcggtggatgtaaacagcgttgcgcgcccattctttatgggtggacatcgggaagatgccggcgaggtgtttgccgctttcggtaatgctgtgggtgacggacgtgccgccgccgatggtggttttgtcggcgatttcgatgtgtccgaccgtaccgacgccgccgccgatgatgcagtagctgcctatggttacgctacctgagatgccggttttggcggcgatgacggtgtgcgaaccgattttgcagttgtgtccgatttggacttggttgtcgattttggtgccgttgccgacggtggtgtcgctcatcgcgccgcggtcgatgttggtgttcgagccgatttctacgtcgtcgcccagcgttaccgcgccggtttgcgggattttgaaccacgaatcgtcggcgaaggcgagtccgaaaccgtccgcgccgatgaccgcgccgctgtggatttcgacgcgtctgcccagtgtgcagccgtaataaacgacggcgttgggatgcaggacgacttcgtcgcccagtttgcaatcgtgttggacgacggcgtttgccaagatgcggcagccttcgccgagcacggtgtttgcgccgatgtagacgttcgcgccgatttcgcagctggtgggaacggtcgcgcccggttcgacgacggcggtcggatggatgccgccgcgcgctttgacgacgggtgaaaacaggcgggcgactttggcgaaatagagataggggtcgtcggcgacaatcaggttgcgcccttcaaatccgtctgccgctttggcggaaacgatgaccgcgcccgcgctgctgtcgtggacttcggctttgtatttcggattggcaaggaagctgatgtgttccgcctgcgcgtctgcgagcgggcgcacggcggtaacggaaatgtcctcgccgcgccattcgccgccgagccgcgcggtgatttgggacagggtgtaggtggccggaatcatggttttcctgttcggtatgccgtctgaaagggtcagcgggcgttcatttctttaatgacgctgtcggtaacgtcgtattgggtgttgacgtaaatcacgttctgcaaaatgacatcgtaaccttcctgtttggcgattttgacgatgacgcggttggcgttttgctggagggaggcaaactcttcgttgcggcggaggttgtagtcttcttcaaactgcgcctgttttttgcggaacgctgcgaccagcccgcgccatttttcttcggcttgcgccttttttgcgtttctgagtttgccttcggcaagctgcctttccaaatccagaccttcgcgttgcagtttttgcaattcgtcctgacgagcggaaaattcgctgtccagcgttttttgaatcttgcgcgcctgcttggattcgaggtagatgcgctcggtgttgataaagccgattttttggaaggtgtcggcgtgcgcgcctgcggtgcagcacaaaccgatcagagccgcggcaaacgcgcgggtcaaacgggtcatggtaaaactccttcgaatgttgccgcgaaatgccgtctgaagggcttcagacggcatttgcgggattagaacgtcgtgccgagttggaattggaagcgttggatttcgtcttccggttttttcttcagcgggtaggcgtagctgaatttcatcgggcctaaaggcgagagccaggtaaccgcgccgccggcggaatagcgcaattcgttggtaaaggtggatttatgggtattgccggcgccgtaaatgttttgaaccctgccgccggtcgcggaactgctgttgtcgtcgtaggttttgccgtcccacacgctgcctgcgtcggcaaacaggctcaggcggacggtgcgcgcgtctttcgcgccgggcatcgggaagagcagctcggcggagacgttggcttttttgttgccgccgtagctgattttttcgccgtattcgtcatagactttcggaccgagcgtgccgctttcgtatccgcgcaccgaacccaggccgccgccgtagaagttttcaaagaaggggatttctttggttctgccgtagccgcccgcaatgccgacttcgccgccgagcatcagcgtgaaggttttgctcagggggaagaaccaggtttggttgtgggtggcggagtagtattgcagtttgctgccaggcagggcgatttcggcgttcacgcccgtcaggtagccgcgcgtcggccataacgcgctgtcggttttgttgcgcccccagccgacggtacctttgtacagccagcctttgaagctgccgtctgtgccgtcggttttgccgtatttcttgataaagtcggcatagtgtttgggcgctttgttgtaggtgttgacggtcaggtgttctgccaccaaaccgaaattcacgcggtcgtattcggtaacaggcacgctcatgcggatgcctgcgcctgccgtggtggttttatattgtttgatgctggtcgatgctttgcgcgggtcgaaggcttttccgtaaacatcgtagcccaggctgaccccgtctgccgtgaagtacgggtcagtaaacgacagcgagccgttaagcgtggttttgctcctggaggcgcgcagtgcggccgacttgcccgtaccgaacaggttgtcttgggaaacgcctgcggacatgaccaacccggtatcttgaacccaacccgcgctcaaatccagggaaccggtggaacgttcggtcagactcatgttcaaatcgactttgtcgggcgtgccggcaagcgggacagcatcaaactggacattgtcgaagtagcccaaaagctcgacgcgctctttggaacgttgcagcttggaggtgtcgtaaggtgcggattccatttggcgtaattcacggcggacgacttcgtcgcgggttttgttgttgccggtgatgtgtatttcgttgacgtagattttccggcccggttcgatgtgcaggacgaaatcgacggttttggtttcagcgttcggcagcggctgtacgctgatttcgctgtatgcgtagcctgccgagcccatgcggttctgaatctcacccaaaacggcggtcatctgctggcgttcgtaccatttgccgggcttcatggtcagcagtttttccagttcggctttggggacttcgttggtgtcgccttcgatggagactttgccccaacggaaacgtccgccttcgtggacggtgattttgatggtctgcttggttttgtcttcgttggtttggatgtcggtatcgaggatacggaaatcgaagtagccgttattttggtagaagtcggttactttttccatatcttgggcaaatttctgctcgttgaattggttgcttcgtgtcagccatgtccaaatgccgccttcggtcagggacatttgccgcatcagtttgcggtcggaatagacttggttgccttcaaattcgatgtcggtgattttggcggatttgccctcgtcaatcgtgatgtcgatgtcgacgcggttgcgggcgagtttggttactttgggcgtgatttggatattgagtttgccgcgcccgaggtattcttctttcaggccggcgactgcctgattgagtgtcgcctgattaaagtattgcgactgcgccagcccgaacgattcgaggtttttcttaatggcgtcgttttgcagcatttttgcgccggtgatgttgagcgagccgatggtggggcgttcgataacggtcagcaggagctgcccgtccgcagtttcgacgcgtacgtcgtcaaagaaaccggtggcgtacaggcttttgatgatggcactgccgtgtgtgtcgttgtaggtgtcgccgactttgacgggcaggtagttgaatacggtactcggctcggtacgctgcaagccttcgacgcggatgtcttggatggtgaagtcggcaagtgccaaaggcgatatgcccaacatcatcagtgcggaagcaatctgtttcagtttcattgtcagttccttgtggtgcggaatgcggtttcagacggcattccgaaacgtaaaatctaaccgagcagccgggtaacgtcgttgaagaaggcgaccgccatcatcagcatcatgagggcgagcccgaagcgcaaaccgatgttttggacgcgttcgcccaaaggtttgccgcgtatccattcggcagtataaaacacgaggtgcccgccgtccaaaacagggacgggcagtaggttcagcacgccgaggctgatgctgaccagtgctaaaaattccaaataactttgcaagccgagttcggcggactgtccggcaatgtcggcaatggtcagcggcccggaaatatggctgacggaggcgttgccgctgattagtttgccgaaaaatttgagggttgtccacgagtgggaaacggttttttcccagcccatgccgaatgcgcggacaacagacggacggtagctgcggcggatttgcgcgtcccacgccctgtccggctgcggacggaggccgacgcgcccgatcagggtgtggtcggactgttcgacagtatcggggcggatgtcggcggtatgggtttgtccggcgcgttcgtagttcagggtgatttttttgccggggctttggcgggtcaggtttgcccattcttgccatgaggcgatgggtttgccgtcggcggcagtcagcctgtcgcccggtttcaggcctgctttttcggcggggctgcctttttccacgccgccggcaacggttgtgattttaaagggcatcagtccgatgtagccttggttttttgcgattttaccggcttccggcgtgcctgcggcatcgatggtgcggacggtttgcgcgcccgatgccgtctgaacgccgacggcgactttgccggcttcgaggttgaggacgatttcggtttgcgcgctgccccaatctgcaacgggtgtgccgttgacggattgtattttgtcgccgctttggaagccggcgcgggcggcaatggtgtcgggttcgactgtgccgacgtaggggcgcagttcggttacgccgaaggaaaagctcagtccgtacagcaaaaccgccagtgcgaggttggtcagtgggccggcggcgacgatggcgatgcgcttggcggggtgttgtttgtcaaaagcgtagggtaaatcggcttctgatacttcgccttcgcgcgtatcgaccattttgacgtaaccgcccaacggaatcggggcgaggcaccattcggtgtcgccgcgctttcgggtgaaaaacggtttgccgaagccgacggaaaagcgtacgactttgacgccgcacaatctggcaacgatgtagtgtccgaactcgtgcaggctgaccaaaatcaggatggcgaagataaaagctagaagggtgtgcaaatggttttcctttgataacggtgttcagatggcatcagcgcagtgtgccgataaatgctcgcgcttgtgcgcgtgtccgggcatcttgcgccaagagcccccctatatcgcctatgccgtctgaaaagtcttgtgcaagacagtgggcgacggttttggcaatgtcggtaaacttaatctgtccgtccaaaaaggcggcgacggcggcttcgttggcggcgttcaatacgcagggcgcggctccgcctgcgttcatggcttcataggcgagcctcaggcaggggaagcggtcaaagtcgggcttttggaaggtcagcgcggacaatgcgtcgaaatccaggtcgccgacacccgaatcgatgcgctcgggcaaacccaaacaataagcgatgggcgttcgcatatcgggattgcccagttgcgccagcacggagccgtcgcggtagcgcaccatgctgtgtatcacggattgcggatggatgacgacttcgagtttgtcgggcggacagttgaacagccaatgcgcttcaatcagctccaaacctttgttcatcatggtggcggaatcgacggagattttgcgtcccatacgccaattggggtgtttgaccgcttgggcgggcgtaatgcggtcgaacgtgtttaaatcggcggtcagaaacgggccgccggaagcggtcaggataatcgaagcgatgccgtgttcgttcagacggccggcgtaatcgcgcggcaaaacttggaaaacggcgttgtgttcgctgtcgacgggcagcactgccgcgccgtttgcacgggcggtttccataaacaacgcgccggaaaccaccagcgtttctttgtttgccagataaatggttttgcctttttgcgccgctgcgagcgcggaaggcagccccaccgccccgacgatggcgcacatgacaccgctgacttcgtcggcagaggcaacgtcaaccaatgcctgcgcgccgtgtaaaacctgagtcgccgtgccgtcgcgtttcaacagggcttcaagccgggcggcgtgttccgcatcggcaacgacggcatattcggggtggaacgtttgacattgagccgccaatttctcgacctgcttatgccctgccagcgcgaatacgcggaatttttcggggtggcgggagacaacgtccagcgtgctttcgcctatgctgccggtactgcctaatatggtcaggacttgtggtgtcataatggggataactttataccggatgccgtctgaagcgttttcagacggcatagaatcaatttaaaaccgacatcatcgctgcatagacgctgataacggcaatcaggctgtcggtacggtcgaacacgccgccgtgtccgggcagcagcttgctgctgtctttgatgcctgccgcgcgcttgagccagctttccaaaaggtcgccgcatacgctgacaacggtcagcaccaaaccgattaacacggtatcgaaccagcctgtatcgaatgccagccagccggcacttcgtacggcggtcatgtacactgccacgcaaaccgcgccgccgattgcaccttcccagcttttgccggggctgattgccggcgcgattttgtgtttgccgaacgccttgccgctgaaatacgcgcaaatatcggcaacccacaccaaacccatcacggcgagcagcggcagggcatcatcgggatgcgggcgcagggatacgagcgcgaaccaaaacggcatgaccagaagccagccgacggcataaacctgccaaccgccgttgagcctccatttgaatctcaaccataaaggcataacggcgagccaaaatgccaaaacaacataccaaaccaaattaggcagcatccagccgcccgcataggcaaccacgccgaaaaccaaggttgcggcgaggtaatggttggttttaattttgcacaaaccgcccatacgggcatattcccacaaggcaatcagggcaatcagtccgcaaaatgcagcccacaaccattgcggcgcgtaaaacagcatgcccagcatcagcggcagcagccacatggcggttattacccgttgtttcagcatattcagttcctttgctgttcgataggcagttgctcggaggtgcgtccgaaccgccgttcgcgtttttggaacgaagcgacggcatcgtccaaagccttgccgtcaaaatcgggccacaaaatatcggtgaaatacagttctgcatatgccatctgccagagcaggaaattgctgatgcgcgtttcgccgccggtgcggatgaacaaatccggttccggtgcatcgcccagcatcaagtgtttcgccagcgtgtcttccgtaatctcggatacgccttcggcaatcagtttgtttgccgcctgcaaaatatcccagcggccgccgtaatcggcggcaatgctcagggtcaggccggtattgtttgccgtcaacgcttccgcctcttcgatgccttgcagaatctgccggttgaagcgttcgcggctgcccaatatcttcaggcgcatattgttttcgtgcaggcggcgtacctgtttttgcaaagcctgtaaaaacagccccatcaggaacgaaacttcgtcttcggggcggcgccagttttcggttgaaaaggcaaacacggtcagatattgcacacccagtttggcgcaatgcttcaccatattttccaatgcgtccaaaccgcgtttgtgtcccattatgcgcgggaggaaacgttttttcgcccaacggccgttgccgtccataatcacggcgatatgcttgggaatggcggtgtgttccaaaacggcctgcgtgctgcttttcatgtctgcctttcgcggttcggcattcaaatgccgtctgaacgccgaaccgtgcaggttaaattgccatcaaatcttcttctttggcagtcaggagtttgtcggcttcggtaatgtatttgtcggtcagtttttgaaccgcttcttcgccgcgacgtgcctcgtcttcggaaatttctttgtctttgaggagttttttgatgtggtcgttggcatcgcggcgcacgttgcggatagagacgcggccttcttccgcttcgccgcgtacgactttaatcaggtctttgcggcgttcctcggtcagcatgggcatcggcacgcggatcaggtcgccgacagctgccgggttcagtcccaagtttgaatcgcggatggctttctcgactttggccgccatattgccctcaaacggtttcacgccgatggtgcgcgcgtccagaagcgttacgttggcaacttggctgacggggaccatgctgccccagtattcgacttccacttggtcgagcaggccggtatgcgcgcggccggtacgcactttcgccagattttctttcagtacttcgaccgaacgctgcatcttgccttcggctgttttttgaatatcgttgatcatattgttctttcggtgggataaggtgggcgggagaccgtctgaacgcgtttcaagccgttcagacggcataaagaccgttaaccgcgaatagtaccgttattcgggcataacgacaaggtaggcggattggggatgccgtctgaagcgacaggcgtttcagacggcatcgtgtccgaccgtcagccgtgttcccgtgtttcaagcaggctttggcgcaggtgttggcgttcgtgggcatccagccatttgcggcgggtgcgttgcagcaggatgacgagggcggaaatttcctgacgcatattggtgctgagccagaggaagccctgccattggtagtggaggtgttcggcgagggcttccagttcggggttgatggcggtgtcgatgcggatgcggcgggcgtgtctgccgttgataagggcgacggtttgttgcaggtcggtttggagcagtgtgaagtggcggtcaagcagccggatttcgctgccgttgagtttgggagattgcagcttggcggcggtggtcaggagcagctcggtggtgttgacgattttacggtgggcgtgctgcatggcttccatcatggcggggctgatgcggctttcgcccgatgtggcggcgagatggctgcggcttttgaccatgcgtgcgttgatttggcgcattttcgccatgttctcctcgaggcgttcgcgggtcatgcgcctgccgttgctgatttcggcaatcattttgctgcagtcggccaggttgtcggcaagcatgaaacgccacatcagtgtggatttcagcggcagcagtttggcggcggcgatggcgatggccgcgccgatgaggacgttcatggcgcgcatgagtccgctgtcgagccattcgctgccgttgtcgccgatgagcatacacatcgtcagccctgccagcatagggacgtagccgtttttgccgaccgccgcccagccggccagtgcgcttgccgtgccgacggtgaggtagaagaggaggttgccgtggaaataatgctggttcagccataaaacgcccaaacccgcgcccagcccgatgaccgtgccgagcatacgttccaccgccttggagtaaatcgccccttgaaactggagcatgccgaggacgacgaagacggtcatccctatccactcgccgtgttggaggtggagcagccgggcggaggcggtggcgaacaggacggccccgccgagccggacggcgtggatgaggcggcggtagcggtagcgttcgtaggagttgagccagcggctgacgaggcggttgcgttgcgaggtgttcatatcggttgtgccgtctgaagcggaaatgtgaaaaagcacaggcttcccgaggaagggagggtctgtgcttggtattggtgccggagaagggaatcgaacccccgaccttcgcgttacgaatgcgctgctctaccgactgagctacaccggcgttttttcgtcatgatatatatgaacggttgtttgtgcaacttttcgggcgggcggcaaggcagtgcgcggtatagtggattaacaaaaaccagtacggcgttgcctcgccttagctcaaagagaacgattctctaaggtgctcaagcaccaagtgaatcggttccgtactatttgtactgtctgcggcttcgtcgccttgtcctgatttttgttaatccgctatataatgcggtctgcttcggaagagggggacggcgatgtttgtgaacgagaaatatccttatgcggctctgtttgcgggactggtgtttttgacgctgccgtttgcgttggcggtgcatgatgcctttgcgcttgcgttcggacggacggggttgctggtgtcggtgtcggacggcggattcggctggcgtggcggttgggacggcactgtttggtttgtgttcggtgtgtttgcgtttttgaatgtggttgtgtcggcgggtctgacgaaactggcgtacaaaaagatgatgcggcggcattcgcgttacacactgtttctgtcgggcgtggcggcttgcgcggcggcagcggtggcttggattttcgagctgctgcttggcagtggggctttgggcgggctgcgggggaggcggtgttggaatatgcgtttgccgtgtggctggtggcgatgctgacgctgcccaaacgcctgacgcgcgcgccggtgcagccggtggtgtttcacaggaaaaaataggttggaacgggaaatgccgtctgaaacccgacacgcggtttcagacggcatgtttttccgctaacattacgcctgaatatggacaggaagcagatatggaacgcaaagaacgcctgcgtgcaggcattgccgcgatggggctggatatttcggaaacggcgcaggacaggcttttggtctatgtggatttgttgaaaaagtggaacaaaacctacaatctgaccgccctgcgcgacgaggaaaaaatgattgtccatcatcttttggacagcctgacgctgctgccccatatcgagggtgtgcaaacgatgctggatgtcggttcgggcggcggtcagcccggcattccggcggcggtgtgccgtccggatgtgcaaataacccttttggatgcgaatacgaagaaaacggcttttttacagcaggcggttatcgagttggggttggacaatgtgcgcgtggtatccggacgcgtggaggcggtttcggacgtgcgtgccgatgtggttaccagccgtgcgtttgcagaactggcggattttgtgtcgtggacggtgcatctgttgaaagacggcggctactgggcggcgatgaagggcgtgtatccgcaggaagaaatcggccgcctgccgcaggatgtgtgcgttgaaaaagtccaaaggctcgacgtgccgggcttggatgcggaacgccatatcgtcatcctgagcaagcgttgagcgcacttcagacggcatgaataccttttttgtgcggataaaggtaaaattccgcactgtttttcttttttcaacatcagacgggacacgggcgggacatgagtgcgaacatccttgccatcgccaatcagaagggcggtgtgggcaaaacgacgacgacggtaaatttggcggcttcgctggcatcgcgcggcaaacgcgtgctggtggtcgatttggatccgcagggcaatgcgacgacgggcagcggcatcgacaaggcgggtttgcagtccggcgtttatcaggtcttattgggcgatgcggacgtgcagtcggcggcggtacgcagcaaagagggcggatacgctgtgttgggtgcgaaccgcgcgctggccggcgcggaaatcgaactggtgcaggaaatcgcccgggaagtgcgtttgaaaaacgcgctcaaggcagtggaagaagattacgactttatcctgatcgactgcccgccttcgctgacgctgttgacgcttaacgggctggtggcggcgggcggcgtgattgtgccgatgttgtgcgaatattacgcgctggaagggatttccgatttgattgcgaccgtgcgcaaaatccgtcaggcggtcaatcccgatttggacatcacgggcatcgtgcgcacgatgtacgacagccgcagcaggctggttgccgaagtcagcgaacagttgcgcagccatttcggggatttgctttttgaaaccgtcatcccgcgcaatatccgccttgcggaagcgccgagccacggtatgccggtgatggcttacgacgcgcaggcaaagggtaccaaggcgtatcttgccttggcggacgagctggcggcgagggtgtcggggaaataggtcaatccaaatcgggctgcccgtgcctttatgctgtttggccgggtgcgttatagtggattaacaaaaatcaggacaaggcgacgaagccgcagacagtgcaaatagtacggaaccgattcacttggtgcttcagcaccttagagaatcgttctctttgagctaaggcgaggcaacgccgtactggtttttgttaatccactataatatggcggattaaaataaaaatacttatatcgtcatttatcgtcattcccgcaaaaacaaaaaaatcaaaaacacaaaactgaaatatcgtcattcccgcgcaggcgggaatctaggtctgtcggtacggaaacttatcgggaaaaacggtttttccaaccctgagactccggattcctgttttcgcgggaatccggttttttgagtttcagtcatttttgataaattcttgcagctttgagtttctagattcccgcttttgcgggaatgacgcggaaaagttgctgtgatttcggataaattttcgtcacgcttaatttctgttttatccgataaatgcctgcaatctaaaatttcgtcattcccgcaaaaacaaaaaatcaaaacagaagcctaaaatttcgtcattcccgcgaaggcgggaatctaggtctgtcggtacggaaacttatcgggaaaaacggtttttccaaacctgagactccggattcctgttttcgcgggaatccggttttttgagtttcagtcatttttgataaattcttgcagctttgagtttctagattcccgcttttgcgggaatgacgcggaaaagttgctgtgatttcggataaattttcgtcacgcttaatttctgttttatccgataaatgcctgcaatctaaaatttcgtcattcccgcgaaggcgggaatctaggtctgtcggtacggaaacttatcgggtaaaacggttttgccagccctgagactccggattcctgttttcgtaggaatccggttttttgagcttcagtcatttttgataaattcttgcagctttgagtttctagattcccgctttcgcgggaatgacggtttggaagttacctgaaattcaaaaaaaaaacggaaaccggacggattggattcccgcctgcgcgggaatgacggattttaggttttttttttgattttctatttttcgcgggaatgacggtttgggttctttctctttggagttgcgatgccggaaatgccgtctgaaggcttcagacggcatttttgtgccggtttaaaacaaggcctgctgcgcgagcaggtttctgacgggggcgaagtcgcggcggtgttcgggcagcacgccgtatttttcgagggcttccaaatgctgcttcgtgccgtaacctttgtgtttgtcgaaaccgtattggggatggcgttgcgccagtgcgtacatttccgcatcgcgtgcggtctttgccaaaacggatgcggcggagatttcgatgattttgctgtcgcctttgacgacggcttcggcagggatgttcaaatgttcaggaatgcggttgccgtcgatgaatattttttcgggacgcacagccaagccgtcaacggcgcgtttcatcgcgagcatggtggcgtgcaggatgttgaggctggcgatttcttcgggcgaggcggcggcaacgtgccactcaaccgcctgattttttatcatttcggcaagcgcgtcgcgttttttctcgctgagttttttggagtcggtcagtccgggcaggtcgaatgtttccggaaggatgacggcggcggcaaacacgctgccgactaaaggtccgcgtcctgcctcgtccacgccggcggtcagtatgtgcatgatgtttcctgtcgggatggtgggaatgccgtctgaaaagggtttcagacggcatcgcgccgatgtgtttatttcgcgtctttaaacccgcgcttcaaatgcaccatcagcaatgccactgccgcaggggttacgccggaaatgcggctggcttgtccgacggtttcgggtttgtgctggttgagcttttgctgcacttctgccgacaagcctttgactttgccgtaatcgatgccgtcgggcagttttaaggtttcgatgtcgcggcggctgtcgatttcttcgttttggcggtcgatatagccttggtatttgacttggatttcgacttgttcgatgacttcggcggagaggttttcagacggcatcgcgccttcgagcgtcatcagcgcggcgtagtcgaggtttgggcggcgcaggaggtcgtgcaggttggcttcgcggctgagtttttgtccgaacacacggatttgttcgccttcggcgagtttttgcggcgtgtaccacgttgttttcaaacgttggatttcgcgttcgacggcttcgcgtttttcgttgaacatgcgccattgcgcttcggacaccaagccgattttgtagccgtcttcggtcaggcgcatgtcggcgttgtcttccctgagttgcaggcggtattcggcgcggctggtgaacattcggtagggttcgttcacgcctttggtgatgaggtcgtccaccaatacgccgaggtaggcttgttcgcggcgcagcaggagcgggtcttgtccgcgcacatattgcacggcgttcgcgcctgccaataaaccttgcgcggcggcttcttcgtagccggtcgtaccgttgatttgcccggcgaaaaacaatccggcaatggttttggtttcgaggcttgctttgaggttgcgcggatcgaagtagtcgtattcgatggcgtagccggggcgcaggatatgggcgttttccaaacctttcatactgcggacgagcgcgatttggatgtcgaacggcaggctggtggagataccgttaggatagtattcgtgcgtggtcagaccttcgggttcgaggaaaatctggtggctgtctttgtcggcgaagcggttgattttgtcttcgatagacggacaataacgcggacccacgccttcgattttgccggtaaacatcgggctgcggtcgaagcctgagcggatgatgtcgtgggtttgcgtgttggtatgcgtaatccagcaggacacttggcgcgggtgcatatcggcgttgccgcgcacggacatgacgggaacgggcgtgtcgccgggctgttcggtcagttgggagaagtcaatcgtgcgtccgtcaatacgcggcggcgtgccggttttcagacggccttgcggcagcttcaattcgcgcaaacgtccgcccaacgatttggcggcggggtcgccggcgcgtccgccttcgtagttttccaaaccgatgtggattttgccggacaaaaacgtgcctgcggtcaacacgacggcgcgtgctttaaactccacgcccatcgcggtaattacgccgctgatgcgttcgccgtcgagcgttacgtcttcgacggcttgttggaaaaggtcgaggttttcttggttttccaacatttcgcggatggcggctttgtacaggatgcggtccgcctgcgcgcgcgtggcacgcactgccgcgcctttgctggcgttcaggcggcggaactggataccggatttgtcggttgccaacgccatcgcgccgccgagcgcgtcgagttcgcgcaccaaatgccctttgccgatgccgccgatagaggggttgcacgacatttgtccgagcgtttcgatattgtgtgagagcaaaagcgtctgcgcgcccatacgggcggcggcgagtgcggcttccgtgccggcgtgtccgccgccgacgacgataacgtcgtaggttttggggtaaatcatgtgggtcatagtgtgtattgcctgacggtgtttcagacggcatttatagtggattaacaaaaaccagtacagcgttgcctcgccttagctcaaagagaacgattctctaaggtgctgaagcaccaagtgaatcggtttcgtactgcttgtactgtctgcggcttcgtcgccttgtcctgatttttgttaaaccactatattcaatatgccgtctgaaaaacgaaatggattcaaaagtaaagggttgggattgtacgcttgttcgccctgtttttacagtgtgcggaaagggaaaagccgcttcgcggggaagcggctccggtaagggcgggatttaccaaacgtcggatttgatacggcgtttcaggcccggatgttcggaaagtttgaactcggggtctttgcccattttcagcttggcggtgtaatcgcgcagcagcataaacgccaagggcgagagcagcaggatggcgacaaggttgatccacgccataatgcccatcgccatatccgccatatcccagaccaaaggcacattggcaaccgcgccgaaatagacccacgccaaaaccagcatacggaaaacggcggtaatcagccaatggcttttgatgaattggacgttggactcggcataggcatagttgccgataacggtggaaaaggcaaacataaacaggatgacggcgaggaagcccgcgccccattgccccacttggctgacaatcgccgcctgcgtcagcgccgcaccgctcaaatcgccgtaaggctgttggtaaatcaagatgatgaaggcggtgcaagaacaaacgatgatggtatcgacaaacacgcccagcatttgaatcataccttgcgaaacagggtgtttcacttcggcggcggcggcggcgttcggcgcggaacccatacccgcctcgttggaatacaggccgcgtttgatgcccatcatcatcgtttgcgaaatcagaccgccgagtaagccgcctgctgccgcgtcgaatttgaacgcgcccgaaaaaatctgaccgaacacgtccggaatcatcggaatattggtcaaaatgatgaaaagcgcgataaagaggtacaaaaccgccatcagggggacgacgatttccgccgctttagatatgcgcctgatgccgccgaagataatcggcgcggttaaaatcaccagggcgacgccgacataatgaggctcccaaccccatgccgctttgacggtatcggcgatggtattggtctgaaccgcttcaaacacaaagccgaaacagaaaatcaggctcagggcgaacaacacgcccagccatttctgccccagcccttgagtgatgtagtaggcagggccgccccggaaatggtggttgtcgtagtcgcggactttaaagagctgcgccagcgaagattcgacaaacgccgaactcataccgattaaggcggttacccacatccaaaacaccgcgcccggtccgccgactttgatggcgatggccacgcccgcgatattgcccacgcccacgcggctggcaaggccggttacaaatgcctgaaacggcgtgatgccgtgagggtcgtccccctgtttgcggccgccgagcatttctttgatgctgcgcccgaacaggcggaattggacaaagcccgtggttacggtgaagaaaagccccgtacccaaaagcatataaaccaagtatgaccacatcggatcgttgatggcgccgacccagccgtgcagccattcggtaaagttctcgttcatatcgcttccttaaagttgaaactcgcacatattggcggtatgcaagcagggtttaaattttgtaaacgcccattctagcagattgtcaacaaaatcagaaaaatttacatcgccgcgcggctgcggcgttagaatcgcattttgtttggagcaaacacgatgaaacagcctgtttttgccgttacttccggcgagcctgccggcatcggccccgatatttgtttggacttggcgtttgcacgcctgccctgccgctgcgcggtattgggcgacaaaaacctattgcgcgcgcgcgccgaagccttgggcaaaagcgtcgtcctgcgcgacttcgatccagaatcaggcggcgcggcatacggcgagctggaagtgctgcacatccctgccgtcgaagcggttgaggcgggcaaactcaatcccgccaacgccgcctatgtgctgcaacttttggacaccgcgctcgcaggcatttcagacggcattttcgacggcatcgttaccgcgccgctgcacaaaggcatcatcaacgacgcgcgcgcaagcacaggttttttcagcggacacaccgaatatctggcggaaaaaagcggcacggggcaggtcgtgatgatgcttgccggcaaaggcctgcgcgtcgccctcgtaacgacccacctgccgctgaaagacgttgccgccgccatcacgcaaccgctgattgaaagcgtcgcacgcattttgcatcacgacttaaaacacaaattcggcatcaaaaatcccaaaatccttgtcgcckgacttaatccccacgccggcgaaggcggacacctcggacacgaagaaaccgacaccattatccctgcattggaaaacctgcgccgcgaagggataaaccttgccggcccgtatccggcggacacattgttccagccgtttatgctcgaaggtgcggatgccgtattggcgatgtaccacgaccaagggctgcccgtgttgaaataccacagcttcggacagggcgtgaacatcacgctcggcctgccctttatccgcacctccgtcgatcacggcaccgcgcttgatttggcggcaaccggcagggcggattccggcagcctgataactgccgtggagaccgccgtcgagatggcgcgcggcagcctttaaagatgataaaagacccgtcatttccgcgcaggcgggaatccggtctgttcggtttcagttgtttttgggtttcgggtaatttccaaatcgtcattcccgcgcaggcgggaatccagaccattggacagcggcaatattcaaagattatccgaaagtttgaggttctagattcccgttttcacgggaatgacgaaaggtggcgggaatccggtctgttcggtttcggtttttttttttgaggtttcgggcaacttctaaaccgtcattcccgcgcaggcgggaatccagaccattggacagcggcaatattcaaagattatctgaaagtttgaggttctagattcccgttttcacgggaatgacggaatgttgcgggaatccggcttgttcggtttcggtttttttgaggtttcgggcaacttctaaaccgtcattcccgcgcaggcgggaatccagaccattggacagcggcaatattcaaagattatctgaaagtttagaggttctagattcccgttttcacgggaatgacggaatgttgcgggaatccggcttgttcggtttcggttttttttgaggtttcgggcaacttctaaaccgtcattcccgcgcaggcgggaatccaggcctttgggcgacggcaatattcaaagattatctgaaagtttagaggttctagattcccgttttcacggaaatgacgaaatgttgtgggaatccagaccttcgggcagcggcaatattcaaaggttatctgaaagtttgaggttctagattcccgttttcacgggaatgacgaaaggttgtgggaatccagaccttcgggcagcggcaatattcaaagattatccgaaagtttgaggttctagattcccgttttcacgggaatgacgaaaggtggcgggaatgacgaaaggttgcggtaatcatgggaatggcgaagtttcagacggcatcgtccaccctccgccgtcattcccgcgcaggcgggaatccaggcctttgggcgacggcaatattcaaagattatccgaaagtttgaggttctagattcccgttttcacgggaatgacggaatgttgcgggaatcatgggaatgacggaatgttgcgggaatcatgggaatgacggaatgttgcgggaatcatgggaatgacggaatgttgcgggaatcatgggaatggcggaatgtttcggtaatcacgggaatggcgaagtttcagacggcattgcaggtatccgaacccatgtaaaaaagaggttctgcggaacagaacctctttttgccgccgtcggttcagccttgccgggtttcgacttggatcatttcttcggcagggacggttgcgacttcagacggcttgggctgttcggaacggcgcaaaccgcgtccggcttggacttcgggttgtgccgcccatgccttcaatgcggcagggtcggtttcgatcaggacgagtccgccggtttgtgcggtttcccgtgcctgttccgccgcagccgtaaaggttgcggtttcagacggcatttcctgtgcttcggctttcggtgtcgcgccttcgggcaggatggcggcggtggcacggcggattttttccgccgcatcataaaccggtgcgtcgccgtttgaaacggcgggagatgctgtcggaagatccctttctgcaaccggatcggcaatgctgacagtaatcggcgcgtttgcgtcggtttcgccgaaaacgtgcgcggcggcggaacggactttgtcggcggtgtcgtgaatattcaggtactgctcgattttggcggcagacggaatattgcgttttttgccgttttgacggcggtcgcgctgattgttgcgctcgcggcgttctttggcatctcggctgtcgcgttcgcggcggttgcgttcggatttgggcttgctgcctttgtcttctgcggtatgcggttcggacggcgtgttttccgctgtctgaacggttgtttcggcaacggtggcggtttccggcgcggtttggccgcgttcgctgcggctgccgttgcggcggcgttttccggtttgcacttcggtttcggacggtgcggcatctgcaacggttgcggcaggctgtacgttgcggctttggatttccgcttcgttggcgcgttcggcggcacggtcgccgcgttcattgcggcggcggttgccgttgttgcgcgtttcggctttgtcggcacgcgcttcctgtccggcagttttgcctgccacttcgcggacttctactttgctgccttcgcgtttgctgcggcgcgggttttggcggcggttgttggcgcggctgccgctgcggtttgccgtgctgcgtttttcggaggtttcggcagcgggcgcggcttgggtttcgctgccgccgaaaatgcgtttgagccatgctttgaagctgtcccaccaagaggtttttttctcgggggcggcagtcggggcggggctggtgtggcgcacgcctttgacggcgggttcgggacgggcggctttggctttttcgccgccgaacggtttggcggattcgtcttcttccggctcggcgacgcgtttgtagctcggttcgccgtcttcttctacgtcgtcggtgcggatgcggttgatttcgtagtgcggattttcgaggtggatgttcggaatcaggacgacgttgacatccaaacgctcttccatcgcaaacagctcggcgcgtttttcgttcagcaggaaggtggcgacatcgacgggcacttgtgcgcgcacttctccggtgttgtccttcatcgcttcttcttgaatgatgcgtaaaacgtgcagggcggtggattcgatgccccgaatcacgccggtgccggcgcagcgcggacaggcgacgtggctgctttcgcccaaagccggtttcaaacgttggcggctcaattctaaaagtccgaaacgggagagtttgcccatctgcacgcgggcgcggtcttttttgagcgcgtcgcgcaggacgttttccacatcgcgctggtgtttggggttttccatgtcgatgaagtcgatgacgaccaagccgcccaagtcgcgcaggcgcatttgtcgggcgacttcttcggcggcttccatattggttttgaacgcggtgtcttcaatgtctgcgccgcgagtggcgcgtgcggagttcacgtcgatggagacgagggcttcggtatggtcgatgacgatcgcgccgccggagggcaggctgacgctgcgcgaaaacgcgctttcgatttggtgttcgatttggaagcgggaaaacagcggcgtgtggtcttcgtagagtttcagacggcctatattgcccggcatgacgtagctcatgaactcggcaacttggtcgtaaacttcttgattgtccaccaaaatctcgccgatgtcggggcggaaatagtcgcggatggctcggatcagcagcgagctttccataaagagcaggtaggggtcgtgatgcgcttttcctgcttcttcaatcgcctgccagagttgtttgaggtagttcaagtcccattccaactcttccgcgctgcggccgatgccggcggtacgggcgatgatgctcatgccgttcggaatgtcgagttccgccatggcggctttcaactcttgacgctcttcaccttcgatacggcgggatacgccgccgccgcgcgggttgttcggcatcaataccagatagcgtccggcgaggctgatgaaggtggtcagcgcggcgcctttgttgccgcgctcgtctttttcgacttggacgatgacttccatgccttctttgagcacgtcttggatgcgcgcgcgtccgccttcgtagtcttggaagtatgagcgggagacttctttaaacggcaagaagccgtggcggtcggttccgtaatccacgaaacacgcttccagcgacggctcgatgcgggtaatgatgcctttgtagatattgcctttgcgctgttctttgcccagcgtttcgatgtccaaatccagcaggttttgtccgtcgacgatggcaacgcgcagctcttcggcctgcgttgcgttaaataacattcttttcatgatcacctcgtgggcaggcggcgttcagacggcacatgcccggttcggcattccgtaaggctgggttttccgatgttttcggataaaaccggtaatcagtttttgagttgaaaatccgcagggatgcacgttccggagaaccgtgtgcggaagggtcggatacagaaggctataaagatcgatgcggcggtttgtctgccgcgttccgaacgctgcggtcggaaaaatgggggccggcttcttcttgttatcgtgatgcctgtgttttgggcggtttgcgtttgggacttgggcccggctgccgtcttacttccgcgccgaaacggcaaaatcaattcaaacttgattacgttctgcgcctgccggctgggaacaggcgcagggaaaatgctttgcggagtgcgtttttaatataaaattccgttttaaagtaaaccgtttcaggaggcgcggcgggcgcgctttttgctgaaacggatgttcggattatagatgaaaacgcacgaaataagcaaagattcggtcagcttgataggggttgccgaacatgaggcgggtcaacgccttgataactatctgataaaaatcctcaagggtgttcccaagagccatatccaccgcattatccgcgccggcgaggtgcggttgaacaagaaacgctgcaaacccgacagccgtattgcggagggggatacggtgcggattccgcctgtgcgcgtggcggagaaggaaatgccgtctgaaaggcgtgccgccgtaccggcgcgtgcgtttgacgttgtttacgaagacgatgcgcttttggtcatcgacaaaccgtccggcgttgccgtccacggcggcagcggcgtgagtttcggcgttatcgaacagttgcgccgcgcccgtccggaggcgaagtatttggagttggttcatcgtttggacaaggatacgagcggcttgttgatggtggcgaagaaacgcagcgcgctcgtcaaacttcacgaagccatccgtaacgaccaccccaaaaaaatctaccttgcgctgggggtgggcaaactgccggacgacaatttccatgtcaaactgcccctgttcaaatataccggcgcacaaggcgaaaagatggtgcgcgtcagtgcggacgggcagtcggcgcatacggtgttccgtgtgttaagccgtttttcagacggcattttgcacggtgtcgggctgtcgcacctgactttggtgcgggcgacgttgaaaacggggcgcacgcaccaaatccgcgtccacctgcaatctcaaggctgtccgattgcgggcgacgaacgctacggcgattatcaggcgaaccgtcgtttgcagaagttgggtttgaagcggatgtttttgcacgcgtccgagctgcacttgaaccatccgctcacgggcgagccgctggtgttgaaggcggagctgccgccggacttggcgcagtttgcggtgatgttggaaaacgggacgaaaatgtgaaccccgatgccgtctgaagccttcagacggcatcgggacgtgaaagtatgtggggacagacgaatatggctgataaaaaaagccctttgattgccgtcagtgtcggcgaagcgtcgggcgacctattgggggcgcacctgatacgcgccatccgcaagcgttgtccgcaggcgcggtttaccggtatcggcggcgaactgatgaaggcggaaggtttcgagagcctttatgatcaggagcggctggcggtgcgcggctttgtcgaagtggtcaggcggctgccggaaattttacggatacgcagggggctggtacgggatttgctgtcgttgaaacctgatgtctttgtcggtatcgatgcgcccgattttaatttgggtgtggcggaaaagctgaaacggtcggggattccgaccgtgcattatgtcagcccgtcggtgtgggcgtggcggcgggaacgtgtgggcaaaatcgtgcatcaggtcaaccgcgtgttgtgcctgttcccgatggagccgcagctttatctcgatgcgggcggacgtgcggagtttgtcggtcatccgatggcgcagcttatgcccttggaagacgaccgtgaaacggcgcggcaaactttgggcgtggatgccggcatccccgtattcgccctgctgcccggcagccgcgtcagcgaaatcgactatatggcgccggtgttttttcagacggcattattgttgttggaacgctatcccgccgcacgcttcctgctgcctgccgcaacggaggcgacgaagcggcgtttggcggaagttttgcagcggccggagtttgccggattgccgctgacggtaatcgacagacagtctgaaacagtgtgcagggcggcggatgcggtgctggtaacgagcggtacggcaactttggaggtggcgttgtgtaagcgtccgatggtcatcagctacaagatttcgccgctgacctatgcttatgtgaaacgcaaaatcaaagtgccgcatgtcggcctgccgaatatcctgttgggtaaggaggctgtgccggaattattgcaatctgaagcaaaaccggaaaaactggcggcggcgttggcggactggtacgaacaccccgataaggttgccgcgctgcaacaggatttcagggcgttgcacctgctgttgaaaaaagatacggcggatttggccgcgcgcgcggttttggaagaggcgggatgttgagcggttaatggattattttcccgaagcagcacgtattacaaaaaaagggggagaaattgtgattaatggcacatcaaacaataagtatttaagaggaattccaaatgaaacagaactggcccgaatgggattaaggttaaaatataatggtcagttaactgattaattttgttatatatgatttatgattatagcttatactaatacgcttacttaccttgtttcatttgttcttcgtaaatttctattttaggcaattgtgtcagttcaatagggcaagttgctccccaccaaaaatgttctacataaaaccaaggattatctggaaaatatagcaacatctcttccatatccggccaaattcttcttaattcatctacctgtgtttttggcgaaccagttaatatttttggaggattttcacgataatcgcataattcaataacaccatctgataaaagttcttccaaaaaatcaaaaaatctaatttttaaatttggatctttgatatccatatttaaataatttttataaacaccaaaaataccacctaaatattcacaatattctaaaagattatattttatcttcacattcataacgtaacctttatctaaattttaattctaatctttgcccatgtactgaatcaggttgattcctaaactcaatcgtccattttgctccagtttgttctcggctagttgaaaaattccttaaaataaaggaagagtttaaacaactgaaatttcataagagtagtagaaccaacttggactcaaaaaatcttaaactcattgtttttgaaaaggtaaaataatatgacaacttataccattccaaaaaaagattatcaatttctgtatatatatgagggcactctattaaactatactttgaaaaacgatgaattccatatcatcgtccagaatgtggattatccggactttcctcaagagattcctacaccaaattatacagactgggtaaaaattaaattcaagcagttcagctatctgaaatttatctatggatacgccacgaagaaccaagataaaaatatcaaaaatgtattggaacttggagaattaaagcaggatgatgaaatcttggattatggaggtgcgctggaagtgataggcagtaggtatgatcttccgaccggttttagtatagatatagtttgccgggaaatagagttagaatttttagatcaggagagtttcaattaaacgagccgtagcttgttatgctgagcaggcaactttatcgtatttccttttcggttgaaaccccgccactcggacatctgtccttcggggcggtagaatcagattttatttgggaggggcgtaaccccttccgaatcagggcaacacatagggcgacgctttatgtgtcgtcctgtgtgttgaaacattgatatgccgatacggagcctgtcggcaaaatgccgtctgaacaatatcttttcagacggcattttgtatgggggttaacggttgttcagcccgagtacgtcctgcatatcgtacaaacccgttttgccgttgacccaaactgcggcgcggacggcaccggcggcaaaggtcatgcggctgctggccttgtgggtgatttccacgcgctcgccgtcggtggcgaagagggcggtgtggtcgccgacgatgtcgcctgcgcggacggtggcaaagccgatggtcgacggatcgcgcggaccggtgtggccttcgcggccgtaaacggcgcattgtttgaggtctctgccgagcgcgccggcgatgacttcgcccatgcgtaacgcggtgccgctgggggcatcgactttgtggcggtggtggccttcaatgatttcgatgtcgtagccttcgtttaatacgcgtgcgacggtgtcgaggatgtggaaggtgaggttgacgccgacgctgaagttggcggcgaaaacgatgcctgttttttcggcggcagtgtggatagcggctttgcccgtatcgtcgaagcctgttgtgccgatgatgatgttgacttgtttttcaacgcatttttgcaggtgtttgagggtgggctcggggcgggtgaagtcgatgagtacgtcgctttgtgcgagaacggcgtcaacgtcgtctgaaatggcgatgccggttttgagtccgacggcgtagcctgcgtccagcccgagggcttctgagcctgagtgttcaagcgcaccggaaaggacggtgtcgggatggttgttgacggcttcaaccaatacgcgtcccatacggccgtttgcgccggcgatggcgattttgagcggtgtcatgtgtgttccttatggtttgtctgtgttttggcggtctttgagggcttcggcagcgttttgcaggacgtcgccttcggtgcggacgagtacgccgttttcaaaatagacggtcagattgctgcgttctttgatgatgccgttgcgggaggtgttgaaggtatagtcccagcggtcggtatggaatgcgtcgcgcagtatggggctgccgagcaggagcaggacttggtctttggtcatgccggggcggagggcggcaacggcgcgcggttcgagttcgttgccctgtatgattttgagtttgtacgaggggaacagtgaaacgcgttcggcactgcacgcggcaaggccgaggagggcggaaagggcgaggatgagggttttgttcacggaaatgcctttctgtgcaaatcgggatgggtagtgtaacactgcttgaatattttataaaagcgaacgataatcatacgattaagcggtatccgccctgtccgcgcatcggccgccggtgcggttttactattgcaaactgctatggtgcgatagtgggcaaacaggccgaaattgcgtattataacgtctattgttttacaggggtattgaatattatggaaaaattcaacaatattgcacaactgaaagacagcggtctgaaggttaccggcccgcgtttgaagattttggatttgttcgagacgcatgcggaagagcatttgagtgcggaagatgtgtaccgcattttgttggaagagggtgtggaaatcggtgtggcgacgatttaccgtgtgctgacccagtttgagcaggcgggcattttgcaacgccatcattttgaaacgggcaaggcggtttatgagttggacaaaggcgaccaccatgaccacatcgtctgcgtgaagtgcggcgaggtaacggaattccacaatcccgaaatcgaagccctgcaagacaaaatcgcggaagaaaacggctaccgcatcgtcgatcacgcgctttatatgtacggcgtgtgcagcgactgtcaggccaagggcaaacgttaaatccggacggtttgttgttcagacggcattcatgattttggatgccgcctgtgtttttggagaactgtcatgcgtattccgctgcttgcccctgacaattatgcctttcccgatcctgcctatgctttggcccggtgcgacgggctggtcggcgtgagcggcgatttggatgcggggcggctgcttgaggcgtatcggaacggcgtgtttccgtggttttcccgggacgggtggtttttttggtatgcggtcgggccccgtgcggtggtgtttcccgacaggctgcatattccgcgctcgctggcgaaaacgctgcgcaacggcagctatcgggttgcggtcaacggctgttttgcggaagtggtcgcgcattgtgcggcagcggcgcgcccgaatcaggacggaacttggattgcgcccgagtttcagacggcatatttgaagctgcacgaaatggggtacgcgcattctttcgagtgccattatcccgatgaaagcggtgaaacgaggttggcgggcggcttttacggcgttcagatcggcagggtgttttatggcgaatcgatgttcgcattacaaccggatgcgtcgaaaatcgcgtttgcctgcgccgtgccgtttttggcggatttgggcgtggaactgatagactgccagcaggatacggaacatatgcgccgtttcggttcggagctgctgccgtttgcggattttgccgaacgtctgcggatgttgaacgccgtgccgttgaaagaggaaatcgggcggcgcgaagtggcgtgcaaggggctttgatggcggcttatgctccggtcaggttcaaatatggtggattatagtggattaacaaaaatcaggacaaggcgacgaagccgcagacagtacaaatagtacggcaaggcgaggcaacgccgtactggtttttgttaatccactataaaattagaaatgacgacagccggataaaatcacggtgaaaatgaaaaatgccgtctgaaacttgaaaacatcgggtttcagatggcattttgtttgacggtttgttgcttatttgagcgggcgcacttcaagtccgaacatacggcgtgcggtgttcagcatttggcagctgaagccccattcgttgtcataccaagcgaacactttgaccatgttgccgtcaacgactttggtcagtgttgcgtcgaagtggctggcttcggtagtgtggttgaagtccatggaaaccaagggcagggtgttgtagcccaaaacgcctttgagcgggcctgcttccgaggcggctttcatcagtgcgttgatttcttcgactgtggtgtcgcgcgcggcttggaagctcaaatctaccaatgatacgttgacggtcggcacgcggatggcaagcccgtcgagcctgcctttcaattcgggcagtaccaaaccgacggcttttgccgcgccggttttggtcggaatcatgttttccacgccgctgcgggcgcggcgcaggtctttgtggcgcacgtcggtaacggtttggtcgttggtcagcgcgtggatggtggtcatcgcgcctttgacgatgccgacgctttcgctcaacactttggcaaccggcgagaggcagttggtggtgcaggaagcgttggaaacgacggtcatgtcggcggtcaggacgctgtcgttcacgccgtacacgacggttgcatcgacatcgtcgccgcccggtgcggaaatgaggacttttttcgcgccgctttcgaggtggattttggctttttctttgctggtgaacgcgccggtgcattccatgaccaaatcgacaccgagttctttccacggcagttcggcagggttgcgggtcgagaagaaggggattttgtcgccgttgacgatgaggttgccgccgtcgtgggatacgtcggcttcaaagcgtccgtgcacggtgtcgaatttggtcagatgggcgttggtttcaaggctgccgctggcgttgacggcgacgatttggagttggtcttgaatctgataatcgtagatggcgcgcaaaacctggcggccgatgcgtccgtagccgttgatggcgactttgatgcccatggtttgttcctttgttgagggttgggtagattttcggggcggattatagcaaatttgtagtggcgtgtaattaatattttattgaaaacggcgcggccggaagggtgggcggtaagatgcggacggcacgggtgcggcggacggagagcttgataaaatgccgtctgaagcggcttcagacggcatatcagggaagggtcaggaggcggtattctgtgcggcttcctgtttggctttgtattgtttgagatattcgagggcggcggctttttcgctgtcgctgccgtatttcatatcgcgttgggcgcggcgcaactcggcgcgttcgcgggcttcggctatctgtttcgcctgatagtctttgcggttgtcggcggcggcgaggcggtcttgttgggtttgcgcttttgccatggctttggcgatgaggtcggcagggttaaacgtcggttttttcggtgtgtcgggcgtttgcggacgcgcgttgcggacggcggcttcgcgttcggcaagcatggccttgcgttcgtcggcttcgcgctgtttgcgttcgttgcgtttgaggtagcgcgtgcgcgcgtgttcggcggcggcaaaacggctgtcggcggacaggctgaagcggcgcgcgcggggcaggacggtgtcggcaacgggctgcatatggatgcagtcgacggggcagggggcgacgcagagtccgcagccggtgcattcgtcggcgatgacggtgtgcataagtttgcccgcgcccataatggcatcggcagggcaggcgcggatgcaggcggtgcagccgatacaggcggtttcgtctatccgggcgagtgctttggcttgggttttggcaggtgcgacaaagggtttgccgagcagggcggaaatgtcccgaatgacggtttctccgcccggggcgcagaggttgtacgcttcgcctgttgcgactgcctgtgcgtagggcaggcagccgtcgtagccgcattcgcggcattgggtttggggaagcaggcggtctatggcggcggctgtggcggtcatgtcggtgtgcggctcaaaatcgaaagggcgtattttagcagaattgtatgccgcgcccgtttcggatggtgcgcggtgttttgttataatgcggcggcgtatgccgtttcagacggcatttttctgtattttcctgttcggacggtctatgaacgaattttcgcttgcccctattgtgattgttttgctggtgtcggtcattacggtgatcctgtgccgcaagttcaacattccctccatgctgggctacctgctggtgggctttttggcggggcccggtatgctcagcctgattccgaaaagccatgcgacggattatttgggcgaaatcgggattgtgttcctgatgttcagcatcggtttggagttctcgctgcccaagttgagggcgatgaggcggctggtgttcggtctgggcggtttgcaggtcggcattacgatgctgtcggtaatgggcatactgatgctgacgggcgtgccgttcaattgggcgtttgccgtgtcgggcgcgttggcgatgtcgtccacggcgattgtgagccggattttgtcggaaaagacggaattggggcagccgcacggtcagatggcgatgggcgtgctgctgatgcaggacatcgccgtcgtgccgctgatgattctgattcccgcgctggcgggcggaggggacggaaatatttgggcggccttgggtttggcgtttgcaaaaatgctgctgacgctggggctgctgtttttcgtcggcagcaaaattatgtcgcgatggttcaggatggtggcaaaacgcaaatcgtccgaactctttatgatcaatgtgctgctggtaaccttgggtgtggcttatctgactgagctggaaggtttgtctatggcgttgggcgcattcgttgccggcatgctgctttcggaaacggaataccgtttccaagtcgaagacgacatccgcccgttccgcgatattttgctcggctttttctttatcacggtcggcatgaagctggacattcaggcattgatcggcggctggcggcaggtattgatgctgttggcaatgctgctggtgttgaaggcactggttgtgtttgccattgccttcaaaatgaaacattcggtcggcgacagcctcaaaacggctttgtatctcgcgcagggcggcgagttcggcttcgtgatgctggccattgccgggcagcttgatatggtttcgccagaatgggaacaggcggcgacggcggcggttctgctgtcgatgattatcgcgcccttcctcttgggcggcagcgatgcgctggtcgggcgtttggtcaagtcaagctgggacatgaagtcgctcgatctgcacagtatgctggtagaaaccatgagcaagtccgaccatgtgctgattgtcggcttcggcaggggcgggcagacggtcggacgcgtccttgcccaagaggatattccgtatttcgcgctcgacttggacattgcgcgggtgcaggttgccagaagtgcgggcgaaccggtgtcgttcggcgatgcgaaacgcagggaagtattggaagccgccggtctgggacgggcgaaaatggtggtggttacgctcaacaatatgcacgaaacgcaacacgttttagacaatgtgctgtccatgtatcccaatatgcccgtatatgtgcgcgccaccaacgacgattatgtgaaaacgtttaccgatataggtgcggaagaagccgtgtcggacaccaaagaaaccggactcgtgctggcaggctatgcaatgttaggcaacggcgcgtcgtatcggcacgtctatcagacgatggcaaatatccgccacagccgttatgccgcgttggagggactgtttgtcggtagtgatgatgaggcaggattcggcgaaaacggcgaaaccgtccgtcacgcctttcctttggctgcagaagcatacgccgtcggcaaaacagtcggcacgcttccgatggcggcttacggcatcaaactcttgttcgtccgccgccgcaccggccggattgaaaacccggatgcctcgtttacattggaaggcggtgacgtgttggtggtcgcaggcaaaaaagaagaaattatctcttttgaaaactggagtttgcagggaatataaatgaaatgccgaaataaggcttgcgccatttccggttatttggtttaataacgctttcgcaaatcgcaagggtgattagctcagttggtagagtgtctgccttacaagcagaatgtcggcggttcgactccgtcatcacccaccaagttttctttcattgttgcaaacaatggatgcgcggtggtagctcagttggttagagtaccggcctgtcacgccgggggtcgcgggttcgagccccgtccgccgcgccaagtttcaaaatactgactctgtcggtattttttatacacgggtgattagctcagttggtagagcgtctgccttacaagcagaatgtcggcggttcgactccgtcatcacccaccaagttttctttcattgttgcaaacaatggatgcgcggtggtagctcagttggttagagtaccggcctgtcacgccgggggtcgcgggttcgagccccgtccgccgcgccaaaagttaaggaataccaacctccggttggtatttttttgtttgtatgctttgaaaaatgtttgtttccggattttgccattcccatccggttttgcgctgtacgatgtgttttagcgcggacttgctcaaaatcgcatgtgattccggtatttgaggctttgattagggatgcggactttcaatatattttctcagctacaacaacgaaggcttgatgtctgtcgggcaggtaagggagatttttgagcgtttcggcaaatataatttggttcaaacggaataccggcgttttaaggcagataagacagaaaaccgtaatcataaggcaaattcgatattcgaatttctgcatattttagaaaagaccttttatagtggattaacaaaaaccagtacagcgttgcctcgccttagctcaaagagaacgattctctaaggtgctgaagcaccaagtgaatcggttccgtactatttgtactgtctgcggcttcgtcgccttgtcctgatttttgttaatccactataaaaattcttgccggatgctgcaaacaacgccggtttgcattcctgatggcggtggttttcttagacgaacgcccgaacacgcaggaatggataggcttggggctggttacggcgggcgtgttgacgctggcactgaaacggtaaagccgcaagaaataaatgaaatgccgtctaaaaaactgttttcagacggcattttcgtttctgtccatcctcagcactcgaccacgcgcacggatacggggacggcttttttccggagcgtggcggcgagtccggcaagcgaggtttctttgtaggtcgccttcatatcccggccggtttgcagcatggttcggatgacttcgtcgagcgagacttttttgtccgtgccgtcttccaaaagcgcgagcgtgccgagtttgagggctttttcggcggcgatgccgttgcgctcgatgcaggggatttgcaccagtccgccgacggggtcgcaagtcagccccaaatggtgttccatcgccatttcggcggcgttttccacttgtttgggcgtgccgccgatgacttcggcgtatgcgcccgccgccatcgaacacgctacgccgacttcgccctgacagccgacatccgcaccggaaatggaggcgttggtcttgtagaggatgccgattgcgcctgcggtgagcaggaagttttcgacgcgttcctgtgtggcgtgcggattgaacttgcggaaatagtgcaatacggcgggaatgatgcctgccgcgccgttggtcggtgcggtaacgacgcgtccgccggcggcgttttcttcgttgaccgccatggcgtacaccatcggccagagctgggtgttgacgatttcggtttcgcgcaggactttgagcttggcggcaagctgcggggcgcggcggcggacgttcaatccgctgggcagttcgccgtccgcacccaagccgcgtttgatgcagccttccataacctcggcaacggcagcggcgcggcggcggatttcggcttcgccgcatccggcaagcgcggcttcgtttgccaacacgacttcggagatgtcgagccggttcagacggcatcgggcaagcagttcggcgcaactggtatagggatagggaacggctttttccgtttccgcctgccggtcaaaatcttcttcggtaacgacaaagccgccgccgaccgaataataaacctgttcattcaataccgtgccgtctgaagcataggcggtaaaacgcaggctgttggggtgtttgggcagcacttgattgccgagtatgttcaggtcgcggtcggggatgaagcggatttcttgcccgttgagccggaggatgtgctgcgtgcggatgcgttcgaggcgttcgggaatgccggcaagcgggatgtcgtgcggcaggctgccttccaaaccgagcatcagcgcgtcaaatgtaccgtgtccgtatccggtcagtgcgagcgagccgtaaatgtcgatgacgatgcgaacagcctgtgcatccaaacctgccgcaaaggcggcggctgccttcatcgggccgaccgtatgcgaactggaaggcccgataccgattttgaaaatatcgaaaatgctgatcatattttgctccgacggtttttcagacggcacaggttccgtttgaccaaccaaaaaggagacgcggcacgatgcccgtctccttttttaaaacggcacttatgcgtcgatattttgggcaatcagcgcgttgttttcgataaaggcacggcgcggctcgacctcgtcgcccatcagcgtaacgaacacttcgtcggcggcaatggcatcttcgatgcgcactttcaacaggcggcgcacggcgggatccatcgtggtttcccacagctgctcggggttcatctcgcccaagcctttgtatcgttggatggacatacctttttgggcaacgctcatcaagatgtccaaagcggtttcaaagctgtccgcgtcgtacccgttttcgcctttgtaaagcttggcaccctcgccgaccatgcctttgagcgcggcggcggtttgggtgagggtttggtaggctttgctgttgaggaacttgggttcgatgtagctgaccatgacgttgccgtgcagcttgcgcgtgattttgatgaaccggtgtccttcatgaccttcgatgcgttcgagggcgacttctttttcgtcaagcagaccggaaagttcggcaacggctttatcggcgttttcagacgacgtcaaatcaatgggcgacgcgtgtagcatggcgcgcaggacgagttcgtctacgaagcggctttcctgttcgatgacggtttttgccaacaggaattgtttggcggtgtcggcaagttctgcgccttcgatggtgcggccgtctgaaatgattttggctttttccaaggcaagaccgagcagccattggtctttttccaactcgtccttgaggtaacgttcctgtttgccgtatttcgctttatacaaaggcggctgggcgatatagatgtagccgcgctcgaccagctcgggcatttggcggtagaagaaggtcaggagcagggtgcggatgtgcgcgccgtccacgtcggcatcggtcatgatgatgatgcggtggtaacgcagtttttcggcattgaattcttctttgccgatgcccgcgcccaaagcggtaatcagcgtggcgacttcttggctggccagcattttttcaaaacgtgctttttcgacgttcaaaattttacctttgagcggcaaaatcgcttggaatttgcggtcgcggccttgcatggcggaaccgcctgcggagtcgccctcgacgaggtagagttcggacagggcagggtctttttcttggcagtcggcgagtttgccgggcagtcccaagccgtccatcacgcctttgcggcgggtgatttcgcgtgctttgcgggcggcttcgcgcgcgcgggcggcatcgacgattttgccggtgatgattttggcttcgttcggattttcttcgaggaagtcggtcagggcttggctgatgacttcgttgacaacggggccgatttcgccggaaaccagtttgtctttggtttgggacgagaatttggggtcgggcagtttgacggacaacacgcaggtcaaaccctcgcgcatatcgtcgcctgcggtttccactttggcttttttggcgacttcgttggcttcgatatagttgttgatggtgcgggtcatcacttggcgcagtgcggtcaggtgagtaccgccatcacgttgcgggatgttgttggtgaaacactgcacgctttcttgatagctgtcattccattgcatcgcgcattcgacgctcatgccgtctttttcgccgaacgcgtagaagattttttcgtgcaacggcgtttttttgcggttcatgtattgcacgaaacccgccacgccgccggaaagggcgaagctttcgtgtttgccgtcgcgctcgtcggtcaattcgatgtccacgccgttgttcaggaaggaaagttcgcggatgcgtttggcaaggatgtcgaagctgtattcgacgttgccgaaggtttccgtactggcgaggaagcgcacggtcgtgccttttttatcggaatcgccgacaattttcagcggctcttcggtttcgccgcgcacgaagcggacgaagtgttctttgccgtcgcggtagatggtcagcgttacccagtcggacagcgcgttgacgacggacacgcccacgccgtgcaggccgccggagattttgtagctgttgttgtcgaatttaccgcccgcgtgcaatacggtcatgatgacttcggcggcggagcgtccttctttcgggtggatgccggtgggcataccgcgcccgttgtcggcgacgctgacggaatggtcggcgtgtatcgttaccgtgattttgtcgcaatgtccggcgagtgcttcgtcaatggcgttgtccaatacttcgaacaccatgtggtgcagaccgctgccgtcctgcgtgtcgccgatgtacatgccggggcgtttgcgtaccgcttccaagccttcgagcacctgaatgctgtcggcgccgtattcttcgtgtttttgttcagtcatattttttgccggattttgaaaagattttgcgatgccgccaaaacaagtccgcaccttgtagaaaaagcgggcgggacgacatatataattgtgtattatagccgattttgccgcctaattcagcgttatccgcatcagtgtgccgccgggaaaagatgaaacggtacgtttgcctccggcatcaggtcggggattgtcccgtaaagtggcaaaagcgtttttttgccactaaaatctacaccctatacttttcggacaggggcgcggaaatggaaatatggaatatgttggacacttggctcggtgccgtcccgatacgtgcggaggcggtcgaatccgtggcggcggttgcggctttgctgctggcgcgcgcccttctgttgaatatccacttcaaacggcatccggatttcggcatcgaaagcaagcggcggtttttggttgccagccgcaatataacgctgcttttggtgctgttttcgctggcatttatctggtcggcgcaaatccaaacgctggctttgtcgatgtttgcggtggcggcggcggtcgtcgtggcgacgaaggaactgattatgtgtctgtcgggcagtattttaaggtctgccacccagcaatactcggtcggcgactatatcgaaatcaacggcctgcgcgggcgcgtggtcgacatcaacctgttgaacacgctgatgatgcaggtcggtccgaaccccttggtcggacagcttgcgggaaccaccgtttctttccccaacagcctgttgttgagccaccccgtgcgccgcgacaatattttgggcgactatgtcatccatacggtcgaaatccccgttcccatccatttggattcggatgaagccgtatgccgtctgaaagccgtactcgagcccttgtgcgcgccctacatccccgccatccaacggcatttggaaaacgtgcaggcggaaaaactgtttatcacgcccgccgccagaccgcgcgttacccgcgtgccgtacgatgacaaggcataccgcatcatcgtccgcttcgcttcccccgtttcaaagcggctggaaatccaacaggcggttatggacgaatttttgcgcgtacaataccgcctgttaaatcaccccgccggctccgaaacactttaactttccccgaccgaccccatttccggcttcagacggcatattgccgatatgctgtctgaaacacaacacgcaaaggaaacccatcttatgactgacaacgcactgctccatttgggcgaagaaccccgttttgatcaaatcaaaaccgaagacatcaaacccgccctgcaaaccgccatcgccgaagcgcgcgaacaaatcgccgccatcaaagcccaaacgcacaccggctgggcaaacactgtcgaacccctgaccggcatcaccgaacgcgtcggcaggatttggggcgtggtgtcgcacctcaactccgtcgccgacacgcccgaactgcgcgccgtctataacgaactgatgcccgaaatcaccgtcttcttcaccgaaatcggacaagacatcgagctgtacaaccgcttcaaaaccatcaaaaattcccccgaattcgacaccctctcccccgcacaaaaaaccaaactcaaccacgatctgcgcgatttcgtcctcagcggcgcggaactgccgcccgaacagcaggcagaactggcaaaactgcaaaccgaaggcgcgcaactttccgccaaattctcccaaaacgtcctagacgcgaccgacgcgttcggcatttactttgacgatgccgcaccgcttgccggcattcccgaagacgcgctcgccatgtttgccgccgccgcgcaaagcgaaagcaaaacaggctacaaaatcggcttgcagattccacactacctcgccgtcatccaatacgccgacaaccgcgaactgcgcgaacaaatctaccgcgcctacgttacccgcgccagcgaactttcagacgacggcaaattcgacaacaccgccaacatcgaccgcacgctcgcaaacgccctgcaaaccgccaaactgctcggcttcaaaaactacgccgaattgtcgctggcaaccaaaatggcggacacgcccgaacaagttttaaacttcctgcacgacctcgcccgccgcgccaaaccctacgccgaaaaagacctcgccgaagtcaaagccttcgcccgcgaaagcctgaacctcgccgatttgcaaccgtgggacttgggctacgccagcgaaaaactgcgcgaagccaaatacgcgttcagcgaaaccgaagtcaaaaaatacttccccgtcggcaaagtattaaacggactgttcgcccaaatcaaaaaactctacggcatcggatttaccgaaaaaaccgtccccgtctggcacaaagacgtgcgctattttgaattgcaacaaaacggcgaaaccataggcggcgtttatatggatttgtacgcacgcgaaggcaaacgcggcggcgcgtggatgaacgactacaaaggccgccgccgtttttcagacggcacgctgcaactgcccaccgcctacctcgtctgcaacttcgccccacccgtcggcggcagggaagcccgcctgagccacgacgaaatcctcatcctcttccacgaaaccggacacgggctgcaccacctgcttacccaagtggacgaactgggcgtatccggcatcaacggcgtagaatgggacgcggtcgaactgcccagccagtttatggaaaatttcgtttgggaatacaatgtcttggcacaaatgtcagcccacgaagaaaccggcgttcccctgccgaaagaactcttcgacaaaatgctcgccgccaaaaacttccaacgcggcatgttcctcgtccggcaaatggagttcgccctctttgatatgatgatttacagcgaagacgacgaaggccgtctgaaaaactggcaacaggttttagacagcgtgcgcaaaaaagtcgccgtcatccagccgcccgaatacaaccgcttcgccttgagcttcggccacatcttcgcaggcggctattccgcaggctattacagctacgcgtgggcggaagtattgagcgcggacgcatacgccgcctttgaagaaagcgacgatgtcgccgccacaggcaaacgcttttggcaggaaatcctcgccgtcggcggatcgcgcagcgcggcagaatccttcaaagccttccgcggccgcgaaccgagcatagacgcactcttgcgccacagcggtttcgacaacgcggtctgacggcagggttgaagtaaaaaatatggcggattcgatagaaaaacatccgcaccgtcattcccgcgcaggcgggaatccagaccggtcggtgcagaaacttatcgggaaaaacggtttctttagattttacgttctagattcccactttcgtgggaatgacgcggaaaagttgctgtgattccggataaattttcgcaacgtttaatttccgttttacccgataaatgcccgcaatctcaaatcccgtcattccccaaaaacaaaaaaatcaaaaacagaaatcccatcattcccgcgcaggcgggaatccaggtctgtcggtgcggaaacttatcggataaaacggtttctttagattttacgttctagattcccgctttcgcgggaatgacggaatatttttgaatttgataaaaatgccgtctgaaacggtcaaacaacgcttcagacggcattttatagtggattaacaaaaatcaggacaaggcgacgaagccgcagacagtacaaatagtacggaaccgattcacttggtgcttcagcaccttagagaatcgttctctttgagccaaggcgaggcaacgacgtactggtttttgttaatccactatattttccgacatcattgaatcaaacccaaatgcgacaagagcgtccatgtgccgatggcaatcaacaccaaacctccggcaaattccgcacacctgccgaacaatacgcccaaagcccttcccgccgtcagcccgaccgccaccatcaccgtcgtcgccataccgatgattgcggcggcaaaggcgatgtttacctccataaacgccaagcccaccccgactatcatggaatcaatactggttccaaaagcagtcaaaaccgtcatccataggctttcccgtttgctttcgcgcacatcttccgcctcgccggacagcccttcgcgcatcattttcagacccagcccgcccagcaggacgaaagccacccaatggtcccattcgctgataaacggcttggcataaaaaccgcctacccagcctgccagcggcgtgagcgcttcaaccgtgccgaacaccaaagccgttgccgcaattttgcgcggaggcattctgaccgccgcaccctttgccaatgcgacggcaaacgcatccatcgacatccccagagcaatcaagagcaaagcataaaaacccataccgcacccgtcctcaaaaagggcggattatagcaaaagcaaaaaaatgcaaaaatgccgcacgaaaacccgcatcccgtcattcccgcaaaaacaaaaaatcaaaaacagaaatcccgtcattcccgcgcaggcgggaatccagagttgtcggtgcggaaacttatcggataaaacggtttctccaaccccgagtccttgattcccactttcgtgggaatgacgggatattttgcgtttaataaaaaacgcccgctgaaacggcggggcgggatgggggaatgccgtctgaaacggtcggacaatgtttcagacggcatttttatgcccggttatttccgatagcggacggcgcgggacaggatttcttcaatttccatccacataatgcccccttacagcaaaccagcctgacccagtgcgggatcggtcgcgcgggcggcttgggcatcttcgacagtcagtccaagggctttggccacgccttcgccgtatgccgggtcgcaacggtagcagttgcggatatggcggtatttgatgaagtcgggcgcgtcgcccattgcggcggcggtgttgccgaacaatgcctgtttctgcgcgtcgttcatcaggttgaacagggcgcgcggttggctgaaatagtcgtcatcgtcttggcggtagtcccagtgtgccgcgtcgccgttgattttcaaaggcggttcggcgaagtcgggttgttgctgccattggccgaagctgttgggttcgtagtgcggcaggctgccgtagttgccgtcggcgcggccttgcccgtcgcgctggttgctgtgaacagggcaacgcggacgattgacgggaatttggcggaagtttacgcccaaacggtagcgttgtgcgtcggcgtaattgaacaaacgcgcttgcagcattttatctgggctggcgccgacaccgggaacgaggttgctcggtgcgaaggcggattgttccacatcggcgaagaagttttcgggattgcggttcaactcgaattcgcccacttcaatcagcggatagtcttttttcggccaaactttggtcaagtcaaacggatgataaggtactttttccgcgtctgcttcaggcatgacttggatgtacatcgtccatttcggaaactcgccgcgttcgatggcttcgtataagtcgcgctgatggctttcgcggtcgtcggcgatgattttggcggcttcttcgttggtcaggtttttaatgccttgttgggtgcggaaatggaatttcacccaaaaacgctcgcctgcttcgttccagaagctgtaggtatgcgaaccgaagccgtgcatatggcggtagccggcggggatgccgcggtcgctcatcacgatggtaacttggtgcagtgcttcgggcagcagcgtccagaagtcccagttgtttgtggcagagcgcatattggtgcgcgggtcgcgtttgacggctttgttcaggtcggggaacttacgcgggtcgcgcaggaagaacacgggcgtgttgttgccgaccacatcccagttgccttcttcggtataaaatttcaaggcaaaaccgcggatgtcgcgttctgcatcggctgcgccgcgttcgcctgccacggtggtgaaacgggcgaacatctcggtttttttgccgacttcgctgaagattttggcgcgggtgtatttggtgatgtcgtgcgttacggtaaacgtaccgaacgcgcccgaacctttggcgtgcatacggcgttcggggatgacttcgcgcacgaagtcggcgagtttttcattcagccacaaatcctgcgccagcagagggccgcgaggaccggcggtcaggctgttttgattgtcggcaacaggcgcgccgttgttcatggtcagatgggttacagggcatttggaggtagtcatcgctcttgttccttttctcaggttggtcaaatgggggtaaacggcttacagtacgatttggcggaaagcgtattcgtaaccggtttcttgattgcaataaatttcttgaatcgacattttatttcccttttgtaaaaactatggatgcgactatacgccaagattttcgctattaaaactatgaaatcgatttaatattattataagcaatcggttcttgattttcgtttgttttttgttatcgaacggaatccgaacccgctcattaaaaccatttataatgcaatgacgctttgcggcattttttgcgccgacaggctgaaaataacaattttccccacattatcatgaccttactcggaataaagctcaaacagacccagcagctcaaccagcggctgcaacaatctttgcgcgtattgcagatgtcgggtatcgaacttgaacgcgaggtcgaaaactggctgtcggacaaccccctgctcgaacgcaaagacacggatgaattttccgatgccgagttcagccattacactgcgcctgcccgtcaaatcggcggagacgaaggcgaagatatgctgtccaacatcgccggcgagcaggatttcaagcaatacctgcacgcgcaagtatgcgaacacccgctttccgaccaagaagccgcctgtgtccacatccttatcgatttccttgacgagcagggttatctgaccgacagcatcgaagacatcctcgaccatacgcccttagagtggatgttggatgaagcaatgctgcaacacgcgctgaccgcattgaaaaaattcgacccggcaggcgtggccgccgccgatttgaacgaatcgctgatactgcagatagaaagattgggcgaatgtgctgccaaacccgccgccctgcatatcgtccgaaacgccctcgacagcattgacggcaaccgcagccaaaccctcgcacgaataaaaaaacacctgccccaaaccgacagcggcacactcgaagccgcactcgacctcattgcttcgctcaatccctttcccgccgccggttttgcctcgtccacgcccacgccgtattctgacgaggcgctcgccaacctgctggctttccgcggcatggaggtttctcgccgcaccattgccaaatacagagaatcctttgagattccggcagcacacaaacgcaaaaccgcagaataattgccgaataatcttataaagacaacaaaccaaaagccggcatttctgcgaaagcgggaatgccgaatccgtccgcgcggaaacctgcatcccgtcattcccgcgaaagagggaatctagaaacgcaaagctgcaagagtttatcggaaatgaccgaaactcaacgaacctggattcccgctttcgcgggaatgacgggggtttggcgggaatgacgagggtttgggatttctgtttttgaatttctgtttttgtgagaatggcaagattttcggttcttgtatggataacgagattttagatggcgggaatttgtcgggaaaacagcaatctgagacctttgcaaaaataatctgttaacgaaatttgacgcataaaaatgcgccaaaaaattttcaattgcctaaaaccttcctaatattgagcaaaaagtaggagaaatcagaaaagttttgcattttgaaaatgagattgagcataaaattttagtaacctatgttattgcaaaggtctcaatctttaccgtcattcccacgaaagtgggaatctagaaacgcaaagttgcaagaatttatcggaaatgaccgaaactcaacgaacctggattcccgctttcgcgggaatgacgagggtttgggatttctgtttttgaatttctgtttttgtgagaatggcaagattttcggttcttgtatggataacgagattttagatggcgggaatttgtcaggaaaacagcaaccctccgccgtcattcccacgaaagtgggaatctagaaacgcaaagttgcaagaatttatcggaaatgaccgaaactaaacgaacctgaattcccgctttcgagggaatgacgggggtgtggcgggaatgacgggggtttatcagaaatgaccgaaactcaaaagcgggcagccttgtttacgccttcaaaatatcgagcaatttcaaatcgactttttcggcatcgaatttatctttggcaatcgcataacttgcattccccatcaggcggacggcttccctgttttcgataaaataaatcattttttcggccaagatgcggggattccaaggctcgatcaggaagccgttgaccttgtcggcgaccgtttccctgcatccggggacatccgtcgtaatcactgccctgccgacggccattgcctcctgagtgcttcggggaacgccttccctataataagacggcaatacgaatatatgatgttcttttatcacttcggaaacattgttcacaaaaccggggaaacggataatatcgcgggcggcaagccgttccaaatcgcccccccccccgcgtgatttgtcgattgcgcccaaagcggtaaaaaccgtatcggggtatttgtccttaacctgttccgccgcccgaataaaatcatcaatccccttttctttcagaaatctgccgataaagaggaattttacgggttctttttcatcgggaatatccgcctcggaataaggatattgccgcaaatccagaccgattccgcccaaaatatggatgttttttattttgatgccgtatttgtccgtcagttcgtctttgtcgtcggggtttaatacaatcaggctttccaacatcggcagggcaatgcggtataaggcaatcaaaatcccctttatgatttttgtttttaacggtatgccttccggctgcggggtaaatgcgaatcccaaaccttccagcatcccgacgattctgggcacgcctgccagttttgcggcaaaagtgccgaaaatcacgggttttgcgaaataagggaaaaccaaatccggcgatatttttttgagttctttaaagatgaggaaggtggattttatatccgaaaacgggttcagcccgctgcggtttgaacggtaggtaacgggtgtaacccccatttccctgataatatccaattcattgtcggaaaactccgatacaaaggcatacacctgatggtttttgccgattaattttttaatgacgggggcgcggaaaccgtaaatgctggatgcgactgttgtgataaaaacgattttcataaggcggacaccttgaatatggattggaaatgcggtctgctacggcagggtttcatcctgtaacccagcaaggcttgggtttgcctgcgtattatagtggattaacaaaaaccggtacggcgttgccccgccttagctcaaagagaacgattctctaaggtgctgaagcaccaagtgaatcggttccgtactatttgtactgtctgcggctcgccgccttgtcctgatttttgttaatcactataaaaatgccgtctgaaacggtttcagacggcatttcgatgtcggcggcggctttgcggaatcagcctttgaagcgtttgaagaccagcgtgccgttggtgccgccgaagccgaaggagttggaaatggcaacgtcgatttccgcgtcgcgcgcttcgttggcgcagtagtccaaatcgcagccggcttcaacgtcttgttcaaaaatgttgatggtcggcgggattttgccgtcgtgtatcgccaaaatgctgtacacggcctccacgccgcccgccgcgccgagcaggtggccggtcatggatttggtcgagctgacgacggttttgtaggcgtgttcgccgaacgcgcgtttgagggctttggtttcgttggcatcgcccaagggggtggacgtgccgtgcgcgttgacgtaatccacgtcttcgggattgatgccggcatctttcagcgcgcgggtaacggcaagggcggggccttcttcgttcggcgcggtgatatggtaagcatcggaactcatgccgaagccgacgatttcggcgtagattttcgcgccgcgttttttggcgtgttccaattcttccaacaccaatatgcccgcgccttcgccgataacgaagccgtcgcggcctttgtcccacggacgggaagcggtggcggggtcgtcgttgcgggtggagagggctttcatcgcggcaaaaccgcccacgcccaaagtgctgattgcgccttccgcgccgccggcaaccattatgtccgcgtcgccgtatttaatcatacggagggaatcgccgatggcgtgcgcgccggtggtgcaggcggaaaccatcccgtagctcgggccgcggtagcctttgaggatggtaacgtgtccggaaatcagattaatcagagaaccggggataaagaaagggttgattttgcgcgcgccgccttcgattacggctttgccggtgacctcgatgccgggcagtccgccgatgccggaaccgatgttcacgccgatgcggtctttgtcgaggttttccacatcgtccaaacccgaatcggcgattgcctgcaatgcggcggcaatgccgtagtggatgaatacgtccatccggcgcgcttctttcgcgctgatgtattgtccgatgtcgaaaccgcgcacctcgccggcgacacggctgttgatgtcggatgtgtcaaagcgggtaatcgcgccgatgccgcttttgccggtgagcagggtgtcccaagcctctgcgacagtgttgccgacaggggaaacctgacctaagcctgtaatgactactcttctctgactcatgataacctcgctgttggttgtcggaatgggggcatatgcggctgtcgtgcagatgccgtctgtaatttgcggcaggggttcaaacagtttgccatataagggaaaagcctctattgcgcggtgcagcagaggctgttgtgtcgggcgacgaccggttagccgttgtgggcattgatgtagtcgatagccagttggacggtggtgattttttcggcatcttcgtcggggatttcgcagccgaatgcttcttccaaagccataaccagctccacggtgtccaaagaatccgcgcccaagtcgtcttggaaggaagattcgtttttcacgtcggcttcgtttacgcccagttgttcagcaacaatttttttaacttgttgttcgatgtttgacatatcagtcgttcctttatgccttgcggcaggttgtttaagggaaataaatcggtggtattgtaccgacttttaatagagttttctatctaatgactattatatcaatatttgccgatttgtacatttttgggtgcggcgggttttgtcgttcaagtttgacctgtgtgccgtatgtttggcgggatttcggttaaaatggcggcatttccatctgaagcagaaagccctgtcatgtatccacttgcccgtcgcatcctgtttgcactcgatgccgaaaaagcccaccacttcacgctcgacgcgctctacacggtttataaattgggtttgattcctgtaaccgacaaccgtaccaaacctgtaaaattgatgggtatggatttgcccaaccctgtcggacttgccgccggactcgacaaaaacggcgaatacatcgacgcattgggcgcgctcggctttggtttcatcgaaatcggcacggtaacgcccaacccgcagcccggcaacccgcagccgcgcctctttcgcgttcccgaacaccaaggcatcatcaaccgcatgggtttcaacaaccacggtatcgacaccatgatacgcaacatcgaaaaaagtaaattcagtggcgtattgggcatcaacatcggtaaaaacgcggttacacccatcgaaaacgctgccgatgattatttaatctgccttgaaaaagcctacgcacacgcaagttacattaccgtcaatatttcctcgcccaacactaaaaacctccgcgcgctgcaaggtggcgacgagttgagcgcattgcttgaggctttgaaaaacaaacaggcacagcttgcctctgtacacgggaaatacgtcccgctcgccgtcaaaatcgcccccgatttggatgaagcacaaatcgaagacatcgcccacgttgtcaaatccgtcgaaatggacggcatcatcgctaccaataccaccatcgacaaatcaagtctcggcagccatccgctcgcaggcgagcagggcggtttgagcgggctgcccgttcatgaaaaaagtaatcgggtgttgaagctgttggcagaccacatagacggcaagctgccgattatcggcgtaggcggcattatggaaggcgaggactcggcagataaaatccgcttgggcgcgaccgccgtccaagtgtacagcggattgatatacaaaggtccggcattggtcaaagaatgtttgaaggctttggcgcgatgacgcgatccgcccaaaatgccgtctgaacgcacgttttgccgttcagacggcattttcatttcctttttccgcctgacgccccttgaaaatcccttacgcgccgccctgtttgaaataaggcaaaccgatgcgtgaacacggagcaggcaatcggagtaaaaaatgaaccttgatttaaccgcgcaaaaagtccgtctttcttggaaggatattctgtgggggtatgggaataaatacttgggttgggctgatgtggcagcttatgcccgaaaaatgacgctttcagatcatgatgaacgtgtgttcaaactatctttaatcaacaaatccaatattcttgaattaaagcctgttctggaagatttggcttcggaaatgagggattattcccctaaaaattggctgtacgtcctcttaagcgatgtattccatagaaaagaagaatttgaggatcctttgggggaagttgaaaaaatttatgcagattttgattatccggaagaaatagaatcatttgtcaggtatatgccgcccaaagacggttatattccttctgcccacacctatgaagaaaatattgcccggttatattctcactgggaacactatttgaacaacggcggagggcagggttaaaaccggcaatccgatgccgtctgaagcattatccggccttcagacggcattttgttttccgacagtttataaactgtcgttgtttcttgacagaaacaacgaccttatttgaaacgattggaggacatgattatgggtttttggaatggtgtggcaaaagcagcaaaagcagtgggagagggaatgattgaagccggcaatgagcataaggcgttgaaaatggaatatgcggagaaatcaagtgaggagctgcatgaaatcgtcaagagtgatggtttttttaaaaattccacacgggagaaaagtgcggcttatgctattttaaaagagcgtggcgaggtgtgaacaggaaacggcggcatttgccgctgttttttattggtaggcatccgtccgaatatcggggcaaggtttcagacgacatcgaaggttgctatgatatagtggcttgactttaaaccggtacggcatcccctcgccttgtcctgatttaaagttaatccactatctcattcccgtcatccttccaaacggaatccgaaatgtccgacaaccgcctcgacaccgcccgccgccattccctcttcctcgcccgccagctcgacaacggcaaactcaagcccgaaatattcctgcctatgctcgacaaggttttgaccgaagcggatttccaagcctttgccgactggggcgaaatccgcgcggaagaaaacgaggaagaattggcgcggcagttgcgcgagttgcgccgttatgtggtgtcgcagattatcgtgcgcgatatcaaccgtatcagcgatttgaacgaagtaacccgcacgattacgctgtttgccgattttgccgtcaataccgcgctggattttgcctacgcctattatcgggacatgtacggcacgccgatcgggcgttataccaaatcgccgcagcatttgagcgtggtggcgatgggcaaggcgggcggctatgagttgaacgtgtcttccgacatcgatttgattttcgtctatcccgaatcaggcgacaccgacggcaggcgcgaacggggcaatcaggaatttttcaccaaagtcgggcagaaactgattgcgctgctgaacgacattaccgccgatgggcaggtgttccgcgtcgatatgcggctgcggccggacggcgattcgggcgcgttggtattgagcgaaaccgcgctggagcaatatttgattacacaggggcgagaatgggaacgctacgcgtggtgcaaaggtcgcgtggttacgccgtatccgaacgacatcaaagcactggtgcgcccctttgtgttccgcaaatatctggattacggcgcgtatgaggcgatgcgtaagctgcaccgccaaatcagcagcgaagtcagcaaaaaaggcatggcggacaacatcaaactcggcgcgggcggcatccgcgaagtcgaatttatcgcccagattttccagatgatacgcggcggacaaatgcgcgcgctgcaactgaaaggcacgcaggaaacgctgaagaagcttgccgagctgggcatcatgctgtctgaacacgtcgaaaccctgcttgccgcctaccgcttcctgcgcgatgttgaacaccgcctgcaatactgggatgaccagcaaacccaaaccctgccgacctcgcccgaacagcggcaactgctcgccgaaagcatgggtttcgacagttattccgctttttcagacggtctcaatgttcatcggaacaaagtcaatcagttgttcaacgaaattttgagcgaacccgaagagcaaacgcaagacaacagcgaatggcaatgggcatggcaggacaaacccgacgaagaagggcggcgatgccgtctgaaggcgcacgggttcgatgccgaaaccgtcgccgcaaggctcgaccaaatccgccacggccataaataccgccatctttccgcacacgcccagccgcgtttcgatgcggttgtgccgctgttcgtacaggcggcggcagcgcaaagcaacccgaccgatacattgatgcggctgttggattttctcgaaaacatcagccgccgatccgcctatctcgccttcctcaacgaacatccgcaaaccttggcgcaactggcgcagattatgggccaaagttcttgggtggcggcgtatctgaacaaatatccgattttgttggacgaactcatcagcgcgcagcttttggataccgcgtttgattggcaggcgctcgccgccgccctttcagacgacctcaaagcctgcggcggcgatactgaagcgcaaatggacaccctgcgccgcttccagcacgcccaagtcttccgtctcgccgtccaagacctcgccggactgtggacggtagaatccctctccgaccaactctccgccctcgccgacaccatcctcgccgccgccctgctgtgcgcatgggcggacatgcccaaaaaacaccgcgacacaccgcaattcgccgtcgtcggctacggcaaactcggcggtaaagaactcggctacgcctccgacctcgacctcgtctatctctacgacgacccccaccccgacgcaggcgacgtgtacagccgcctcgcccgccgcctgaccaactggctttccgccgccactggcgcaggcagcctctacgaaaccgacctgcgcctgcgccctaatggcgacgccggtttcctcgcccacagcatcgccgcctttgaaaaataccagcgcgaaaacgcctggacgtgggaacaccaatcccttacccgcgcccgcttcatctgcggcacgtccgaaattcagacggccttcgaccgcatccgcaccgaaatcctcaccgccgaacgcgaccaaaccgccttggcaggcgaaatcatcgaaatgcgcgaaaaaatgttccccacccacccgcctgccgacagcaacgtcaaatacgcgcgcggtggcgtggtcgatgtcgaatttatcgtccaatatctgatacttgcccatgcccgccagtatccgcaactcttggacaactacggcaacatcgccctcttaaacatctccgccgactgcggtttgattgacaaaaccctcgccggacaaagccgcaccgcctatcgcttctaccgccggcagcagcacaacaccaaactgcgcgacgcggcaaaaaccgaagtaaccggcgaactgttggcacattacggcaatgtcaggaaattgtggcgggaagtgttcggcgaagaagcggcaaccgtctgaacaaaaaatgccgtctgaagcctgacaatctgggtttcagacggtattttcgtaccgtgccgttttaaggttgcggcagagctaaagcgatttatcgggaatggctgaaacccaaaaaccggattcctctttcgcgggaatgacgggatttcaggcttctgtttttgtgggaatgatgggattttttatccaagcaaaaatcaaaacaaacaaataagaaccgtttaaaaccccgccgtttccattaaaatagcgcattctactttttagacggccttggattcggatttcaagtgcaacactagtgtattagtggttggaacagattcaagaataaaacacttggcgtttcgtagccaagtgtttttcttggtcggtggttcaactcatcttgaaccctgcgtatctcccgatcactgatgttacggaaatcggtttgtttggggaagtattgccggatgagtccgttggtgttctcattcagccctttctcccaagaatggtaagggcgacaaaaataagtctccgctttcaatgctttggttattttggtgtgttggtagaactctttgccgttatccatggtaatggtgtgcaccctgtctttatgtgcctttaatgccctaacagctgcccgggcagtgtcttcggctttgaggctatccaatttgcagatgatggtgtagcgggtaacgcgttcgaccaaggtcaataatgcgcttttctgtcctttgccgacaatggtgtcggcttcccaatcgccgatacgggatttctggtcgacgatagcgggtcggttttctatgccgacacggttgggtactttgcctctggtccatgtgctgccgtagcgtttgcggtagggtttgctgcatattctgagatgttgccacaacgtgctgccgttgcttttgtcttggcgaaggtagcggtaaatggtgctgtggtggagcgtgatctggtggtgtttgcacaggtaggcgcatacttgttcgggactgagtttgcggcggataaagggtgtcgatgtgctgaatcagctgcgaatcgagcttatagggttgtcgcttacgctgtttgatagtctggctttgccgctgggctttttcggcgctgtattgctgcccttgggtgcggtgccgtctgatttcgcggctgatggtgcttttgtggcggttcagctgtttggcgatttcggtgacggtgcagtggcgggacaggtattggatgtggtatcgttcgccttgggtcagttgcgtgtagctcatggcaatctttcttgcaggaaaggccgtatgctaccgcatactggcctttttctgttagggaaagttgcacttcaaatgcgaatccgccgacctctttcagttacagcagcttgatccctttcccttatccaacgggggaaggctaggatagggtggcttgcaaatatacagaacaagggacaagagccaccctctctccaaccctctccctccgtacgggagggggtggattctcgcgggcgaagcccacgctacggttagcctttaccccagcacaaacaattcccgcccgtgcgccttcagccaacttttagcattgtcggtatgcggcgtcagcgtgttcaccaaatgccaaaagcgcggactgtggtcggggtggcggaggtggcagagttcgtggatgcagacatagtcggcgacgtattcgggcgtgccgatcagccgccagttgaggcggatgccggtgtgcgggcggcatacgccccaaaaggttttggcgttgctcaggtctgtggcggtgggcgtcagtcctgtttcggctgcgtgtttttcaaggcggggcagcaggtattcgcgggcgcgttcgttcaacaggcggcgcaggtggtcgatttgtgcggcggtttcttttcggggaagcaggatttcagacgacgtgatacggatatggctttggctgtgggtatccagcttggtctttattccccgataccaaatccactcgggtaagtttgggtgggaaacaggatgcacgggcgttttggcaagcgtgttccgcaaaatcgtttcgtttgccgccagccagtttgctaacgcgtggtcttgaaaaaagggtgggacgttgatgctgaccgtctgcatattgacggggcgcagaatcagatttttcttggcactgcgtttgagttcgatttcgatgcacaaaccgtcggaaagagtataggtgaagcgtttcatagttgtgaataggtttcagaccggatacatcgtctgaaacaggaattttccatatcaggcggcaaacttcggataatatacaaaatcaaacatctgcgctacaaggttcagccgaacaagccgccgatatatttgctgatggtgatggcgctgagtactgccatcaaaccgaccacaatcacgccggaaacggtgagccacagcgggtgtttgtagtcgccgacaattttggttttgtaggcggcaatcagaatcagaccgagggaaatcggtaaaatcaggccgtttaatgcgcctacgaacaccagcacctgcgccggtttgccgatggtggaaaatacggcggtggacacggcgataaaggcaataatccatttgtttttattgcgttcgatagacgggctgagaccggagaagaacgacaccgaagtataagccgcaccaatcaccgaagtaatcgaagccgcccaaatcaccacgccgaaaatcagcaggccgatgtatcccgccgcatattcaaacggtgtggaagcagggttgtcgggattgagctgtacgccttggctgaccacgcccaaaaccgccaaaaacaatacaatccgcataatcgaggcaatcaggatcgcccgcaccgagctttggctcacttccggcaacgccgatttgcctttgatacctgcgtccagcagacggtgcgcaccggcgaaggtgatgtagccgccgaccgtgccgcccaccagtgtaacaatcgccattgcatcgagtttttccggcataaaggtatgcacggcggcatctgccagcggcggattcgcctgccatgccacataaaccgtcagcgcaatcattacgaaacccatcacttgggcgaatttgtccatcactttgcctgcttctttaaacagaaacacaccgatggcaatcacgccgctgatcacggcaccggtttccggtgacagtccggtcagcaggttcagacccaagcctgcgccgccgacgttgccaatattgaacgccaaaccgcccatcacaatcagcacagccaagaaatagcctgcgccgggcaagacctgattggcaatatcctgcgcctgtttttcggaaacggcgacaatccgccaaatattgagctgcgccccgatgtcgagcagaatcgagagcagaatcacaaagccgaaacttgccgccagtgcttgggtgaaggtggcggtttgggtcagaaagcccgggccgatggcggaagtcgccatcaggaatgcagcgccgattaaggcatttctgcggtttttttgatcagacataatcgcttatcctctataaaattggttgttgctgtgtttgggcgaaacctgcggttttagctacgcagaaactcgctttgctcgttttggcgaaacctgcggttttcagacggcctatgaactgtttttcaagcagaaactttgatgcctgccgccagtagttcctgccggattttttcggcaaacaccacggcgtgcggcccgtctccgtgcagacagatgctgtcggcttgcacggcaaccaggctgccgtccactgctttgacctgcccgtcccgcaccatctgcaatacttgggcgatggcttcttcgtcgctgtccacctgcgcatcggggcggctgcggggaaccagcgtaccgtcgggcatatagcggcggtcggcgaatacttcggaaatcacacccaagcctgcggcttttccggcttccaagagcaggctgccggaaagtgccatcaatttcaatttcgggtcgaaatccgccacaattcgggcaacggtatccgccagcgcacggtttttcgccgcttgattgtacattgcgccgtgcggtttgacataagccatttccaaaccctgatcacggcacaaggcctgcaatgcgcccaactggtaattcagacacgcccgcaaatcggcttcggacagattcatttcggtacggccgaagttttcccgatcgggatagccggggtgtgctccgatgcgcacgccgttttgttgggcatacgccaatgccgcccgaatatcggcaatgctgccggcgtgttgggcgcaggcgatgttggccgaagtaatcagctgcaacaaggcttcgtcgctgccgcagccttcggcgagatcggcgtttaaatcaacctgcttcatgggtgattctccgtatttggttcagataggcttgtttttgcgccgcagggcggtggcttctttcaagccgattattttgaatttgactttgctgccgaagcgcacctgtgccagcctgcccaaatcggcggcggcaacggtagcgattttcggataaccgccggtggtttgcgcatcggccagcaggataatcggtttgccgccgggcggcacctgcacggttcctgcctgaacagcgtgggacagcatttccaaaggttgcgacagggtcagcggctgtccgtcgaagcggtagcccatgcggttgctatcgctttgcagcgtccacgtttcccgttccagattcagacgccctttttcactgaaagcggcatattccgacgaaggaacaaggtggacggtatcggtaaacggtatcggggcaatgccgactttggacaattcctgcgcacctttgccgatggggagataatcgcctttttgcagcattctgccctgatggccgccgaaaccggctttcaggtcggtgcttctcgaacccatcacttccggcacatcaaatccgcccgccacgcacacatagccgtacatgccctgcacggcacgcaccagtttcaaggtctgccctttgcgggcggtataacgccaatacgaatagaccggttcgccgtccaattccgcctgatacacggcaccggtgagacaaaacggcgtatcccgttcaaacaccagcattatcccgcccaaagcgatttcgattgcggccgtgccttcgtcgttgcccaataaaatattgcccgccgccaaagcaaccgtgtccatcgcaccggcatgaccgatgccgtaacgccggtgtccgtagcgtccggtatcctgaatatgcgccggtgcctgcactgccgaaacgtgaatcatggctcaatcctttctgcaacaaagcggacttggtcacccgccgccagcagggtcggcggattcaaatcggctcggaacaagggtaattcggttctgccgataatctgccagccgccgggcgaagcgaacggatacacaccggtctgactgccgccgataccgaccgaaccggcaggaacggacgttctcggcacggcacggcggggcgtgtgcaatgcttcgggcaagccgcccagataagggaaaccgggctggaagcccatcataaatacggtataagtttgcgccgtatggcggcggacgatttcggaaataaccgtctgatggaaagcagcgacttccgccaaatccgggccgtattcgccgccgtagcagacgggaatttccaccagtttgccctgatggtctgtaacggcggtgtgttcccacacatattgcaattcatcggcaagcgtcgccaaatcggtatcgaaacgggtaaacacggtcagattgttcatgccgaccaccacttcctcaatcctgtcgtgctgcccgagcgcagcggcaaacgcccacaacttttgctgtttgcccagttcggaaggcgcattcagtcggtagaccaaagcggattcgctgattggtgtgatctctattctcatttgttgttcattttggttatgttttaatgaatctatatgcaggggcggcggtttgtcaatatcttctgtgctgcatcatcaaaccgtcgattggaaaagtgctgccctgccgctgcactttttcagacgaccttaaaccgtttctattaaaatagcgcattccacttttcagacggcatccttatgtttcccgaccaatccgcccccaacctgctgcaaggcttgaatcccgaacaactctccgccgtaacctggccgccgcaatccgcacttgtgctggcgggcgcgggcagcggcaaaacgcgcgtgctgaccacgcgcatcgcatggctgttgcaaagcggacaagccagcgtgcacagcattatggcggtaacgtttaccaacaaagccgccaaagaaatgcaaacccgtttgggcgcgatgattcccatcaatgtccgcgccatgtggctcggcacgttccacggtctctgccaccgctttttgcgcctgcaccaccgcgacgccggtctgccgtcttcctttcaaatcctcgacggcggcgaccagctttccctcatcaaacgcctgctcaaaagcctcaacatcgccgaagaaatcatcgcgccgcgttcgctgcaaggctttatcaacgcgcaaaaagaatccggtttgcgcgcttccgtgttgagcgcgcccgatccgcacacacgccgcatgattgagtgctacgccgaatacgacaaaatctgccaacgcgaaggcgtggtcgattttgccgaactcatgctccgcagctacgaaatgctgcaaaacaacgaaatcctgcgccagcactaccaaaaccgcttcaaccacattctcgttgacgagttccaagacaccaacaaactgcaatatgcttggctgaaactgattgccggcaaccacgcagcagtatttgccgtcggcgacgacgaccaaagcatttaccgtttccgtggcgcaagcgtcggcaacatgaccgcgctgatggaagaattccacatcgacgcgcccgtcaaactcgaacaaaactaccgctccgtcggcaacatccttgccgccgccaatgccgtgattgaaaacaacgacgaacgactcggcaaaaacctgcgcaccgacgccgaagcaggcgacaaaatccgctactactccgcctttaccgacctcgaagaagcccggttcatcttggacgaaaccaaagccctcgaacgcgaaggctgggatttggacgaaatcgccgtcctctaccgtagcaacgcccaatcccgcgttatcgaacaaagcctgttccgcagcggcattccctacaaaatctacggcggcttgcgtttttacgaacgccaagaaatcaaacacgcgctcgcctacctgcgcctcgccgtcaatcccgacgacgacaacgccctcttgcgtgtcatcaacttcccaccgcgcggcatcggtgcacgtaccgtcgaaaatcttcagacggcctcaaacgaacaaggcatcaccctctggcaagccgcctgcaacgccggcgcgaaagccgccaaagtcgtcgccttcgtccgcctgattgaagccctgcgcaaccaagtcggacaactgtccctgtccgaaatcatcgtcggcatcctcaaagacagtggcttgaccgaacactaccgcacccaaaaaggcgacaaccaagaccgtctcgacaaccttgacgaactcgtcaacgccgccatcgaattcaaacccgaagacagcaacttcgaaatcctgcctgaaaacatttcagacgaccccgccttccccattctcgccttcctaagcaatgccgccctcgaatccggtgaaaaccaggcaggcgcaggcgaaaaggccgtccaactcatgaccgtccacgccgccaaaggcttggaatttaacgccgtcttcctcaccggcatggaagaaggccgcttccccagcgaaatgagccttgccgaacgcggcggcctcgaagaagaacgccgcctcatgtacgtcgccatcacccgcgcccgcaaacgcctctacatcaccatggcgcaacaacgcatgctgcacggacaaacccaattcggcatcgtctcccgcttcgtcgaagagatcccacccgaagtattgcactacctgtccgtcaaaaagcctgcctacgacagttacggcaacacgcgccaaaccgccgcatccaaagataaaatcatcgacgactacaaacagccccaaacctacgcaggtttccgtatcggacaaaacgtccgccacgccaaattcggcaccggcgtgattatcgatgccgcagataaaggcgaatccgcccgactgaccatcaatttcggcaaacagggcgtgaaagagttggacaccaagtttgcgaaattggaagagatgtaaatttgaaatgtaggtcggatattcgtatccgacctacggcaaaaaccttagcaggagagaatagaaacccgtagcgtgggctttttctatgaatcaagcccaaaatttcagacggcatttttagccgtcattatcgtggatgaagcccacgctacaatgtacacacagagcaaatagagatgtgggtcggatattcgtatccgacaaaaacatttgacgcgtctattgtttccgaaacaccgctgttggaaatgtcggatacaagaatctgacttacggcaaaaaacgtagtaaggacaaagcaaaaggccgtctgaaaacgggaagggcaattttgccgcaaccgccgccgtcattcccgcgcaggcgggaatccagacctttcggcacggaaacttatcggataaaaggtttctttagattccacgtcctagattcccgccggaacataaatgacggacggtaaaagccgggtatgaatacccaccctctgttatcactgagatcaataaggaagaacattatgtcccaagtttttaaagattttgacttgtcctccgtatggaaaactaatagttgggcagatgaaaactacaaagaagccccgtttacccctgaaattttggctgccgtagaaagtgaactgggctataaattgccgcaaagttttattgaattgatggcagtacaaaacggcggaatatttgtcaaaaactgttttccgaccacgcagagaaattcgtgggcggaaaatcatgtgcaaatttgcgaggtatcgggaatcggttttgaaaaagaagggagtttgtgcggcgcgatggggcaaaaactttggctggaagaatgggaatacccgcctatcggcgtgtattttgccaacgacccgtcaggcggtcatgccatgtttgccttagactatcgggcgtgcggcaaagacggcgagccgaaagtggtgtttgtcgaacaagaatcggattttgaaatcgtcgaacttgcccccgattttgaaacctttatccgcagcttgcggcatgaagatgagtttattgacgaagaaatataaaacggtggttgaaaaactgaaatcatcaagagaaaacgggcgaaataacgggtaatcgcttgaatccgtaaggaaaacggtttggtggaacgcgccatccaagacctttgcaaaaaactgtccccgacagcattgacattattaacagaacttatcaattttggagctatctcaaatataattcggttatcctgttgtatccattaaatcatatgcttcaattaattgttgttctagctcttataccaattttggattgcgaattcctgacacaatctcaaattcttctgcatctatgcaaacacctgcataaatttcaataacaagggaacgcaataattgaagctcttctcttgttaaagaaataataatgtcatcacctttgtaattgattatattcataataattttatttttgtttgtcaaagtaagttttgcctaaggttggtctaaatgcagttccaccatcttttgaatttgggtctctgattacaattgctccagacttatcatcccaaattgctcttatgtgtttggattgtaatcttcgaattcccaagaaaaaaatcgtaataagtttgaaagtgtcaaatcccaagtttcttttgagcaatattctaatattttatcaatttcacttttaataatcttatgatcaaactgttctaatattaatgcattagaccaaaaaaaaccttctttattacaatgatgggaaatccatttaggagaacaaatgcaaagtgaaaaaatagatgagccttgttctccttcgattccgatatccaaatctatccatctatggaaattatctggaatttcgggggtaaatttttcaaaatcaatatcatataaatttatgctttttaaatccaatttaatcattagggctgtcctagataaatagggaaattcaaattaagttagaattatccctatgagaaaaagtcgtctaagccggtataaacaaaataaactcattgagctatttgtcgcaggtgtaactgcaagaacagcaacagagcccgacagcattgtttatacggattgttatcgtagctattcatttacgcaagtttaacggcattcccaaagcgcattttgagctgtatttaaaggagtgcgaatggcgttttaacaacagtgagataaaagttcaaatttccattttaaaacaattagtaaaatcgagtttatcttagttgtccaggacagccccattatttttataacaccgtgaagccgcacagcagtttgaacagtgatacgccgtttgcgggcttacgagtttattttcccggcctgcagtttgagcaatacggtgatttcctacggttaatacaaatgtttacacattgatacatttcatttatagttccgcctatttgaaaatagaaaatatgaattcgaccgcaagtaaaaccctgaaaggattgtcgctggtgtttttcgcctctggattctgcgccctgatttaccaggtcagctggcagaggcttctattcagtcacataggtatcgatttgagttcgattactgtcattatttctgtatttatggtcggcttgggtgtaggtgcgtatttcggtggacgcattgctgaccgttttccttcaagtatcatccccctgttttgcatcgctgaagtatccatcggtctgttcggtttggtaagcaggggtctgatttccggcttggggcatcttttagttgaggctgatttgcccatcatcgctgctgccaatttcctcttattgctgcttcctacctttatgatgggcgcgaccttgcccttgctgacctgtttttttaaccggaaaatacataatgttggcgagtctatcggtaccttatattttttcaacactttgggtgcggcactcggatcgcttgccgccgccgaatttttctacgtcttttttaccctctcccaaaccattgcgctgacagcctgctttaaccttctgattgctgcttcagtatggctgcgttacagaaaggatggatatagtgaacactaaaccgaatactagtttgatttatatgctttctttccttagcggcttattgagcttgggtatagaagtcttgtgggtgaggatgttttcgttcgcagcacagtccgtgcctcaggcattttcatttacccttgcctgttttctgaccggtatcgccgtcggcgcgtattttggcaaacggatttgccgcagccgctttgttgatattccctttatcgggcagtgcttcttgtgggcgggtattgccgactttttgattttgggtgctgcgtggttgttgacgggtttttccggcttcgtccaccacgccggtatcttcattaccctgtctgccgtcgtcagagggttgattttcccgctcgtacaccatgtgggtacggatggcaacaaatccggacgacaggtttccaatgtttatttcgccaacgttgccggcagtgcattgggtccggtccttatcggctttgtgatacttgatttcttgtccacccaacagatttacctgctcatctgtttgatttctgctgctgtccctttgttttgtacactgttccaaaaaagtctccgactgaatgcagtgtcggtagcagtttccctaatgttcggcatcctcatgttcctactgccggattctgtctttcaaaatattgctgaccgtccggataggctgattgaaaacaaacacggcattgttgcggtttaccatagagatggtgataaggttgtttatggggcgaatgtatacgacggcgcatacaataccgatgtattcaatagtgtcaacggcatcgaacgtgcctatctgctaccctccctgaagtctggcatacgccgcattttcgtcgttggactgagtacaggttcgtgggcgcgcgtcttgtctgccattccggaaatgcagtcgatgatcgttgcggaaatcaatccggcataccgtagccttatcgcggacgagccgcaaatcgccccgcttttgcaggacaaacgtgttgaaattgtattggatgacggtaggaaatggctgcgtcgccatcctgatgaaaaattcgacctgattttgatgaatacgacttggtactggcgtgcctattccaccaacctgttgagtgcggaatttttaaaacaggtgcaaagccaccttaccccggatggtattgtaatgtttaataccacgcacagcccgcatgcttttgctaccgccgtacacagtattccctatgcataccgctatgggcatatggtagtcggctcggcaaccccggtagttttccctaataaagaactgctcaagcaacgtctctcccggttgatttggccggaaagcggcaggcacgtatttgacagcagcaccgtggatgctgcagcacaaaaggttgtctctcgtatgctgattcagatgacggaaccttcggctggggcggaagttattaccgacgataatatgattgtagaatacaaatacggcagagggatttaaccgtcttaaagggtttcaggcaacgcaggttttaggtaacgtcctgctagttcaaaaaaaccgcatcacagcagtcgggacaaaatggtttaaacattttgtcccgaattcttattcctatatatagtggattaacaaaaatcaggacaaggcgacgaagccgcagacagtacaaatagtacggaaccgattcacttggtgcttgagcaccttagagaatcgttctctttgagctaaggcgaggcaacgccgtactggtttttgttaatccactataccacgaattacggtgtaaaaatttatatgaccttataaaatcaaataagaatcgttatcataacatgattgtatttattgggtttttttgggcgttttgccgatatttaccttttaatggtttttgaaattcgctaaaatacgaaattattgtagaaattttgttaacggatttgggtgtaaccatgttgtccgcttactttcccgtctttgtctttatcctcatcggcctcgcggccggcgtgctgtttatcctgctcggcacgattttaggcccgaaacgccactatgccgaaaaagacgcgccttacgaatgcggttttgaagcttttgaaaacgccaggatgaagttcgacgtgcgctattacctcgtcgccatcctcttcatcctgtttgatttggaggtcgcgtttatgctgccgtgggcagtcgtgttcaaagatttgggcgcgtacggcttctggtctatgctggtgtttatcgttgttctgacggtaggctttgtttacgaatggaaaaaaggtgcgctggaatgggaatagaaggcgttttgaaaaaaggtttcatcaccaccagcgcggatacggtgctgaactatatgcgtaccggttcgttgtggccggttactttcggcttggcctgctgcgccgtggaaatgatgcacgcgggtatggcgcgttacgaccttgaccgtttcggtattattttccgtccgtccccccgtcaggccgacctgatgattgtggcgggtacgctcaccaataaaatggcgcccgccctgcgccgagtgtacgaccagctcgccgagccgcgctgggtattgtctatgggctcatgtgccaacggcggcggctattatcactattcttattccgttgtgcgcggtgccgaccgcgtcgtgccggtagatgtttatgtgccgggttgtccgccgactgcggaagccctgatttacggcctgattcagctccaacaaaaaatcaagcgcacttccaccattgcgcgtgacgagtaaggagaggacgatatggcaagcattcaagacttatacgaaaccgtcagccgcgttttgggcaatcaggcaggcaaagtcatttccgctttgggcgagattaccgtcgagtgtctgcccgagcactatatttcagtcatgaccgcattgcgtgaccatgaagagttgcatttcgagcttctggttgacttgtgcggtgtcgattacagcacttacaaaaacgaagcatggcagggcaaacgctttgccgtcgtcagtcagttgctttccgttaaaaacaatcaacgcatccgcgtgcgcgtctgggtttcagacgacgacttccccgtagtcgaatctgtagtcgatatttacaacagcgcggattggtacgaacgcgaagccttcgatatgtacggcatcatgttcaacaaccatccggacttgcgccgcatcctgaccgattacggcttcgtcggacatccgttccgcaaagacttcccgatttccggctatgtggaaatgcgttacgacgaagagcaaaaacgcgtgatttaccaacctgttaccattgagccgcgcgagatcacgccgcgtatcgtccgtgaggagaactacggtggccaataaattaagaaactacaccatcaacttcggcccgcaacaccctgcggcgcacggcgtattgcgtatgattttggagctggacggcgaacaaatcgtccgtgccgacccgcatatcggcctcttgcaccgaggtaccgaaaaactggcggaaaccaaaacctatctgcaagccctgccctatatggaccgcttggactatgtttccatgatggtcaatgagcaggcgtattgtttggcagtagaaaaacttgtcggtatcgatgtgcccatccgcgcccaatacatccgcgtgatgtttgccgaagtaacgcgcatcctcaatcacttgatgggcatcggttcgcatgccttcgacatcggcgcgatgaccgccattctttacgccttccgcgaccgcgaagagctgatggacttgtacgaagccgtgtccggcgcgcgtatgcacgccgcctacttccgtcccggcggcgtttaccgcgacctgcccgactttatgcccaaatacgagggcagcaaattccgcaatgccaaagtattgaagcagctcaacgaatcccgcgaaggcaccatgctcgactttatcgatgccttctgcgaacgcttccccaaaaatatcgacacactcgaaaccctcctgaccgacaaccgtatttggaaacagcgtaccgtcggcatcggcgtcgtctcccccgaacgtgccatgcaaaaaggctttaccggcgtgatgttgcgcggttcgggcgtggaatgggacgtgcgtaagacacagccttacgaagtgtacgacaaaatggatttcgacatccctgtcggcgtgaacggcgactgctacgaccgctacctctgccgtatggaagaaatgcgtcaatccgtacgcatcatcaaacaatgttccgagtggttgcgtgtcaatccgggtccggtcattaccacaaaccacaaattcgctccgcccaaacgtaccgaaatgaaaacaggtatggaagacctgattcaccatttcaaactctttaccgagggtatgcacgttcccgagggcgagacctacaccgctgtcgaacatccgaaaggcgagttcggcgtttacatcatttcagacggcgcaaacaaaccctaccgcctgaaaatccgcgcacccggcttcgcccatctgcaaggcatggacgaaatggcaaaaggccacatgctcgccgacgtcgttgccatcatcggtacgcaggacatcgtattcggggaggttgaccgataatgttatccgcagaatctttaaaacaaatcgacatcgagttggcaaaatatcctgccgaccaacgccgctccgcgattatgggcgcattgcgtattgcccaaaccgaaaaaggctggcttgctcccgagaccatcgcttttgtcgccgactacatcggcatcacgcctgcacaagcctacgaagtcgccactttctacaatatgtacgaccttgagcctgtcggcaaatacaaactgaccgtttgtaccaacctgccctgcgccctgcgcggcggtatggctaccggcgaatacctcaaacaaaaactcggtatcggctacggcgaaactacccctgacggcaagtttacccttgtcgaaggcgaatgcatgggcgcatgcggcgacgctcccgttatgctggtcaacaaccacagcatgtgcagctttatgaccgaagaagcgattgagaagaaactggcggagttggagtaggtcgtctgaaacgacgatttaaacgtaggtcggatacttgtagccgacagagtgggtaaaaaggcaaaatgtcggatttaagaatccgccctactgaaataccgaaatgccgtcattcccgcgcaggcgggaatccaccggtaagattcggtttctgaatttaataagacattgcttaccattgaggatggattcccgcctgcgcgggaatgacgacagacaagcaagtggtcgagatccaacaaaaacgattaaaggtcgtctgaaaatatcgatttgataaactagattttatttcagacgacgttacaagccggtacacaaagacatcttaaggtcgtctgaaacagcggccgcaaccgatacgaaaacaaacaggcacaccaaaaatggctatttaccaatcaggcgtgatttttgaccaagtggataccgccaatcccgattgctggacattggacgaatacgtcaaacgcggcggctataccgccctgcgtaaaattctgtccgaaaacatctcgcaaaccgatgtgattgacgaagtcaaaacctccggtttgcgcgggcgcggcggtgcgggcttcccgaccggtttgaaatggagctttatgccccgttctttcccgggcgaaaaatatgtggtttgcaacaccgacgaaggcgaaccaggtacgtttaaagaccgcgacatcatcatgttcaatccgcatgccctgatcgaaggcatgattatcgccggttacgcgatgggcgcgaaagccggttacaactatatccacggcgaaatttttgaaggctaccaacgctttgaggccgctttggagcaggcgcgtgccgcaggctttttgggtaaaaatattttgggttcggattttgaatttgaactcttcgcccaccacggctacggcgcatatatttgcggcgaggaaaccgcattgctcgaatcgctggaaggcaaaaaaggccagccgcgctttaagccgccattccctgcttcgttcggcctgtacggcaaaccgactaccatcaacaatactgaaacgttctcctccgttccattcattatccgtgacggtggacaggcatttgccgataaaggtattccgaatgcaggcggtaccaaattattctgtatttccggccatgtcgagcgtccgggcaactatgaagtgccattgggtacgccgtttgccgaagtcttgaaaatggcgggcggtatgcgcggcggtaaaaaactcaaagccgtcattcccggcggttcgtccgcgcccgtattgcctgccgacatcatgatgcagaccaatatggactacgactcgatctccaaagcaggctccatgctcggttccggcgcgattatcgtcatggacgaagacgtgtgcatggtcaaagcccttgagcgtttgagctacttctactacgacgagtcttgcggccaatgtaccccctgccgagaaggtacgggctggctttaccgcatcgtccaccgcatcgtagaaggcaaaggtaaaatggaagatttggatttgctggattccgtcggcaaccaaatggcaggccgcaccatctgcgccctcgccgatgctgccgtcttccccgtccgcagctttaccaagcatttccgtgatgagtttgtgcattacatcgaacacggcgggccgatgaaagagcataagtggggagggtggtaatggtggaagctaaaatttttattctatacggtgcagccaacaaaggtaagagtacgacactcaatacgctttttaatcagatttgtcggaaattttctaaatttctagtcttttttgaaagacatggaaacggcttagattttgttgcagtatttgatcatgaaggtcagagaattggtttttattcatctggtgataatgaatacgaggttaggggaaatttatacaaactttattcgcataattgtgattttatttttggcacgtcaaggacacggggtggtagttgcgatgcagtaggatgttatgcagagttattgcatggcgatgtaaatataattaattggtgtgaaaagtttgagcctacagatgaagacaatgagcgtgctgttaaagagttatttaagtcatttaaaaatataataaatgagttatagttttagttggttttatattggttaaaagcaaaatgctaaaaatttaactttgccgtcattcccgcgtaggcgggaatccatagtggaatttacagaacccgatatttgaaaagcagttgccgaaattcaaaaaatggattcccgcctacgcgggaatgacggcgggagtaggcagatgttttcagatgaaaacggttgtaaatgatattaaaaaagttgttgtttatattgcaggaaaaatgaatacgaaaccatccgcttactagacaacctgccgtatatattttggcaaacggtaaaaatggaacactctatatcggtgttaccatgaatttgccggaaagggtttggcagcacaaaaaccatgtcaatattgatggctttactgcccgatatgatgtgcatgatttagtttggtatcagttttttgagaatatgcctgaagcagttgccaaagaaaaaacgatgaaaaaatggcgacgtgaatggaagattaaactgattgaagaacaaaatactgaatgattggacttgtcgggcgtgttgtttgtttagttttatttctggaactttaaaaactgtcgttattccagccccacctacgcgcagacaggctacggcgggaatcaccgcaaaagttaagaaaccaatgtttgaaaacagttaccgaaaacccaagaatggattcacgcctgtgcgggaatgacggcaaggtggcagtaaacgttttaaacagtattgattgtcaatgaaactcaaaaggccgtctgaaacccatttttcagacgacctccataaaagattatttatcaaatacccgtaactaggaacgaaccatgttacaaatcgaaatcgacggcaaacaagtatctgtggagcagggcgcgacggtgattgaagccgcgcacaagctcggtacttatattccgcatttctgttaccacaaaaaactttccatcgccgccaactgccgtatgtgtctggtgaacgtagaaaaagccccaaaacccctgcctgcctgtgccacgccggttacagacggcatgattgtgcgtacgcattcggcaaaagcccgagaggcgcaggaaggcgtgatggagttcctgctcatcaaccatccgcttgattgtccgacctgcgaccaaggcggcgaatgccagttgcaggatttggcggtgggctacggcaaaaccaccagccgctacaccgaagaaaaacgttccgtcgtcggcaaagatatggggtccttggtttccgccgaggaaatgagccgctgtatccactgcacccgctgcgttcgtttcactgaagaaatcgccggtttgcaggaaattgcgatggtgaatcgcggcgaacactccgaaatcatgccctttatcggcaaaacggtggaaaccgaattgtcgggcaacgtcattgatttgtgtcccgtcggcgcgctgaccagcaaaccgttccgcttcaacgcgcgtacttgggaattgaaccgccgcaaatccgtttccgcccacgatgctttgggcagcaacctgattgtgcagaccaaagaccataccgtccgccgcgtgttgccgttggaaaacgaagcgattaacgaatgctggctgtctgaccgcgaccgtttcgcctacgaaggcctgtatcacgaaagccgtctgaaaaacccgaaaatcaaacagggcggcgagtggatggacgtggattggaaaaccgcgttggaatatgtccgcagcgcgattgaatgtatcgccaaagacggcaagcaaaaccaagtcggcgtttgggcgaacccgatgaatacggttgaagaactgtatctggcgaagaaactcgccgacggcttgggtgttaaaaactttgcaacccgtttgcgccaacaagacaaacgtctttcagacggccttaaaggtgcgcaatggttgggacaaagcattgaatctttggctgacaacgatgccgtattggtagtcggtgcgaacttgcgcaaagaacagccgctcctgactgcccgcctgcgccgcgccgccaaagaccgtatggcattgagcgtattggccagcagtaaagaagaattgtttatgccgcttctgtctcaagaagccgcacatcccgacgagtgggcaggccgtctgaaaaacctgtctgtcaatgcggaacacgccgttaccgccagcctgaaaaatgctgaaaaagcagcggtgattttgggcgcggaagtgcaaaaccatcctgattacgccgcggtttacgccgccgcgcaagagctggctgacgcgaccggcgcagtgctgggcattttgccgcaagccgccaacagcgttggtgcggatgtcttgaatgtaaactccggcaagagcgttgtcgaaatggtaaacgcgccgaaacaggcagtcttgctgctcaacgttgagcctgaaatcgatacggcggacggtgcaaaagccgtagccgcgttgaaacaggcaaaaagcgtgatggcgtttacgccgtttgtcagcgaaacgctgctggacgtgtgcgacgtgttgttgccgattgcaccgtttaccgaaacctcaggcagcttcatcaatatggaaggccgtctgcaatccttccacggcgtggtacaaggcttcggcgattcgcgtccgctgtggaaagtgttgcgcgtattgggcaacctgtttgacctgaaaggttttgaataccacgataccgctgcgattttgaaagacgcgctggatgtggaaagcctgccgtccaaactggacaaccgcaacgcatggacaggggagggcgttcagacgacctcagaccgcctcgtccgtgtcggcggcgtcggtatttatcacaccgattctatcgtgcgccgttccgcaccgttgcaagaaaccagccatgccgccgtgcctgctgcgcgtgtaaatccaaatacattggcacgcttgggcctgcaagacggacaaaccgctgtcgccaaacaaaacggcgcaagcgtatcggttgccgtcaaagccgatgccggactgcctgaaaacgtggtgcatctgccgctgcataccgaaaatgccgcgctgggtgcgttgatggacactattgaactggcgggagcttgattatgcaggaatggttccaaaacctctttgccgcaacgctcggtctgggcgatttgggtattactgtaggcttggtggtatccgtcatcgtcaaaattgtgattatcctgattccgctgattctgaccgtcgcctacctgacttatttcgaacgtaaagtcatcggcttcatgcagcttcgcgtcggtccgaacgtaaccggcccgtggggtctgattcagccgtttgccgacgtgttcaaactcttgtttaaagaagtaacccgtccgaagctgtcaaacaaagccctgttctatatcggcccgattatgtcgcttgccccgtctttcgcggcgtgggcagtgattccgttcaatgaagaatgggtgctgaccaacatcaatatcggtcttttgtacatcctgatgattacctcgctgtcggtttacggcgtgatcatcgcgggctgggcttccaactccaaatattcgttcttgggcgcaatgcgtgcttccgcgcaaagcatttcctacgaaatcgccatgagtgccgcgctggtgtgcgtcgtgatggtgtcgggcagcatgaacttctccgacatcgttgccgcgcaggcaaaaggcatcgcaggcggttcggtattctcttggaactggctgccgctcttccccatcttcatcgtctatctgatttccgccgttgccgaaaccaaccgcgcaccgtttgacgtggcagagggcgagtctgaaatcgttgccggtcaccacgtcgaatattccggcttcgcattcgcgctgttcttccttgccgaatacattttcatgattctgattgccgcgctgacatcgttgatgttcctcggcggctggctgtctcccttcccgcaaagctggggcattgtcggtacgccttccgcattttggatgttcgcgaaaatggcggcggttctgtactggtatctgtggatacgcgccaccttcccacgctaccgttacgaccaaatcatgcgcttgggctggaaagtgctgattccgatcggcttcgcctacatcgtgattttgggcgtgtggatgatttcaccgctgaatttgtggaaataagtttcagacggcatcttgaggccgtctgaacaaagcgattttgaatacctaacgaaatccctgttttgagggaacataatatggctaacttagtaaaaacctttctgcttggcgaattggtaaaaggtatgggcgtaacgctcaaaaactttttcgcccgcaaagacacaatttatttccccgaagagaaaacgccgcaatccgtgcgtttccgcggtctgcacgcgcagcggcggtatccgaacggcgaagagcggtgtatcgcgtgtaagttgtgtgaggcagtgtgtccggcaatggcgattaacatcgaatcggaagaacgtgaagacggtacgcgccgcaccaagcgttacgacatcgacctgaccaagtgcatcttctgcggtttctgcgaagaggcatgcccgactgatgcgattgtggaaacccatatttttgaataccacggcgagaaaaaaggcgacttgcacatgaccaagccgattcttttggccattggcgacaaatacgaagctgaaatcgccaaacgcaaagccgctgacgcgccgtatcgttaatgctttggggcttcttggaaggttttaaatatggaaggactgattaatgcattgaaatatttagccgaacatgagccaatagataattttgaagaaattagaactagaaatagtccgattgagttgccaagtggattaagtaattttgaacaaaatatttttttaaaagaaaatttatccccaaaattacaaaatgatgatagcttgaagacgcattattggattatccgtgaatggggtgggattaaaagttttaaacaatctgctgaaaatagccagcttattcgtcaatttttatcggaacttaattcgggaaaattgagtagtggtttgttgaaaatttcatcattatctaaattggcttcttttatagattgtgagcgattcgccatttatgattcacgcgctattttttcgttgaattggttgttgtttaaatttacaaatgcagatttgttttttcagccacaaggtagaaatagggaactagaaatccgaaatatgaacgtattgtttcatttttctgatatcaaaccgaattatcggaaaccagacgtttcgtttcatcaatattgtgggttgttacaagatttggcgaaacaagtttatggtaaacaagcaaaaccgtatcacatagaaatgttgttattcaaaattgcgacaacgtggatttgtgcggatatggatcaactgattaagtttgattgtttgcgtaaccaggattttcagactgcttgaaaccatatttttgattaataaagaaagcatagactatgactttccaactgattttattttatatttttgcagtgataattctttatggcgcgctcaaaaccgtcaccgctaaaaaccctgttcacgccgctttgcatctggtgctgaccttctgcgtgagcgcgatgctttggatgctgatgcaggctgagtttttgggcgtgacgctggtggtggtttacgtcggcgccgtgatggtgttgttcctgttcgtcgtgatgatgttgaacatcgacattgaagaaatgcgtgccggtttctggcggcacgcgcctgttgccggtgtggtcggcacattgttggcggttgcgctgatcctgattctggtcaacccgaaaaccgaccttgccgcatttggtctgatgaaagacattcctgccgattacaacaatatccgcgatttgggcagccgtatttataccgactatctgttgccgtttgaattggcggcggtattgctgttgttgggtatggtggcggcgattgcgctggttcaccgtaaaacggttaatccgaaacgcatggatcctgccgaccaagtcaaagtacgcgccgaccagggccgtatgcgtctggtgaaaatggaagcggtcaaaccgcaagtcgaatctgccgaagaaagcgaagtttcagacgacctcaagccgaaagaggagggcaaagcatgattaccttgacgcattatttggtattgggtgcgctcctgttcggtatcagcgcaatgggtatctttatgaaccgcaaaaacgtgctggtattgctgatgtcgatcgagctgatgcttttggcggtgaacttcaactttatcgccttctcgcaacatttgggcgatactgccggacaaattttcgtattcttcgtattgaccgttgccgctgccgaatctgccatcggtttggcgattatggtgctggtgtaccgcaaccgacaaacaatcaacgttgccgatttggacgagttgaaagggtaaaggtaggttgggtcgagacctgacaagacaccgatgccgtctgaaaacccgataggaaaaacgatgaaatccatagacgaacaaagcctgcataatgcccgccgcctgtttgaaagcggcgacatcgaccgtatcgaagtcggtaccaccgcgggcctgcaacagattcaccgttacctgttcggcggcttatatgattttgcgggtcaaatcagggaagacaacatttccaaaggcggttttcgttttgccaacgccatgtatttaaaagaggctttggttaaaatcgagcagatgcccgagcggacttttgaagaaatcatcgccaaatatgttgaaatgaacattgcccatccgtttttggagggtaatggcagaagtacccgcatctggctggatttggtgctgaaaaaaaacctgaaaaaagtcgtgaactggcaaaatgtaagtaaaaccctgtatttgcaggcgatggaacgcagccccgtcaacgatttagaactgcgctttctgttaaaggacaacctgactgacgatgtggacaaccgtgaaatcatctttaaaggtatcgagcagtcgtattattacgaagggtatgaaaaaggctgagggtcgtctgaaaagcgatttcagactgtttcagacgacctgattcggtaggtgatcagacgggagcggatgagaaaagaaattctgggtaagaataatccggtctgaaatattggaagaagaatgatggataaaaatcagttagaacaagaatttcataaagccatgttaaatatttatcaggaggctttgaatttgccgcaaccttacaaggcgacacgatttttacaaattgtaaatgaatttggtggtaaagaggcggcggataaattattgagtacgggggaaaagaagactcagaccggttttacagagctgattttgagtggtggcggagtccacgccttgaaatacagtatggaatatctggtgttacaaaagccgtggtgtgatttatttactgaagagcaattagctgtggcacgcaaacgattggagcgtgttggatttgtttttccgaagtaattttgtacgaaacaaacatagatttttaaatcaatcggattcaatcaaatgaacgatatgactttatatttgataattgcccttgttccgttggcaggctcgctgattgcgggtttgttcggcaacaaaatcggacgtgccggtgcgcatacggttacgatactcggcgtggcggtgtccgccgtgctgtcggcttatgtgctgtggggctttattgacggcagccgcgccaagtttgacgagaatgtctatacctggctgacaatgggcggcttggatttctccgtcggcttcttggtcgatacgatgacggcgatgatgatggtcgtggtaacgggcgtgtcgttgatggtgcatatctataccatcggctatatgcacgatgaaaaagtcggctaccaacgcttcttcagctatatttctttgtttacattcagtatgttgatgctgattatgagcaacaacttcattcagctcttcttcggttgggaagcggtgggcttggtgtcgtatctcttgatcggtttctatttcaaacgcccgagcgcgacatttgccaacctgaaagcctttttgatcaaccgtgtcggcgacttcggctttttgctcggtatcggcttggtgcttgcctatttcggcggcagcttgcgctatcaagatgtattcgcttatctgcccaacgtgcaaaatgccactatccaactgttccccggtgtggaatggtctttgattactgtaacctgtttgctcctgtttgtcggtgcgatgggtaaatcggcacaattcccgctgcacgtctggctgcctgattcgatggaaggcccgaccccgatttctgcattgattcacgccgcaaccatggttaccgccggtttgtttatggtgtcgcgtatgtcgccgatttatgaaatgagcagcaccgcgctgtcggtcattatggtgatcggcgcgattaccgccctgtttatgggctttttgggcgtgattcaaaacgacatcaaacgtgtagttgcgtattccaccctgtcgcaattgggctacatgaccgtggctctgggcgcgtctgcctattccgtggcgatgttccatgtgatgacccacgccttctttaaagccctgttgttcttggcggcaggcagcgcgattatcggtatgcaccacgaccaagacatgcgccatatgggcaatctgaaaaaatatatgccggttacttggctgaccatgctgatcggtaacttgtcgctgattggtacgccgttcttctccggcttctactccaaagattcgattatcgaagcggcgaaatacagcacactgccgggcagcggctttgcctattttgccgtcctcgccagcgtgtttgttaccgcgttttacgcgttccgccaatactttatggtgttccacggcgaagagaaatggcgcagcctgcccgaacaccattcagacggccacggcgaagaacatcacggtttgggtaaaaacgacaatccgcacgaaagcccgttggtggttaccctgcctttgattttgcttgccgttccgtccgtcatcatcggctacatcgccatcgaacccatgctctacggcgatttcttcaaagacgtgattttcgtcaacgccgacgcgcatccgactatacacatcatgaaggaagagttccacggcgcattggcaatggtgtcccacagcctgcattcgcccgtactctaccttgctatcgcaggcgtgttgagcgcatggcttttgtacgtcaaactgccgcacctgccagcgaaaattgcacagacgttccgtccgatttacgttttgtttgaaaacaaatactacctcgacgccctgtatttcaacgttttcgccaaaggcacacgcgcattgggcactttcttctggaaagtcggcgataccgccattattgacaacggtattgtcaacggctctgccaaactggtcggcgcgattgccgcgcaagtgcgtaaagcccaaaccggctttatctacacctacgccgccgctatggtgttcggcgtattggtcttgctcggcatgaccttctggggattgttccgataagaataaggtttcagacggccttaaaccttcaggccgtctgaaacgaagaaatatccacataaacacatttttattttaaccacaggttaaccactatgttttccaactacctactcagcttggcaatatggatacccatcgccgcaggcgtgctggttttggcaacggggtcggacagccgtgcgccgtttgcccgcgtgctcgccttcatgggtgcgcttgccggtttcttggtaacactgcccctgtttaccggtttcgaccgtttgagcggcggctatcaatttaccgagttccacgagtggattccgcttctgaaaatcaactacgcattgggcgtggacggtatttcagtgctctttatcatcttgaatgcgtttattacgctgttggtggtattggcaggttgggaagtcattcagaaacgtccggcgcagtatatggcggcattcctgatcatgtcgggtttgattaacggcgcgtttgccgcgcaggatgcgattctgttttatgtgttcttcgagggtatgctgattccgctgtacctgattatcggtgtatggggcggtccgcgccgcgtctatgcgtcggtcaagctcttcctctacacgctgatgggttcgctcctgatgctggttgcgatggtttacctttattatcaaacaggcagcttctctattgtcgatttccaaaacatcgaacagattccgttgggcgtacaacagcttttgtttgtggcgttcttcctgtcatttgccgtaaaagtgccgatgttccctgtgcacacttggttgccggatgcccacgttgaagcgccgaccggcggttcgatggtgttggcggccattacgctgaaactgggtgcgtatggtttcttgcgctttatcctgccgattatgccggatgcggcacgctattttgcccccgtgatcatcgtattaagtctgattgccgtgatttatatcggtatggtggctttggtgcaaaccgatatgaaaaaactggtggcgtattcgtccatcagccatatgggttttgtaacgcttgggatgtttttgtttgttgacgggcagttggacgactgggcattgaaaggtgcaatcattcaaatgatttcgcacggtttcgtgtctgccgcgatgtttatgtgtatcggcgtgatgtacgaccgcctgcacacgcgcaatattgctgattatggcggcgtggtcaatgtgatgcccaagtttgcggcgtttatgatgctgttcggtatggcgaacgcgggtttgcctgcgacttccggcttcgtgggcgagtttatggtgattatgggcgcggtcaaagtgaatttctgggtcggcgcgttggccgccatgaccctgatttacggtgcatcttataccctgtggatgtacaaacgcgttatttttggtgcgatccacaatccgcacgttgccgaaatgcaagacatcaattgccgcgaatttgcgattttggcaattttggcggtggctgttttgggtatgggcctgtatccgaacgcatttatcgaagtggtgcatcaggcggcaaacgatttgattgcccatgtggcacaaagcaagatttgaggtgtgtaaatgaactggtctgatttgaatttaatgcccgccatgcccgaaatcgtgctgctgtcgctgctggtgttattgttgctggcggacttgtgggtcagtgatgacaaacgcccgtggacgcattacggcgcgttggcaacggtggcggttacggctgtggtgcagttggcggtgtgggaacagggcagcacgtcttcgttcaacgggatgtatattgcagacggtatgtcgcgtttggcaaaaatggttttatatgccttgacctttgccctgtttgtctatgccaagccctacaaccaagtgcgcggtatttttaaaggcgagttttacaccctgtcattgtttgccctgttgggtatgagtgtgatggtgagcgcggggcattttttaactgcctatatcggtttggaactcttgtcgcttgccctttacgccctgattgccctgcgccgcgattccggctttgccgccgaagccgccttgaaatattttgttttgggcgcgctggcatccggcctgctgctctacggtatttctatggtttacggcgcaaccggttcgctggaatttgccggcgtgctcgcctcttccttcaatgaagaagccaacgaatggctgttgaaactgggtttggtgtttatcgtcgtcgccgtcgcgttcaaactcggtgcggtgccgttccatatgtgggtgcccgacgtgtatcacggcgcgcccacttctgttaccgccttggtcggcactgccccgaaaatcgccgccgtcgttttcactttccgcatcctcgttaccgggctgggaaccgtgcatcatgactggtctctgatgtttgccctgcttgccgccgcctcgctgctggtcggcaaccttgccgccatcatgcagaccaatatcaaacgtatgttcgcctattccaccgtatcgcatatgggtttcatcctgttggcgtttatggcgggcgcggtcggctttgcggcgggcctctattacgccattacctacgcgctgatggcggcggcagggttcggagtgttgatggtgttgtcggacggggacaacgagtgcgaaaacatcagcgatttggcagggttgaaccaacaccgcgtatggcttgcctttttgatgctgctggttatgttctctatggcgggcattccgccgctgatgggtttttacgccaaattcggcgtgattatggcactcttgaaacaaggccatgtttggttgtctgtatttgccgtcatcatgtcgctgattggtgcgttctactacctgcgcgtggtcaaagtcatctacttcgatgtgcctgatcatgaccagccggtcggcagcaactatgccgccaaatttgttctgacggtcaatgccttcttgctgctcctgtggggcatcatgccgcaaaccgttatcgactggtgcgccaaggcgttggagaacacgctgtaagccgccgcaacggcagccgtgtcagaggctgccgtttttgttaagatatgccgttccgcaacgcggttcagacggcatcgccgccgacaacgcctaaacagaaagcccaccatgaccgcatccatgtacatccttttggtcttggcactcatctttgccaacgcccccttcctcacgaccagactgttcggcgtggccgcactcaagcgcaaacatttcggacaccacatgatcgagctggcggcaggtttcgcgctgaccgccgttcttgcctacatcctcgaatcccgtgcaggatcggtacacgatcagggttgggagttttatgccacagtcgtctgcctgtacctgatttttgcgtttccatgttttgtgtggcggtatttttggcacacgcgcaacagggaatagacaagcataggaatgccgtctgaaaccctttcagacggcatttgtttcattcaagtgcaggccggcatcgctgtgccggcacgtttcagccggcgatatacgccggttttaatatttgcgggcgactgcaaattctgccaactgccgcaggcgcagggctttgtcgccgaagggttcgagcagcgcgaccgcttcggcaaccagtttgtgtgcgtatgagcgcgccgcttccaagcccatcagtttcacataagtcggcttgtcgttgtctgcgtctttgcccgccgttttgcccaaagtcgccgtgtccgcttcacaatccaacacatcgtcaatgacttggaacgccagccccagttttgccgcgtaagcgtccaatacggaaagttccgcatctgacagatcaggacacgccgtcgcccccaataaaaccgccgcacggattagcgcacccgttttcaggctgtgcatctgttccaaatcggcttgaaccatttgtttgccgacattcgccaaatcgattgcctgaccgcccgccatacccctgctgccgcccgctttcgccaacaccgacaacattgccaactggcgtgcggcgggcagttctgtcggacggctcaacacgtcaaatgcctgtgtctgcaaagcgtcgccggtcagaagggcggtcgcttcgccatatttgatgtggcaagtcggtttgccgcgccgcaggctgtcgttgtccatcgccggcatatcgtcgtgaaccaaagaatagacgtggatcatttcgattgccgccattgcctgttctactgcttcatgcacggcttcgcctaattccgaagctgccagaaccagcatcggccgcagacgcttaccgccgtccaaagccgcataacgcatcgcttcgtgcagtgtgtgcggtatttccccctcagacggtaaaaaccgttcaagcagcagctctgtttgcgcctgcgccctctgttgccacgttttcaaatcattcgtcggattcaaggtttaactccttcagcccgtctgtgtctaaaacctgtagcttttgttcgacttgtgccagtttggtttggcagtacctgaccagttcgttgccttcctgataggcggcaagcgcgtcttccaagggcatttcgccctgcatagactgcgtcagcgattcgaggcgcgacaaggcttcttcaaacgatttcggggcgtttttcttcatcgtatttccttttcggttgaaaccccgccctttagggcggcaggatcagactttatttgggaggggtgtaaccctttccaaatcagggcaatacatagggcggtgctttatgtgccgtcctgtgtgttggaacatagtttcggatgttccggtaaaaagcggattgtagcatttttgaaaaacggatgccgtctgaaacccgaatccggcttcagacggcattttttccgcccaggcggcaaggcgttacccgggcagttcgtcggtgatgccctgcaaaaaggcgaggcgttcggggcttgccgccccggtttgcgcggcggctttgaaggcgcagccgggttcggcgcggtgggtgcagttgtggaagcggcattgcccgacaaggtggcggaaatcggggaaatagcgcggcaaatcggcggcttggaggtggtgtaaaccaaattcttgcaaacccggggagtcgatgagttgggtttcgccgttcaaatcataaagccgggcgtgggtggtggtgtgttttcccgagtcgagtgcggcggaaatgtcgccggtgcgggcggtttggctgcccaaaagggcgttggtcagggtggatttgcccataccgctctgcccgagcaggatgttgctgtgcccttgcagggcggggcgcaggctgccggcgttttccagtgcgcgggtttcgatgacgggataacccagcgtttcgtagaatttgagtttttcgcgccaaagggcggtttcgggcaggtcggctttgttcaggacgatgacggcttcaataccggcggcttcggcggcaagcagggcgcgttgcagcagccgcacgctcggactcgggacggcggcggttacgatgaggagttgggtaacgttggcggcgatgagtttggttttccacgcgtcttggcggtagagcaggctttggcgcggtaaaaaatcttcaatcacaacttgttcggcgttgacggggctgatgcggacgcggtcgccgcaggcgaaatcgacgcgttttttgcgggtgctggcttcgtaggttgtgccgtcgggcgtgcggacaatgtagcggcggccgtagctggcggtaatttgggcggtgtcgttcatggtttctttggggttgggtgtgggaatgccgtctgaaaacgggtgttcggacggcatcggttcagtcgtgctgccactcgacgtgttcgttgaggaagccgccgctctggtgcgcccagagtttggcgtaaagcccgcgtttttcgaggagttcggcgtgtgtgccttcttcgatgatgcggcctttgtcgaggacgacgagcctgtccattgcggcgatggtggagaggcggtgggcgatggcgatgacggttttgccgtccatcattttgtcgaggctttcttggatggcggcttcgacttcggaatcgagcgcgctggtggcttcgtccaaaagaagaatcggtgcgtctttgagcatcacgcgggcgatggcgatgcgctggcgttgcccgccggagagtttcacgccgcgttcgccgacgtgtgcgtcgtagccgcgccgccctttggcatcggaaaggtcggggatgaagccggcggcttcggcgcgttcggcggcagaaaccatttcggcatcggtcgcgtcggggcggccgtaaataatgttgtcgcgcacggaacggtgcagcagcgaggtatcttgcgtgaccaaaccgatttgggcgcgtaaagattcttgggtaacgccgcttatgtcctgcccgtcgatcgaaaccgtgccgctttgcggttcgtagaagcgcaaaagcaggttgacgatggtggatttgcccgcgccgctgcgtccgatcaagccgactttttcgcccgggcggatggtgaggttgaagccgttgagcagcggtttgcccgcttcgtaggagaaatcgacgtgttcaaatttgattgcgccttgcggcacgttcagcggcagtgcccggggcttgtcgaggatggtgtgcggtttggacagggttgccatgccgtcgccgacggtgccgatgttttcaaacagccgcgcggattcccacataatgtattgcgacaaaccgttgacgcgcaacgccatggcggtggctgtagcaaccgcgcccacgccgacctgcccgttgtgccagagccagatgcccagtgcggcggtggagagggtcagggaggtgttgacgatgaagctgcacgaatgcagcagcgtcgccagccgcatttgggcgcgcaccgtaaccataaattcttccatcgactgcttggcataggcggcttcacgcgcgccgtgggagaagagtttgacggtggcgatattggaataggcatcggtaatgcggccggtcatcagcgagcgggcatccgcctgccatgcggcggtttgccccaatttgggaatcagcaggcgcatcaccgaagcgaaaccgacaatccagccgataaagggcagcagcagccatgagtcgagcgaggcgagaatcacgccggaggtaatgaaatacaccgacacataaacgaccatatcggcaaccgtcatcaccgcgtcgcgcaacgccagcgcggtctgcatgactttggcggacacgcgtccggcaaattcgtcctgataaaaaccgaggctttggttcagcatcaggcggtggaagttccagcgcaggcgcatggggaacacgccctgaagggtttgcaggcgcacgttggacgcggcaaacgcccacgcaaccgaaaataccatcatcgccgccattgccgccagttcccaacttttttcggcaaacagttcggcgggcgcgtatttgccgagccactccacgattttgcccataaattgaaaaaccagggcttccataatgccgatgccggcggtcagcgcagccagggcggctatccatttccgcacgccggccatgctgctccagacaaaccgccacaagcctttttctggcgttttcggggcggcttcgggataagggtcgattcgggactcgaaccaggaaaatattttgttcaacattgttttcgatttcggtaaaacagtttcagacggcatcaaacacaatgccgtctgaaaggaaggacaataacgccattttacgggaaaagccgtcgggaagacagcgcgaggcggaaacgcagggtttcgtcagggcaaacgccgcgccgccttcaggcggcattatttcagcaggtttttcaaagcaaggcgcacgccttcgcccacgtccgtcccctccggaacgcctttgaccgccgcttttgcttcgcgttcgctgtaacccagcgcaagcagcgtgctgacgatgtcttccgtttcgtcggcggcgggtgcggcggcaaacagcccgtccgttaccgtatgcgcgaccagcttgccgcgcagttccaaaaccatacgttcggcggtttttttgccgattcccggggcggaggagaggcgtttgacatcttcttctgcaaccgcccgcgccagttcgtcggcagtcattgccgacaaaatgcccaaagccgttttcgcgccgatgccgccgaccttgatcagttggcggaaggtcttgcgttcttccgcagtggcaaaaccaaataaaagatgtgcgtcttcccgaatgataagctgggtaaacagttgtacgctttcacccacgggcggcaggttgtagaaggtctgcatcgatacgtcggcctcatagccgacaccgttgacatcgatgacgatttgcggagggtttttttcaaccagtttgccggtcagtctgctgatcatgtgtgccgaatcctgaagtgtcgggtgcaaaatgccgtctgaaaccggtttgggcttcagacggcacggattgtatcaaattcagtcgtcgcggcgggaggaaatcacgcggccggtacgggcatcgacaacgactttgtattcctgtccgtttttgacgatttcgacatcatagtgcggacggccgttgtcgtgttcgagatcgatgtcggtgattttgccgccgacacgcgccaacgctgctttttcggcttgggcgcggctgatgattttgtcttgtttgttgtgttggtgtgcggcgtgtccgtggtcgtcatcgccgtgtccgtcgtggtgggcgagcgcgggggcggaaatgctcagcagtgcggttgcggcggaggtcaagagaaggtgtttgatgttcatattttgcctttgtaaatcgtgggttggaaaatgtggatattaataaggtatcaaataaccgtcagccggcggtcaataccgcccgaaccataccgcgcgcctgagcttcggcttcggcggcgcgttcctgcgaggtaaacggtcccattttgacgacgtattcgtaacggcgtttttcaaccgagaggttcgtacccgatgacgaaacggcgaagttttgggcggcttggttcagataggcttgtgcttcgtgttccgtaccgaaagatttcaagtcgataaagatgtctttgttttcggcaaccggtgcggattggcccgggacgatttgttcgattttgacgtgtgccgtcccttggttgacaaagcccaatttttgcgcggcggctttggatacgtcgatgatgcggttgccgtggaaggggccgcggtcgttgacgcggacgatgacgcttttgccgtttttggtattggttacgcgcacatagctggggatgggcagggttttgtgggcggcggtaaaggcgttcatatcgtatcgttctccgccggaagttttgcgcccgtgaaacctgccgccgtaccacgaggcgttgccggtttgcgtgaattcggcgacttggtttttcggcgtgtagcgttttccggcgactttgtagctgcggttggcggaggcgtgcagtttttctgccttgaccactgcgtcggcggatgccgtctgaagggagtgtgtgccgaatgcggcggtgagaaggaaaagggtttttcgggttaaagtcaaaacgtgttccgttcttgagttgaagacgaatgggcatcatgcccgccggatacgttccgaaccgccgtacagtgcggacggcggttcggaatgtgtccggataggttttcagacggcatgaacctgcgttcaaacgccgcctgcgtaaccgtgttgccgccacgcttcaaagagaatcacggcgacggtgttggaaaggttcatactccggctgccgggctgcatcggcaggcggattttttgcgcggcgggcaggctgtcgaggatgtcggcaggcagtccgcgcgtttccggcccgaacagtaaaacgtcgcctttttgaaacgcggtttcatcggggcgcgccgtgcctttggtggtcagggcgaaaatgcgcctgcctgcgagtgccttgaggcagtcgtcgaagttttcgtgcaccgtcaggctggcgaactcgtggtagtcgagcccggcgcgtttcattttggcggaatccaatgggaagccgagcggtttgacaaggtgcaaatccgcgccggtattggcgcacaggcggatgatgttgcccgtgttcggcgggatttccggctggtataaaacgatggtaaacataaatatcaatcacttataggcgcgtaaccttgccacaaggcggatggggtgtcaaaaaatttagttattttttcattggcgtgcgtgccagcgtccagcagcagattcggtttgcgcccgattttttcagcgtctttgccaattcgtccagcgtcgcgccggtggtaaagacatcgtcgattaacagaatattacagttttccggtatcggtgtgcggatttcaaaggcgtttttgatgtttcgccgccgttcgccgcctttgagcgtgctttgcggcgggcggtggtgtcggaaaacggtgtgtcggggcagtatctgccagccgtagcgttgtgccagcagcccgacgatgctttcactttggttgaacccgcgttgcagcagccgctccctgcttagcggtacgggcaggacgaaatcgaaacattcgtctgcaagccggtcgggcggattctgcatcatcaggtctgccagcggctgcaccatgctcaaatcagccaagtgcttcagcgcgtgtatcatattgctgacgggcggttcgtaatgcagcgaagcccacatccggtcgaatgcgggcggttttttctgacagccgccgcacaccgatccgccttggatgtgtctgaaacacagggggcagctgtttgccgcgtcggtgcggtatgccgccaaatcgtcgcggcagccggcgcagatgccgtctgaaacgccagacgaaccgtggcataatacgcaacgcctgatagtgggcgcgtctgcgatgcgccgccaacgagagagaaaatccatgcctgatgccgtcaaaaaagtttacctgatacacggttggggggcgaaccgccacatgttcgacgatttgatgccgcgcctgcctgcaacgtggccggtgtccgccgtcgatttgcccggacacggggacgctccgtttgtccgacctttcgacattgcggctgcggccgacggcattgccgctcaaattgacgctccggccgacattctcggctggtcgctcggcggattggtcgcgctgtatctggcggcgcgccatcccgacaaagtccgttcgctctgcctgacggcgagtttcgcacggctgacggctgacgaagactatcccgaagggcttgccgcgcctgcattgggcaaaatggtcggtgcgttccgttcggattatgccaaacatatcaaacagtttctacaattacagcttctgcacacgcctgatgcggacggaatcataggcagaatcctgcccgatttggcgcgctgcggcacgcctcaagccttgcaggaggcgttggacgcggcggaaagggcggatgcgcggcatttgttggacaagatagatgttccggtactgctggtgttcggcggcaaagacgcgattacgccgccgcgtatgggtgaatatctgcaccgccgtttgaagggcagcaggttggttgtgatggaaaaggcggcgcatgcgccgtttttgagccatgcggaagcgtttgccgcgctgtaccgcgactttgttgaagggggtttgagatgaaccatcaggacgcacgctggcaggttcaccgccatcttgccgaacataccgaccaacggctgacactcgtccgcaacgcgcccaagcatatcctgcttgccggtgcggatgcggacatcagccgcagcctgctggcgaaacgctatccgcaggcggtatttgaagaatacgattcccgtgcggattttttggcggctgccgctgccgcccgcaaaggcggtttttggcaaaggtttacgggtaagggcgtggtgcaacactgccaatccccgatcgcgccgctgcccgaagcgtgtgccgatatgttgtggtcgaatctcggactgttggcggcggaacaaatccttcctgtgctgcacaactgggcgcgcgccttgaagacggacgggctgctgttttttacctgcttcgggcgagataccttggcggaactgaaatgccgtctgaaagaaaacggcattgaaagccgcagcgcgcttttccctgatatgcacgacttgggcgatatgcttgctgaaaacggcttttacgaccccgttaccgatacggcgaagctggtgttggattacaaaaaggcggaaacgttttgggcggatatggacacgctgggcgtttggcgggcgatggcgtggaacgatgaaaacgccgcgcgttcgtgtgtcgggacaatatttgagcgggaaggcggtttgggcattacgctggaaacggtgtacggacacgccgtgaaaaaactgatgctgccgcaaggggagaacgtggtgcagttttttccgaagagatgatgtgcagatgccgtctgaagccgtttccaggtttcagacggcatttgtctgtgaaaaccgacagaaataaaggaaatgccgatgtatagtgaattaaatttaaaccagtacagcgttgcctcgccttagctcaaagagaacgattctctaaggtgctgaagcaccaagtgaatcggttccgtactatttgtactgtctgcggcttcgccgccttgtcctgatttttgttaatccactatatgctgatgccggagacgtatattgcgtctataacatcagactgaagcagtacactgcctgccaggttacccgagttgaagaacacggtggcaaaaaaaacacatgcgaccctgctggctttggactggcagggcaacaaaccgcttggggcggaggagctggcggatttgaaatcgctttacaaagacttaaagaataatattggaaatattgtatgaacaaaaaattaaactatatttttatgttggactgtttagggttggtgatattgtttacttgtataatagctacttttgaaagagattatggatttaaaatttttactaattctaagagacctgaattttattattggattggaatgttttattatggaattatttcttgctggtttgattatcaattaatttcaacaaaggcgaattcgtataaaagaaaagttaaacaatataaaattttttcagtaatattttcagttttgatatttatttctactatagtaaaactttaaattttggagcaaaaatttatgagcgattcaattgaatatgtattgggaacgcggtctgcacatgtataaggcaagtgccgtcgtgccgacgggatatgtacgggttgggaataccgcgccgctggtcggcgaagacacgcaacggtatgcctctttttggggcgacggctacgacgtgtaccgtcagttgagatggcagcagatacccgaaaaacagagaaaggcattcaaaaaagccgccaaaagcaaaaagaccgtgatgtttgccggacgggaatacggcatatccaaacagaatttgagcgatgtttgggatgattttgaagacgcgatggaactgaaggcgtttccctgcctgtcttcgctgtttctgaccaaatggcataaaaatctatatgatagtggattaacaaaaaccagtacggcgttgcctcgccttagctcaaagagaacgattctctaaggtgctgaagcaccaagtgaatcggttccgtactatttgtactgtctgcggctcgccgccttgtcctgatttttgttaatccactataaaaacaggaatttttaaatagaggcaatgccgtctgaaacttggtaacgggcttcagacggcatttcgttccaataccgccaacaccgccgcaccgtaacgtgcggctttttcttcgcctacgccgtatacggcggcaagctccgccaagccttccggctgtttggcggcaatggcgcgcagtgcggctttgctgagaatgcggtagggttcggactgttcgtgttttgccgtttcgccgcaccattggatcagggcgcgcatcaggcggcgtttgcgtttggcggtttcatcgatgccgtctgaaaacggacggcagacggcgaggatgtcccgtccgtatttggcggcgcgtacgctgcccaagccgtacacgccttcgaggtcggtttcggtttcgggcgtatcggcaagcatatcggcaaggctttcgtcggagaggacggcatgcagggcgcagttttccgcccttgcctgttcataccgccaggcttcgagtttttgacgcagttgttgttcgcgttcggtttgcggacggatgaccgcgtcgcggctgaagccggcggcgttgcggcagacttcgaggatgccgtgtccgaaacggtcgattttggcttcgcccaaaccgtagatgtcgtgcagaccgttgaggtcttgcggcattttttcgacaaggtcgcgcagggttttgtcgccgaaaatcatataggcggggatgccttcggcttctgcctgtttcatacgccaaacgcgcaatgcctgccacaggcgttcttcgcgttcggtacgcagccagttgtctttgagggtgcgggcggcgggcttgtcgcgcttgagcggacgcagcatcacttcggtttcgcctttgaggacttttttggcggcttcggtcagttgcaatgcctgatatcgggtaatgttgacggtgaggtagccgaggctgatacactggcggatgacgctgcgccattctttgtcggacaactccgtaccgatgccgaatgtggacagttgttcgtgccggttgccgcgtatccaatcgtcgcttttacctcgtaaaatgttggtgatgtaaccggcggcaaaacgttgtccggcgcggtacacgcagctgagtaatttttgcaccaacaccgtgccgtcaaaccgtacgggcggatgcaggcagttgtcgcaatggccgcagggttcggatgcttcgccgaaatgtttgagcagcagtacgcggcggcaggcggcggtttcgcagacggcaagcatggcatcgagtttttgcatttcgatttgcttttgcacctcgtcgctgttgccttcggcaatccgttcgcgcagcaacacccaatcgttcaaaccgtaacacagccagcttgcggccggcagcccgtcccgtccggcgcgccccgattcttgatagaaatgttcgacactctggggcatatcgagatgggcgacaaagcgcacgtcgggtttgtctatgcccatgccgaacgccacggtcgccaccacgataatattgtcttcatgcgtaaagcggcgttggttttcctcgcgtacgtccatgctcaaaccagcatgatacggaatcgcgtttaatccgttttcacgcaaaaactgcgccacatcttccacctttttgcggcttaggcaatacacaatgccgctttgccccgtcatttctttgcggatgaaatccagcaattgttttttgccgttgtttttttcgataacctgataataaatattcggacggtcaaagctggagacaaattcgggcgcatcgtccaagtgcagataatgcttgatgtcggcgcgcgtggcggcatcggcggtagcggtcagagcgatgcgcgggacgttcggatagcgttcggcaagcatgccgagctgttgatattcagggcggaaatcgtgtccccattggctgacgcaatgcgcctcatcaatggcaaacagactgacggtttgttggtcgagaaaacgcaaaaagcggtcggtaaccaagcgttccggcgcgacataaagcagcttcagacggccttgggcaagccggtcggcaatctcgcgcgcctcgtctgccgatgtgccgctgttgactgccgccgcttcgatgccggcggcgtgcaggtttgccacttggtcgttcatcagcgcaatcagcggcgatacgacaaccgccacgccttcgcgcatcagcgcgggaatctggtaacacaaagacttgccaccgcccgtcggcatcagcaccgtcaaactcccgccgcctgccaaagtattgatgacagcctcctgcctgccgcgaaattcgggataaccaaatacttcgtgcagaatctgtttggcggtcggtcggtgcatgatggttccgtgctcggtaagggtgttgatcggtcggcggcaatatgccgtctgaaatcgggatttagaatagtttgcccacttctgcttcaatatcgtcggcacgcataaacgtttcgccgatcaggaaggtatgcacgccgcgcgattgcataaattccacatccgccttgcctgtaatgccgctttcggtaacgacggttttgccttccagcgcgggcagcagcgacagggtttggtcgagggagacttcaaaagtcctcaggttgcggttgtttacgccccacagcggcgtggtcaggttgcggcatttttccaattcggtttcgtcgtgcagctcgagtaggacggtcatgcccaattcgtgcgccaccgcttcaaagcgttccaattgttcctgttccagtgctgcggcaatcagcaggacggcatccgccccccatgcgcgcgcctgataaacctggtattcgtcgatgatgaagtctttgcgcagcacgggcagcgatacggcttcgcgcgcctgtttgaggtattcgggcgaaccttggaaatagggttcgtcggtcagtacggacaaacacgccgctccggcgttttcataggcgcgtgcaatctcggcagggcggaagtccggacggattaaccctttgctcgggcttgcctttttgatttcggctatgacggcgggcaggtttaggcggtgtttgccgcgtatcgaatcgatgaagctgcggacgggcgcggcttctgcggcaagtgtgcggatgtgttcggcgttgacggcggctttttgagcggcaacttcctgtgctttggtggcaaggattttattgaggatgtcggtcatgtcgggttccgtattcgtctggggaaagggggaatattagcatcaaaccgttaacgcctgtttgtgcggaagctgtcgaaataggacaggacggtctgcggcagccattgcaggtgcagcctgccgccggtgctgctgacaaagccgacatgaccaccatatgccggctggaacagggtaacggcttcggatacttcgtctgcgcggggcagggcttcgggcggcaggaaggggtcgttgacggcattgagcaggagcagcggtttggcaacgtgtttgagcagcggtttgcaggaagtttggcggtagtagtcgtgccggtcggcaaagccgtgcagcggtgcggtgaagcggtcgtcaaactcgcccagtgttttgcaccctgcggcaaatgccgtctgaaaaccttggagcgattttgctttgggtatcagggtgcggaggaagtagcgcgtgtagagcagccgcgtgatgccgctgtcgaagcgtctgcctgccgcctctgcatcgacgggggcggagatgacggcagcggcttgcggcaatgcctttttgccctgttcgcccaaatattttgccagcgcgttgccgcccagcgatacgccgacggcgtatatttcacggtaacgcgcggcgaacgtgtccaaagtaaaggcgatttcggcggtatcgcccaagtggtagaacaccggagcggtgttggcaatgccgccgcagctgcggaaatggacgactacgccgtgccaaccccgatcgcgtaccgcaagcatcagttcgaccgcgtaatggctgcggctgcttccttccaaaccgtgaaacagcacgaccagcggcgcatcgggcgaaatgccgtctgaaaagtcgtaggcgactttggttttacccgtgctgtcgggaagcagctctcggcggtatgcgggcgcggggcgttgcaggaatttggcggcaatcgtgtcggcattgccgttgcggaggaaaaagggcgtgtccggcggtgttaaaatcataaggtatcggttttcttgttttcagacggcattgatgatgcggcagcccgtccggctggtgcggacgtgggggatgcgcgcccgaatataggcgtggaaaagcgtttgccgaaaaaggatatcggcatcggtcagttttccacgcgtttgaaatggcgcggacggaagcccaaagccgccagtgatgcgaaatacagtccgccgccgacggcaatcaggatgcagagctgccccgctttccgcattccgccggcgtgcgcccattcaaacggcaggtaagcctgcgctgcccacagtccgccgcacatcacggcgagcgagagcagcatttttgctaagaacgctgcccaacccttgccaggttggtaaataccgtgtctgcgcaacaggtaaaacaacaatccggcattgatacacgcgcccagaccgatggcaagcgaaagtccgacgtgtttcagtgggccgataaaggcaaggttcatcaactgcgtgcagatgagcgtgaagatggcgattttgacgggcgttttgatgttttgccgcgcatagaagccgggtgccaacactttaatcatgattaagccgattaaaccgaaagaataggcaatcagcgcgtgttgcgtcatctgcgcgtcaaacagcgtaaattcgcggtacataaacagcgtcgccaccagcgggaacgacaacaccgccagtccgaccgccgccggcagcgtcagcagcatgcacaggcgcaaaccccagtcgagcagggcggaaaactgttccgtatcttggtttgccgagtgtttggacaaagtcggcagcaaaatcgtaccgagtgccgcccccagcacgccgctgggcagctccatcatgcggtcggcgtaatacatccatgaaacgctgcccgattgcagataagacgcgaaaatcgtgttgatcaccaaagaaacctgcgccacgctcacgcccaaaatcgcaggcgccatctgtttcatcacgcggttgaccgccgcatctttgaaactcagtttgggcagtttcaaaaagcccagtttcgccagccagggcagttggaagccgagttgcaaaatgccgccgacaaagaccgcccacgccagcgcggtaacgggcggatcgaaatacggcacgaaaaacagcgcgaatacgataaacgacacgttcagaaacgtgggcgtaaacgccggaatgccgaacttatgataagaattgagtaccgagccgacaaatgaagacagggaaatcaataatatataaggaaacgtaatccgcagcaaatcgatggagagctgaaatttgtcggcatcttgggcaaaaccgggtgcggaaacataaatcacccaaggcgcggcaagtatgcccagcgcggtaacgataaccagtacaaacgacagcatccccgccacatggcggataaaagcctccgccgcctcttttgaacgcgtttccttgtattccgccaaaatcggcacaaacgcttgggcaaacgccccctccgcaaacacgcggcgaagcaggttgggcagtttgaacgcgacaaaaaacgcatccgtcgccatacccgcgccgaatgcccgcgcaatgaccgtatcgcgcacaaatcccaaaacgcgcgacaccatcgtcaggctgccgacttttgccaaagctcccagcatattcatcattgttcctcaacagtcgtacccgtctggggcaacggcgcgtattgtacgacagaaaccgcttcagacggcatcgggtttgatgccgtctgaagcggtttcctgaaacgaaaacgtccttttccggcggcaaactgtatcaatacgcggaaatgcaataaaatagccggattccgattgatttccaacatctgtttccaacatcacggagaaccgtatgaaatccagacaccttgccctcggcgttgccgccctgttcgcccttgccgcgtgcgacagcaaagtccaaaccagcgtccccgccgacagcgcgcctgccgcttcggcagccgccgccccggcagggctggtcgaagggcaaaactataccgtccttgccaacccgattccccaacagcaggcaggcaaagtcgaagtccttgagtttttcggctatttctgtccgcactgcgcccacctcgaacctgttttaagcaaacacgccaagtcttttaaagacgatatgtacctgcgtaccgaacacgtcgtctggcagaaagaaatgctgacgctggcacgcctcgccgccgccgtcgatatggctgccgccgacagcaaagatgtggcgaacagccatattttcgatgcgatggtcaaccaaaaaatcaagctgcaaaatccggaagtcctcaaaaaatggctgggcgaacaaaccgcctttgacggcaaaaaagtccttgccgcctacgagtcccccgaaagccaggcgcgcgccgacaaaatgcaggagctgaccgaaaccttccaaatcgacggtacgcccacggttatcgtcggcggtaaatataaagttgaatttgccgactgggagtccggtatgaacaccatcgaccttttggcggacaaagtacgcgaagaacaaaaagccgcgcagtaagcccgtttgaaaaatgccgtctgaaacttggttttcagacggcattttgattgggtttaaaacgtaaagcccgtttccagttcttcatcgccgaccagttcgaccaagagcgcgtagagcggggcgagttcggcataacggcgcgatacgcggcgcagatagtttaagaaacgcgggatttccggacggtatttgtctttgccgtcgcggtagtacaggcgtgcgaagatgcctgcaaccttcaagtgccgctgcacgcccatccattcgaaccagcggtaaaactcgtcaaacgcttcggggacgggcaagccggcagcccgcgccttttcccagtagcggataaccaagtccaagacaaattcttcttcccattcgataaaggcatcgcgcaacagcgacaccaaatcgtaggaaatcgggccgtaaagcgcgtcttggaagtctaaaacgcccggcctgccgcgcgtcagcatcaggttgcggacgataaagtcgcggtgcacatagactttgggctgcgccaacaggggcggcagcagcgtatcgacggtttgctgccaaagttggcgttgtttgaatgttaattcgcgccccaattcttttgcgacaaaccattccgggaacaggttgatttcgcgcaacatcgtttcacggtcatattcgggcaaaaccccttcacggctcgccttctgcaattcgaccaactcgccgattgcctccaaaagcagggctttgtgcgccgtttcgccctgttcctgaagcattgcggtcaaaaacgtcgtattgcccaagtcgttcaataccacaaaccccagatccgtgtccgcgtgcaatacctgcggcacattgaccatgtcaaacagtttctgcactttcaaataaggtgcgacactcatcttgtcgggcggtgcatccatgcagacgacactgctgccgtctgaaaacgttgcacggaaatagcggcggaaatcagcatccgccgccgcaaaagtcagatcgaagtcccgttcgggataaacggtctgaagccaatttttcagtttgatttgtcgttgcataacagtactaaagcatttcaggttacaataaacgctattctaactggcaaaccgacttgaggggcgattttggctcgtttattttcactcaaaccactggtgctggcattgggcctctgcttcggcacgcattgcgccgccgccgatgccgttgcggcggaggaaacggacaatccgaccgccggagaaagcgttcggagcgtgtccgaacccatacagcctaccagcctgagcctcggttcgacctgcctgttttgcagtaacgaaagcggcagccccgagagaaccgaagccgccgtccaaggcagcggcgaagcatccatccccgaagactatacgcgcattgttgccgacaggatggaaggacagtcgcaggtgcaggtgcgtgccgaaggcaacgtcgtcgtcgaacgcaaccggacgaccctcaataccgattgggcggattacgaccagtcgggcgacaccgttaccgcaggcgaccggttcgccctccaacaggacggtacgctgattcggggcgaaaccctgacctacaatctcgagcagcagaccggggaagcgcacaacgtccgcatggaaatcgaacaaggcggacggcggctgcaaagcgtcagccgcaccgccgaaatgttgggcgaagggcattacaaactgacggaaacccaattcaacacctgttccgccggcgatgccggctggtatgtcaaggcagcctctgtcgaagccgatcgggaaaaaggcataggcgttgccaaacacgccgccttcgtgttcggcggcgttcccattttctacaccccttgggcggacttcccgcttgacggcaaccgcaaaagcggcctgcttgttccctcactgtccgccggttcggacggcgtttccctttccgttccctattatttcaaccttgcccccaatctcgatgccacgttcgcgcccagcgtgatcggcgaacgcggcgcggtctttgacgggcaggtacgctacctgcggccggattatgccggccagtccgacctgacctggctgccgcacgacaagaaaagcggcaggaataaccgctatcaggcgaaatggcagcatcggcacgacatttccgacacgcttcaggcgggtgtcgatttcaaccaagtctccgacagcggctactaccgcgacttttacggcaacaaagaaatcgccggcaacgtcaacctcaaccgccgtgtatggctggattatggcggcagggcggcgggcggcagcctgaatgccggcctttcggttctgaaataccagacgctggcaaaccaaagcggctacaaagacaaaccgtatgccctcatgccgcgcctttcggtcgagtggcgtaaaaacaccggcagggcgcaaatcggcgtgtccgcacaatttacccgattcagccacgacagccgccaagacggcagccgcctggtcgtctatcccgacatcaaatgggatttcagcaacagctggggctatgtccgtcccaaactcggactgcacgccacctattacagcctcaaccgcttcggcagccaagaagcccgacgcgtcagccgcactctgcccattgtcaacatcgacagcggcgcaacttttgagcggaatacgcggatgttcggcggagaagtcctgcaaaccctcgagccgcgcctgttctacaactatattcctgccaaatcccaaaacgacctgcccaatttcgattcgtcggaaagcagcttcggctacgggcagctctttcgcgaaaacctctattacggcaacgacaggattaacaccgcaaacagcctttccgccgccgtgcaaagccgtattttggacggcgcgacgggggaagagcgtttccgcgccggcatcggtcagaaattctatttcaaggatgatgcggtgatgcttgacggcagcgtcggcaaaaaaccgcgcaaccgttccgactgggtggcatttgcctccggcagcatcggcagccgcttcatcctcgacagcagcatccactacaaccaaaacgacaaacgcgccgagaactacgccgtcggtgcaagctaccgtcccgcacagggcaaagtgctgaacgcccgctacaaatacgggcgcaacgaaaaaatctacctgaagtccgacggttcctatttttacgacaaactcagccagctcgacctgtccgcacaatggccgctgacgcgcaacctgtcggccgtcgtccgttacaactacggttttgaagccaaaaaaccgatagaggtgctggcgggtgcggaatacaaaagcagttgcggctgctggggcgcgggcgtgtacgcccaacgctacgttaccggcgaaaacacctacaaaaacgctgtctttttctcacttcagttgaaagacctcagcagtgtcggcagaaaccccgcagacaggatggatgtcgccgttcccggctatatcaccgcccactctctttccgccggacgcaacaaacgaccctgaccgtcggaaacctggcaggagcaccgttcccgcacaagacggcattccaccgacaaccccaaacccgccatcaaaggcaggattcaaacgataaggaaagaatgatgaaaatcaaagccctgatgattgccgccgcattgctggcagcagccgatgtccacgccgcaccgcaaaaggcaaaaaccgcatccgccaaagctgccaaagctgccaaagctgccaaagttgccaaagttgccaaagttgccaaagttgccgccacggcgcaaaaagaagccgcacccgcacaacagcagggcggtatccgcttttcagacggcattgccgccgttgccgacaacgaagtcatcacgcgccgccggcttgccgaagccgttgccgaagccaaagccaacctgcccaaagacgcgcagataagcgaatccgagctgtcccgacaggtgctgatgcagcttgtcaaccaatccctgattgtacaggcgggcaaacgccgcaacattcaagcaagcgaagcggaaatcgatgccgtcgtcgcaaaaaatcccgccctcaaaaacctcagccccgcccaacgccgcgattttgccgacaacatcattgccgaaaaagtccgccagcaggcagtgatgcagaacagccgcgtgagcgaagctgaaatcgatgccttcctcgagcaggcgcaaaaacaaggcatcaccctgcccgaaggcgcaccgttgcgccaataccgcgcccaacacatcctgattaaagccgacagcgaaaacgccgccgtcggcgcggaaagcaccatccgcaaaatctacggagaggcccgcagcggcacagacttttccagcctggcgcgccaatattcgcaagacgcgagcgcgggcaacggcggagatttgggctggtttgccgacggcgtgatggttcccgcctttgaagaagccgtccacgcgctcaaacccggacaggtcggcgcgcccgtccgcacccaattcggctggcatatcatcaaattgaacgaagtgcgcgatgccggcacacctcaggaacgtatccgcaattccgtgcggcaatacatcttccaacaaaaagccgaacaggcaaccgtcaacctgttgcgtgacctgcattccggcgcgtatgtcgacatccgctaaggcggtttgaagcaaaaagccataccgatcggcaaaaatccgggcggtatggctttttggatttcgagttacttttacaccgtcattcatcattcccgcgaaagcgggaatctagaaacgaaaagtaacaggaatttatcgggaatggctggagtttaaaggactggattcccgccgtcgcgggaatgacgggattttgggttgtggtaatttatcggaaaaacaaaaaaacctatgccgtcattcccgagcaggcgggaatccggttatttaaaactgcagaaatttatccgaagcaacaacaatctttccatcgtcattcccgcgtaggcgggaatctaggacgtagaatctaaagaaaccgttttatccgataagtttctgtaccgaagaatctggattcccgctttcgcgggaatgacggcgcataagttcccgtgcggacagacctagattcccacctgcgtgggaatgacgattcagaagttgcctgaaacctaaaaaactgaaaccgaacgagccggatttccgctttcgcgggaatgacgggattttgggttgtggtaatttatcgggaaaacggaaacccctatgccgtcattcccgcgcaggcgggaatctaggacgtagaatctaaagaaaccgttttatccgataagtttctgtaccgaagaatctggattcccgctttcgcgggaatgacggcgtataagttcccgtgcggacagacctatattcccacctgcgcgggaatgacgattcagaagttgcccgaaaccaaaaaactgaagccgaacggtctggattcccgctttcgcgggaatgacggcgcataagttcccgtgcggacagacctagattcccacctgcgtgggaatgacgattcagaagttgcccgaaaccaaaaaactgaagccgaacggtctggattcccgctttcgcgggaatgacggcgcataagttcccgtgcggacaggcctagattcccacctgtgtgggaatgacgattcagaagttgcctgaaacctaaaaaactgaaaccgaacgagccggattcccgcttttacgggaatgacgggattttgggttgtggtaatttatcgggaaaacggaaacccctatgccgtcattcccgcgcaggcgggaatctaggacgtagaatctaaagaaaccgttttatccgataagtttctgtaccgaagaatctggatttccgctttcgcgggaatgacggcgcataagttcccgtgcggacagacctagattcccacctgcgtgggaatgacgattcagaagttgcctgaaacctaaaaaactgaaaccgaacgagccggatttccgctttcgcgggaatgacgggattttagattgcgggtatttatcgggaacggcggcttggaagttcattgaaacggaaaaacaacggaaacccaaaaaaccggattcccgactgtgggaatgatgagattcaggtttctgtttttgccggagtttgccgtatcgggcttcagacggcattgcctgccgttgtacccgcgggtgcgactgccttgatgtagttgagcgagacaaactgcttctcggcatccaattcggtgattttgaacaatgcctgtgatttgggcagtgcgtcaaacggaataccggtcgcgcgcgtgaccagcggcaggccttcgatgcggacgaggtcttctttgaggatggtcgcggtcagctcgcttgtaccttgctgttgcaggtacacaaggctccagtaggcttccatctgccgttggaaatcggcgtaggcggtataggcggcatcaaagtcgcgcagtgcggcgaaaagctcggcatcgctgttttgatacagcggctcggcagtgtcgtctatcaggctgatcagctgcttttggttgatgtagtcggcggcgcggcgcagcggcgaggtaaaccagccgtaatgctgcacgcccatgccgatatgcggctcggatttggtgctcatgcgtacttttccggtgggttggacgcggaagaggccgggcaggtcgttgtcatggagcatttgtgcccaagtgctgttggcaagaatcatcatctcgctgaccagcgtatcgatgggtgagccgcgttcgcggcggacgacggataccttgccttcctcatccaattcgatgctgtaatcgtattgcggcgcgcggtcgggttcgtatttgccgcgcgctttttgcagggcggtggcgaattgatagaaccaaatcaggtcttgatggtgggcgaacatcatttcgccggcttcgtccaagccggtttcggcgttgaaatgcggctcgatggcttggatacgcaggtttgtggcgatgttgaccgcttcgattttgcaggtcggcgcgccgacgttgaactcgccgtccacatcgaaataaatgctgacggcagggcggtgtgcgcctgcatcaaggctgaacgcggcaatccagttttcgggcagcatcgtgattttgccgccggggaaataaaccgtgctcaagcgttccatgatgtttttttccattttgtcgcccggtttaacggcaagtgacggcgcggcgatgtggatgccgacacgcttcgtgccgttgtccaagtcggtcaggcttaaagcgtcgtccacttcggtggttgattcgtcgtcaatggaaaaggcggtaacgtcggccttgggcaggtcgggcatttcgggaagggcaaggtcggggaagcctgttcctttagggaagtatttgatttcaaacccgtcttgcaggtattggggaatggacgtaatgccgcccgtttttttcgccaattcgtaggcagaggttttcagcgcgtcggcggctttggtaaaggctttgtaggtcagcgactgcttgtcgggcgcgtgcaggatggttttcaaatccgccgcgatttcagacggcatctcgccgcgtttcaaggcttctgcccaagcgtcgatttgcgcgtcttgctgttttttgcgttcgatggcggcaagtgcttgttttaaagtttcttcgggcgcggctttgaacacgcctttggcttttttgtagaaatacatcggcgcggcgtaaagcgcaatcaaagttgccgccagctcggttttggtcggcgcatggccgtaatattcttcggcgatggcttcggcggtaaattcctcttcgccgcatacttcccacaataaatcggtgtcgatgtccgccgcctgtgcctgcgcgttttccaaaaacgccgccatatcgccgtcaaactcggcaaagacgttgttcgccttcactttggtgcgtttgccgtgtggggtatcgacttggtaggtggcatcgtttttttggatgatggcggcgattttgaattggccggactcttcgtaaaaaatattcatttttcggatttttctgtggaaactcaagcgggcgattttagcagattaccgaaaatgccgtctgaaaaaaggttgggagagggttggcgcggctttgcggtgcttgcgttatagtggattaacaaaaaccagtacggcgttacctcgccttagctcaaagagaacgattctctaaggtgctgaagcaccaagtgaatcggttccgtactatttgtactgtctgcggcttcgtcgccttgtcctgatttttgttaatccactatacgtttttgacggtgtacaatcgctgtttttgaacggaggatggaatggagaatacaaaccgtgtgccggagcaggcacgttatgatgccgaacgcaggcaggcagacgaagcattggcgggcgtgtttccggcagtcagtatcttcggcagcgcgcgcacgccgcagaatcatgcggattatgcgttcgcctgccgtctggcgcggcggctgtcggattcgggcattgccgtcatttcgggcggcgggccggggattatggaggcggcaaacaagggcgcgtttgcagggaagtcggtttcggtggggctgaacatcgttttgccgcacgagcagaaaccgaatccgtatcaggacatcgccttgcggttttcccgttttgccgaacgcaaggcggtgtttttccgctattcccaagcatatgtcgtgatgccgggcggcttcgggacgctggacgaattgtttgaaatcctgaccttggtgcagacgggcaaagtgccgccgcgtccgattgttttggtcggaaaggcgttttggtcgggcttggcggagtggataaacgcgcagcttttggcgcgcggtctgatttccgaaggggcggtctctttgtttgccatatcggacgatgaagacgaaatcgttgcgtatctgtcggaacacgggcttcagacggcatagcgtcctgagagtgatgtataattgcaaacaatttaacaatttttgatgtctttcccgaacaggatgccgaaatgatcaaccccatcgcctcgctttcccctttagatggccgttatgcccaatccgttgaagcattgcgcccgattttttccgaatacggcctgatgaaggcgcgcgtcaaagtcgaattaaactggctcaaagccctcgccgccgagccgaagattgccgaagtgccgcccttcagtgccgaaacgcttgccgaaatcgacacggtgattgaaaacttttcattggaagacgcggccgccgtcaaagccatcgaagccaccaccaatcacgatgtcaaagccatcgaatattggctgaaaaaacgttttgccgaagtgccggaagtcgccgccgtgagtgagttcatccacttcgcctgcaccagcgaagacatcaacaacctgtcccacgctttaatgctgcaagaagcgcgtgaggctgttttgctgccgaagctggccgaaatcatcgaaaaactgaccgctatggcgcacgaccttgccgccgtcccgatgatgagccgcacccacggccagcccgccacgccgaccactttgggcaaagaaaccgccaatgtcgtgtaccgcctgcaacgccagtttaaaaacctgcaagcgcaagagttcctcggcaaaatcaacggcgcggtcggcaactacaacgcccatatggtcgcctatcctgatgtagattgggaaacccactgccgcaacttcgtcgaaatcagcctcggtctgaccttcaacccctacaccatccaaatcgaaccgcacgactatatggcggaattcttccaaaccctcagccgcatcaacacgattctcatcgactttaaccgcgacgtttggggttatatttcattgggttacttcaaacaaaaagtcaaagcaggcgaagtcggttcttccaccatgccgcacaaagtcaaccccatcgactttgaaaactccgagggcaacctcggtatggcaaacgccgtattgggctttttgtccgaaaaactgccgatttcccgctggcagcgcgacctgaccgacagcaccgtattgcgcaatatgggcgtaggcgtgggctatgccgtattgggtttcgccgcccacctgcgcggtctgaacaagctcgaacccaaccccgccgcgcttgccgccgatttggatgccacttgggagctgctcgccgagccgattcaaaccgtaatgcgccgttacggtgtcgccaatccttacgaaaaactgaaagacctgacgcgcggcaaaggcggcatcacgcccgaagtgctgaaaggctttatcggattgctggaaatccccgccgaagccaaagccaaattgcttgagctgacccccgcgctgtatgtgggcaaggctgaagcgttggcgaaacggatttgagcgtttactgaaaccgatgccgtctgaacgcgcgttcagacggcatttttaagataacgggacatacgggggcgatatttatgcaagctgtccgatacagaccggaaattgacggattgcgggccgtcgccgtgctatccgtcatgattttccacctgaataaccgctggctgcccggaggattcctgggggtggacattttctttgtcatctcaggattcctcattaccggcatcattctttctgaaatacagaacggttctttttctttccgggatttttatacccgcaggattaagcggatttatcctgcctttattgcggccgtgtcgctggcttcggtgattgcctctcaaatcttcctttacgaagatttcaaccaaatgcggaaaaccgtggagctttctgcggttttcttgtccaatatttatctggggtttcagcaggggtatttcgatttgagtgccgacgagaaccccgtactgcatatctggtctttggcagtagaggaacagtattacctcctgtatccccttttgctgatattttgctgcaaaaaaaccaaatcgctacgggtgctgcgtaacatcagcatcatcctgtttttgattttgactgcctcatcgtttttgccaagcgggttttataccgacatcctcaaccaacccaatacttattacctttcgacactgaggtttcccgagctgttggcaggttcgctgctggcggtttacgggcaaacgcaaaacggcagacggcaaacagcaaatggaaaacggcagttgctttcatcactctgcttcggcgcattgcttgcctgcctgttcgtgattgacaaacacaatccgtttatcccgggaatgaccctgctccttccctgcctgctgacggcactgcttatccggagtatgcaatacgggacacttccgacccgcatcctgtcggcaagccccatcgtatttgtcggcaaaatctcttattccctatacctgtaccattggatttttattgctttcgcccattacattacaggcgacaaacagctcggactgcctgccgtatcggcggttgccgcgttgacggccggattttccctgttgagttattatttgattgaacagccgcttagaaaacggaagatgaccttcaaaaaggcatttttctgcctctatctcgccccgtccctgatacttgtcggttacaacctgtacgcaaggggggatattgaaacaggaacacctccgcccgttgcccggcgcgccccttgctgcggaaaatcattttccggaaaccgtcctgaccctcggcgactcgcacgccggacacctgagggggtttctggattatgtcggcagccgggaagggtggaaagccaaaatcctgtccctcgattcggagtgtttggtttgggtagatgagaagctggcagacaacccgttatgtcgaaaataccgggatgaagttgaaaaagccgaagccgttttcattgcccaattctatgatttgaggatgggcggccagcctgtgccgagatttgaagcgcaatccttcctaatacccgggttcccagcccgattcagggaaaccgtcaaaaggatagccgccgtcaaacccgtctatgtttttgcaaacaacacatcaatcagccgttcgcccctgagggaggaaaaattgaaaagatttgccgcaaaccaatatctccgccccattcaggctatgggcgacatcggcaagagcaatcaggcggtctttgatttgattaaagatattcccaatgtgcattgggtggacgcacaaaaatacctgcccaaaaacacggtcgaaatatacggccgctatctttacggcgaccaagaccacctgacctatttcggttcttattatatggggcgggaattccacaaacacgaacgcctgcttaaatcttcccacggcggcgcattgcagtagcctgccttcttgtcggatattgcctttggcagcctatgccgctgtttgccgttcggggcggcggcttttatagtggattaacaaaaatcaggacaaggcgacgaagccgcagacagtacaaatagtacggaaccgattcacttggtgcttcagcaccttagagaatcgttctctttgagctaaggcgaggcaacgccgtactggtttttgttaatccactatattttgccgttttgaggccggggtcggaataaccgttttttgatgattttccctccccggctgtgtcatcaaaaccccaattgcctttccaaactctccaccagattgtcatccagtttcaaagcctgcgacaggcgggcgaggaagacggtttctttccgcgacaaatcggcacagaccaaccttgccgccagataggcctccgccgccaacgcctcatcgttgccgacggcggcggcgatgtcttcgatgcttgcgggaaggcggtattcggcggcgagccatgcggcagtttcggggtctgtgccgctttcctgttcgatagtccggcgttcggcttcgtctatcatgccgtctgaagcggcggcggctatcatggtgcgcaatacggtacggctgtatgtttcttcagtttctccggcaggttggaaatcgctttgtgttacggttgcccgccctttgttttgctgccacatctgatagccccggtaggcgaggtagcccaaagcggcggtcgaaccgattttggtgatggttttgcggtttttaccgttcagcagcatggaggcgacaccggcaaccagcgcgcctccgccgaatgaattgagcgggctgtcggagaatgtgttgccttttttttgaaccgtgcttaagacttggttgagcagtcgggtaaagttcatgaatttttcctttctgttgcgggaagggcggtatgtttaccctatccttttaaacggcggcaggccggccaataattgttggccgtaccgctgtgttttgatgcggttgtcgaggatggttacgcggccgtagtcttgttcggtgcggatgaggcggccgacggcctggatgagtttgatgccggcttcggggacggtgatttcgatgaaggggttgccgccgcgctgttctatccagcggttttgggttttttcgatggggttgtcgggcatggcgaagggaagtttggcgatgatgacttgcacgcaggcggtgccgggcaggtcgagtccttcggcaaagctgtcgagtccgaagatgatgctggctttgccttcttctatggcccggtggtgtttttgcaggaggacggctttgggtaattcgccttgtacgagcaagagcggcaggtagtctccgggcaggcgcagggcgacatcctgcatttgtttgcgcgaggaaaacaagacgagcgtgccgatggcttcggtgggcgaaataagcttgggcagccattcgatgacggcggcggtgtgggcttcggggtctttggggctggcgtatatgggggggatgtagagttcgccctgtttttcaaagtcaaaggggcttttgagggcgagggtggtggtttcgggcagccattgcagcccggtttggcgcagcatcaggttgaagttgcccaaggattgcagggtggcggaagtcaataccgcgcctgccgcacgccgccacaggctgttggcaaggtgggatgcgctgctgatggggctggcgttgaaaatgtagtcgtttttgtcgtcggcgcggcgggttatccatttcgccaacggttcttcaccctcgagggggacagtggagagcaaatcccaaaccgcgctgatttgttcgatacgggcgataaaaagaccgaactcgctggtcaggcggtcgaggagcgcgccgtcctgttctttttcgcggcgtgcggcagaaagcgcatcgttcagcccgataacgtgtttgagcaggctgcgcgcagcaatggccgtattggaaacggtggtttcgaggccttcggggattttgccgtcttcccacagccaagtcggttcgctgttggttcgtctgtcgttttcagacacccccagacttaaagacggctcttccgccaaatggaattgccattcatgcaggctgtcgagcaaggatgcggcggcttcgtcggctaggttggcaagttcggctttatcggtcagcgcggcaattttgccggtcagctgcggcagtttttccagcgtccaaacggcaatattccatgaatgttcggcggcaaaacggctgagggcttttttgggcaggtggtgcgcttcgtcgatgcaatagaaactgttttcgggcgcaggcagaatcacgccgccgcccatactgatgtcggcaagcagaagatcgtggttggcaacgacgacatcgacggtttccaagacatcgcgtgctaggtaaaacggacattccggacggttgggacaggcggttttcaggcagccgtggcggtcgttggtcactttgagccaaatcgcgtcatcgattttttccggccaagtgtcgcggtcgccgttgaaccgtcgggcggaaaattcgtcggcgatgtcgcgcagcagcttcaattcttcgggcttgggtttgctgtcccacaagacggcgggggcttcaaagccgagcaggttttgctgggcattgctttgcgtcagtcgatagagtttgtaggggcagagatagcggccgcgccctttggcaagtgcgaaggtcagttccaaaccgcttttttcgaccagaaacggcaggtcgcggtctaccaactgctcctgcaaggcaaccgtcgcgctgctcacaatcagccgcttgccgcgtgtttgcgccatgatgccgccggccaaaaggtaggccaacgatttgcccacgccggtcggcccttcgatcacggcaatgctctcgccttcgcgcttgggcggctcgccgccttcttcgcgcgccaacgtccgcgaaaaagcgttggcaaccgccgcaatcatttcccgctgcgaagcacgcggacggaaaccgggcaggtttttgccgatgttttggtaatggtcgcggatggcgtttttttctaaatcggtgagcatggcgttttgtacggcggtagaagtgggcttattttaacattgcacggaagcggtacaatatcgttgtcggaatggggggtgaggtgaatcgtgcggacgtggttggttttttggttgcagcgtttgaaatacccgttgttgctttggattgcggatatgttgctgtaccggttgttgggcggcgcggaaatcgaatgcggccgttgccctgtgccgccgatgacggattggcagcattttttgccggcgatgggaacggtgtcggcttgggtggcggtgatttgggcatacctgatgattgaaagtgaaaaaaacggaagatattgagtcattcggacgcaatgccgtctgaaacggaagttcagacggcatttgttttaggttgccgtaccgcttagggaataccggcgacaggatgggcgggatagccgtgggtatcgaccgaacaggcaaaccgccaaggcgtgtggacggtgtcggcggacaggtgggcaagctcgggaatgtgccgtctgacaaaggtgccgtcggggtcggttttgtgtgcggcggcggcaatgtcggggcaggtgtgccgtgaggcggcaagccgccagttgccttggttgattgctgcatcgaaatcggtcagctgtcgggcaaaccatatctcgccttcgcggcgggggaggtttaaaacgtggcagaaaaaatccgcgctcaagcgtctcagggcggggtggaggctgccggttttgtgcaaacagcgcatcgcggcatcgataatcggaatgccggtccggccctgctgccaaagcgtcaggcgcagggtgtgttcaggattgccgtctgaagggtcgtcatccgtgtgctgcaaggcaagttgaaggaaaaaatcgcggcggatgatgttgtccgcccacgcgttcagacggcgttcgaggctttcccgcgcgagcaggcgcggcgagatgcagccggcactcaaatacgcgcccatcagcgaagtgtgtttgcgcgaggggaaatcctttaaaacggagtaggaatccgcctgttcgagaaaccgccgccactgccgccaagccgccgtttcgccgctgttttgcggcaggaagatgccgtctgaaagcgcggcaggctgcggggcggaaaggttttcggggaagggttggcggtatgccgcgaataggtccggaccggcggggggctgcttggaaaagcggtcgagccatacttcgcggtagcggtcgaaatcggcatatgccgtgccgccgtcgggtatcaggtcggttttgccgaaaacggcgcggtcgttgacgaaggttaacgcgatgccgtgtttgtccaattcgtgccaaagggcgttgtcggcgagtttgtcggcaaaagtatgggattcgtcggcgatgacggtgcggatattgaggcggacggcgagccggacgagctcggcaggagatgccgccgtgtagagcgggatgccgcgccctgcaagcccttgggcgagttcggcggcggattggcggtagaacgcggcgcggcgagggttgtctgtttcggcatcgtcaatccaaatgccgataatgggcaaacttcggcaacggcggcgcataaggcggcgttgtcgcggatgcggaggttttggcggaaccagacgagcgtgtgtgcggcgcacgtgtccgcataaagggggcgggcggtttcagacggcatttcggcagcctttcctgctggcgattttttcgttcagaaaatcgatgaagctgcggactttcgcgcttaagaatgccctgtctgcataaacggcattcagccggtcggtcgggacggcgtatccgggcagcagcctcaccagcgtgccgcagcgcaaatcgtgttccgccgcccaaagcggctgataaccgatgcacgcgcccgccttaatcatttcgcgcatcatcagcgtgttgtcggtacggatgacgggggtcagttcaagccggtattttttgccgtccgatttgcgggtgaggtcgagtttctgctggttggtgtaggtcggcaggacggcgggcagccccgccacttcttccggcgtttccggcacgccgttgcgcctcaggaaatcgggcgaggcgagcagggcaaattcgatttccgccagtgggcgcgcaatcagcgacggggacagggtttgggaaacgcgcaacgccaaatccacgccttcggcaatcaaatcgacgtggcggttgtccaaaatcagttctaatgccacttcgggataacgttcgcggtattccgccagccagttgcatatctggctgccggcaaaccacagcggcatcgttacgcgcagcagcccctgcggtttttccgtccccccggcggctttttgcgcggcatcgtcgagcgtgtcgagcgcgtaactgcattgccggtagtattcttccccggcttcggtcaggctgaggttgcggctgttgcggtgcaggagtttggcttggacggtgttttccaagtggctgacgtgtttgcttgccattgcggtggagatgccgagcgcgtcggcggcgcgggtgaagccgccgctttggacgacttggcggaaaaccttgaggctgaacagggtgtccatattttcttgtgtggaaaagttgtatcaataaaagcagtatatatttgaaaaggggaaacatctatactctaccgcctgaaatgaagacaaatatcaaaggagcttttatgtccgattgctgcaaccgtatccaaccggttttgctttctgttttgcgtatcgtaaccgcctacctgtttttgttgcacggtacgtcgaaaatcttcgccttccccattgaaatgggcagcggttcgcccggcgggctgttgctgcttgccggtattttagaaattgtcggcggcattttgctggtgttgggcctgtttgcgcgccctgccgcgtttgttttgtccggccagatggcggttgcctattttatggcgcacgcttccggaaatgctttgttcccgattgccaacggcggcgagtccgcagtgctgttctgcttcgtattcctctatatcgcggcggcgggcggcggagcatggtcgctggacaggctgtttttcaagcgtaaagcctgaatcggactgcctaaagtgtattttgttgaatgtttttgaggaaaagaaatgacccgtcaatctctgcaacaggctgccgaaagccgccgttccatttattcgttaaataaaaatctgcccgtcggcaaagatgaagttgtccaaatcgtcgaacacgccgttttgcacacaccttcttcgttcaattcccaatctgcccgcgtggtcgtgctgtttggcgaagagcatgataaggtgtggcaatttgtcgaagacgcgctgcgtgccgtcgtgcctgccgacagttttgaaccgaccgcgcaaaaattgaacctgtttaaggcgggtgcggcaaccattttgttttatgaagatcaaaatgtcgtcaaaggtttgcaggagcagttccctgcttatgccgctaacttccccgtttgggcggatcaggcaaacgcgatggtgcagtatgccgtttggacgacacttgccgcggtcggcgtaggtgcaaacctgcaacattacaatcccttgcccgatgcggcgattgccaaagcgtggaatatccccgaaaactggttgttgcgcgcacaaatggttatcggcggtattgaaggggcggcaggtgaaaagacctttgaacccgttgcagaacgtttgaaagtgttcggcgcataatttcgcggtcaaaaaaatgccgtctgaaccctgttcagacggcatttttcagtatcaggcggcgagttttccgcattctgagacctttgtttacaaatatcatgttcaatatagttaaaagaaattattctcatttcctccgtgaggcaatataattcggttgttttgttaaattgagtataaaaatgaaaatatcatttcatttagctttattacccacgctgattattgcttccttccctgttgctgccgccgatacgcaggacaatggtgaacattacaccgccactctgcccaccgtttccgtggtcggacagtccgacaccagcgtactcaaaggctacatcaactacgacgaagccgccgttacccgcaacggacagctcatcaaagaaacgccgcaaaccatcgatacgctcaatatccagaaaaacaaaaattacggtacgaacgatttgagttccatcctcgaaggcaatgccggcatcgacgctgcctacgatatgcgcggtgaaagcattttcctgcgcggttttcaagccgacgcatccgatatttaccgcgacggcgtgcgcgaaagcggacaagtgcgccgcagtactgccaacatcgagcgcgtggaaatcctgaaaggcccgtcttccgtgctttacggccgcaccaacggcggcggcgtcatcaacatggtcagcaaatacgccaacttcaaacaaagccgcaacatcggagcggtttacggctcatgggcaaaccgcagcctgaatatggacattaacgaagtgctgaacaaaaacgtcgccatccgtctcaccggcgaagtcgggcgcgccaattcgttccgcagcggcatagacagcaaaaatgtcatggtttcgcccagcattaccgtcaaactcgacaacggcttgaagtggacggggcaatacacctacgacaatgtggagcgcacgcccgaccgcagtccgaccaagtccgtgtacgaccgcttcggactgccttaccgcatggggttcgcccaccggaacgattttgtcaaagacaagctgcaagtttggcgttccgaccttgaatacgccttcaacgacaaatggcgtgcccaatggcagctcgcccaccgcacggcggcgcaggattttgatcatttctatgcaggcagcgaaaatggcaacttaatcaaacgtaactacgcctggcagcagaccgacaacaaaaccctgtcgtccaacttaacgctcaacggcgactacaccatcggccgttttgaaaaccacctgaccgtaggcatggattacagccgcgaacaccgcaacccgacattgggtttcagcagcgccttttccgcctccatcaacccctacgaccgcgcaagctggccggcttcgggcagattgcagcctattctgacccaaaaccgccacaaagccgactcctacggcatctttgtgcaaaacatcttctccgccacgcccgatttgaaattcgtcctcggcggccgttacgacaaatacacctttaattccgaaaacaaactcaccggcagcagccgccaatacagcggacactcgttcagccccaacatcggcgcagtgtggaacatcaatcccgtccacacactttacgcctcgtataacaaaggcttcgcgccttatggcggacgcggcggctatttgagcatcgatacgttgtcttccgccgtgttcaacgccgaccccgagtacacccgccaatacgaaaccggcgtgaaaagcagttggctggacgaccgcctcagcactacgttgtctgcctaccaaatcgaacgcttcaatatccgctaccgccccgatccaaaaaacaacccttatatttatgcggttagcggcaaacaccgttcgcgcggcgtggaattgtccgccatcgggcaaatcatccccaaaaaactctatctgcgcggttcgttgggcgtgatgcaggcgaaagtcgttgaagacaaagaaaatcccgaccgagtgggcatccatttgaataataccagcaacgttaccggcaacctgtttttccgttataccccgaccgaaaacctctacggcgaaatcggcgtaaccggtacaggcaaacgctacggttacaactcaagaaataaagaagtgactacgcttccaggctttgcccgagttgatgccatgcttggctggaaccataaaaatgttaacgttacctttgccgcagccaatctgctcaatcaaaaatattggcgttcggactctatgccgggtaatccgcgcggctatactgcccgggtaaattaccgtttctgatgaaatcaggcaaaggctgaaataaaactaaacacattttttcactcaaatcgaacacgccttcaataaaatgccataaaatccgcacattaatctgacacacaagagatacctatgaaactgaaaaccttagctttgacttcattgaccctgttggcattggccgcttgtagcaaacaggctgaaaccagtgttccggcagacagcgcccaaagcagctcatctgctccggcagcccctgctgagttgaacgaaggtgtgaactacactgtattgtctacgcctattccgcaacagcaggccggtaaaatcgaagtattggaatttttcggctacttctgcccgcattgcgcccatcttgagccggtcttgagcgagcacatcaaaacgtttaaagacgatacctatatgcgccgggagcatgtcgtgtggggtgatgaaatgaaacctttggcacgtttggcggccgcagtggaaatggccggtgaatcagataaagccaacagccatattttcgatgcgatggttaatcaaaaaatcaatctggccgataccgataccctgaaaaaatggctgtccgagcaaacagcgtttgacggcaaaaaagtattggctgcatttgaggctcctgaaagccaagcgcgtgcggctcaaatggaagagttgaccaataaattccaaatcagcggcacaccgactgtgattgtcggcggcaaataccaagttgaatttaaagactggcagtccggtatgaccacgattgaccagttggtggataaagtacgcgaagagcagaaaaagccgcaataagttgaggattgaatgagtaaaggccatctgaaaataggatttcagacggccttttgtatttaggctttatagaagagatgattgcttaaagccttatggttttaaatcagaatatatagcggattaacaaaaaccagtacggcgttggctcgccttagctcaaagagaacgattctctaaggtgctgaagcaccaagtgaatcggttccgtactatctgtactgtctgcggctcgccgccttgtcctgatttttgttaatccactataaatcagaatataaaacaaaaacgccgtctgaaatttcagacggcgttttctgttaaatcggcttacaaacccgggaacatcccttttatccccctcattcctttcgccatacgcatcagtttgcccaagccgttgccgctgaacatcttcatcatttgttgcatttgttcaaactgtttgagcaatttgttcacttcctgcacggttgtgcccgcacccattgcaatacggcgtttgcggctggctttgagcagggcagggttggcgcgttctttaggggtcatcgagttgatgatggcttctactttgcccatcgctttttcagccgttccttcggggatttgtttcgagatttgacccagttcgcccggcattttcgacatcaggttttccaaaccgcccatattgcgcatttgctggatttgttctttaaagtcgttgaggtcgaagcctttgcctttgtgcagctttttcgccattttagcggcggcttcttcgtctatacctttttgaacgtcttcaatcagggtcaatacgtcgcccatacccaaaatgcggccggcaagacggtcggggtggaaaggttcgaggccgttgattttttcgccgacaccgataaatttaatcggtttgccggttacgtggcgtacggacaatgccgcaccgccgcgcgagtcgccgtccatcttggtcaatacgactccggtcagcggcagggcttcattaaatgcctgagcagtgttcaccgcatcctgacccagcatcgcatcgatgacgaacaaagtttccaccgggttaaccgccgcgtgaagggctttgatttcgttcatcatctcttcatcgattgccaaacggccggcggtatcgaccatcaatacatcgtaaaaatgttttttggcgtaatcgacggcggcagttgcaatttcaaccggtttttggttggtatcggacgggaaaaaatccacgccgacctgttcggccaacagacgcagctgttcaatcgcggcaggacggtaaacgtcggcggataccaccaaaacctttttcttctgatcgtttttcaacaggcgggcgagtttgccgacggtcgtcgtcttgcctgcgccctgcaaacctgccatcaacacgacggcgggcggcgcaaccgacaaatccagcgttttgttttccctgcccatcagttcggtcagggctttgttgaccacgccgataaatgcctgatccggcgtcaggctgcccgctacttcctgaccgagggccttttctttgacgttgttgatgaactctttgacgacaggcagggcgacatccgcctcaagcagggcgaggcggacttcgcgcaaggcctctttaatattgtcttcggtcagtttggcctgcccccggatgtttttgaagacattgctgaagcggccggttaaattgtctaacatactggtccttggtctgaataagaatagcttgccccatcaggggcattctttgttaaaataaaatcaaaataatttgatgcggcttgtgtgccggacagcatatcggcaaatccgtcaaggcttgaccgaaatggggattttacaattccaacgttaaaagttccaatatttcataagcggccgcatacggcgcaacagtatagatagagaaagtccaccatgccgacagttttcatctttttgacggcggtttacgcaggattgggtgcatttgcatggcactgccaacagcaggggtgcggccgggattacccgtggaagacggaattgccggttttgggtgcggcattgaccgtccacggcgcggcactgcttatgccggtcattcaagacaaaatcatcattatgggcttcgggtattccggcagcctgattgtttggatgatgctgtttatttattttgccggcagcttcttttatccgctgcgcggagtgcagttgctgctgtatccttgcgccgcactgatgctgctgtcaggtttggtttttcctggaaaattctcgggatatgaaattaccgaccttccctttatgctgcatatcggaacttcgctgctcgcatacgggctgttcggcatcgcaacattattgtccgttttgaccctgctgctgaatcggagcctgcaccgcaggagcttctccaagctcgcaggattcctgccgtcgctgctcagtttggaaaaactcatgttccaggccatgtgggcaggtttcatcctgctgacctattccgtcgtcagtggaacattttttgccgaagccgtattcggcaaacccatgacctttacccataaaaccgtattcggcatattgtcatggctgatttacggcggactgctgctcaagcacagcatgaccgcatggcgcggcaaaaaagccgccgtgtggaccatcatcggatttgtcagccttatgattgcctatatgggcagcaagttcgtattggaaatcattctgaaaagataagaagagccaacagatgccgtctgagtccccgagtttcagacagcatattcacaaaggcgcaccagccggaggagggagaggaaaggattgttggaggcggcgcagtatttagcagaaataaaaaaccttatccgacagcgacatgacgaatttccccaaaaaaatcccgctgaaagcattgaccgtttttccctgtgggcgtatagttcggttcttcgctgctgcagaagtggcggacgaactgaaaagtatagcacagaatgttggggatatcgagagatatcttgacaggcggaaggaatactttataattcgcaacgctctttaacaaaacagattaccgataagtgtgagtgccttgagtctcacactgtttgaaagacagacaagataatgttttgaacattgtcctgttggtttctttgaagcagaccagaagttaaaaagttagagattgaacataagagtttgatcctggctcagattgaacgctggcggcatgctttacacatgcaagtcggacggcagcacagagaagcttgcttctcgggtggcgagtggcgaacgggtgagtaacatatcggaacgtaccgagtagtgggggataactgatcgaaagatcagctaataccgcatacgtcttgagagagaaagcaggggaccttcgggccttgcgctattcgagcggccgatatctgattagctagttggtggggtaaaggcctaccaaggcgacgatcagtagcgggtctgagaggatgatccgccacactgggactgagacacggcccagactcctacgggaggcagcagtggggaattttggacaatgggcgcaagcctgatccagccatgccgcgtgtctgaagaaggccttcgggttgtaaaggacttttgtcagggaagaaaaggctgttgctaatatcagcggctgatgacggtacctgaagaataagcaccggctaactacgtgccagcagccgcggtaatacgtagggtgcgagcgttaatcggaattactgggcgtaaagcgggcgcagacggttacttaagcaggatgtgaaatccccgggctcaacccgggaactgcgttctgaactgggtgactcgagtgtgtcagagggaggtagaattccacgtgtagcagtgaaatgcgtagagatgtggaggaataccgatggcgaaggcagcctcctgggacaacactgacgttcatgcccgaaagcgtgggtagcaaacaggattagataccctggtagtccacgccctaaacgatgtcaattagctgttgggcaacctgattgcttggtagcgtagctaacgcgtgaaattgaccgcctggggagtacggtcgcaagattaaaactcaaaggaattgacggggacccgcacaagcggtggatgatgtggattaattcgatgcaacgcgaagaaccttacctggtcttgacatgtacggaatcctccggagacggaggagtgccttcgggagccgtaacacaggtgctgcatggctgtcgtcagctcgtgtcgtgagatgttgggttaagtcccgcaacgagcgcaacccttgtcattagttgccatcattcagttgggcactctaatgagactgccggtgacaagccggaggaaggtggggatgacgtcaagtcctcatggcccttatgaccagggcttcacacgtcatacaatggtcggtacagagggtagccaagccgcgaggcggagccaatctcacaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtgggggataccagaagtaggtaggataaccacaaggagtccgcttaccacggtatgcttcatgactggggtgaagtcgtaacaaggtagccgtaggggaacctgcggctggatcacctcctttctagagaaagaagaggctttaggcattcacacttatcggtaaactgaaaaagatgcggaagaagcttgagtgaaggcaagattcgcttaagaagagaatccgggtttgtagctcagctggttagagcacacgcttgataagcgtggggtcggaggttcaagtcctcccagacccaccaagaacgggggcatagctcagttggtagagcacctgctttgcaagcagggggtcatcggttcgatcccgtttgcctccaccaatactgtacaaatcaaaacggaagaatggaacagaatccattcagggcgacgtcacacttgaccaagaacaaaatgctgatataataatcagctcgttttgatttgcacagtagatagcaatatcgaacgcatcgatctttaacaaattggaaagccgaaatcaacaaacaaagacaaagcgtttgttttgattttttattctttgcaaaggataaaaatctctcgcaagagaaaagaaaacaaacacagtatttgggtgatgattgtatcgacttaatcctgaaacacaaaaggcaggattaagacacaacaaagcagtaagctttatcaaagtaggaaattcaagtctgatgttctagtcaacggaatgttaggcaaagtcaaagaagttcttgaaatgatagagtcaagtgaataagtgcatcaggtggatgccttggcgatgataggcgacgaaggacgtgtaagcctgcgaaaagcgcgggggagctggcaataaagcaatgatcccgcgatgtccgaatggggaaacccactgcattctgtgcagtatcctaagttgaatacatagacttagagaagcgaacccggagaactgaaccatctaagtacccggaggaaaagaaatcaaccgagattccgcaagtagtggcgagcgaacgcggaggagcctgtacgtaataactgtcgagatagaagaacaagctgggaagcttgaccatagtgggtgacagtcccgtattcgaaatctcaacagcggtactaagcgtacgaaaagtagggcggggcacgtgaaatcctgtctgaatatggggggaccatcctccaaggctaaatactcatcatcgaccgatagtgaaccagtaccgtgagggaaaggcgaaaagaaccccgggaggggagtgaaacagaacctgaaacctgatgcatacaaacagtgggagcgccctagtggtgtgactgcgtaccttttgtataatgggtcaacgacttacattcagtagcgagcttaaccgaataggggaggcgtagggaaaccgagtcttaatagggcgatgagttgctgggtgtagacccgaaaccgagtgatctatccatggccaggttgaaggtgccgtaacaggtactggaggaccgaacccacgcatgttgcaaaatgcggggatgagctgtggataggggtgaaaggctaaacaaactcggagatagctggttctccccgaaaactatttaggtagtgcctcgagcaagacactgatgggggtaaagcactgttatggctagggggttattgcaacttaccaacccatggcaaactaagaataccatcaagtggttcctcgggagacagacagcgggtgctaacgtccgttgtcaagagggaaacaacccagaccgccagctaaggtcccaaatgatagattaagtggtaaacgaagtgggaaggcccagacagccaggatgttggcttagaagcagccatcatttaaagaaagcgtaatagctcactggtcgagtcgtcctgcgcggaagatgtaacggggctcaaatctataaccgaagctgcggatgccggtttaccggcatggtaggggagcgttctgtaggctgatgaaggtgcattgtaaagtgtgctggaggtatcagaagtgcgaatgttgacatgagtagcgataaagcgggtgaaaagcccgctcgccgaaagcccaaggtttcctgcgcaacgttcatcggcgtagggtgagtcggcccctaaggcgaggcagaaatgcgtagtcgatgggaaacaggttaatattcctgtacttgattcaaatgcgatgtggggacggagaaggttaggttggcaagctgttggaatagcttgtttaagccggtaggtggaagacttaggcaaatccgggtcttcttaacaccgagaagtgacgacgagtgtctacggacacgaagcaaccgataccacgcttccaggaaaagccactaagcttcagtttgaatcgaaccgtaccgcaaaccgacacaggtgggcaggatgagaattctaaggcgcttgagagaactcaggagaaggaactcggcaaattgataccgtaacttcgggagaaggtatgccctctaaggttaaggacttgctccgtaagccccggagggtcgcagagaataggtggctgcgactgtttattaaaaacacagcactctgctaacacgaaagtggacgtatagggtgtgacgcctgcccggtgctggaaggttaattgaagatgtgagagcatcggatcgaagccccagtaaacggcggccgtaactataacggtcctaaggtagcgaaattccttgtcgggtaagttccgacccgcacgaatggcgtaacgatggccacactgtctcctcctgagactcagcgaagttgaagtggttgtgaagatgcaatctacccgctgctagacggaaagaccccgtgaacctttactgtagctttgcattggactttgaagtcacttgtgtaggataggtgggaggcttagaagcagagacgccagtctctgtggagccgtccttgaaataccaccctggtgtctttgaggttctaacccagacccgtcatccgggtcggggaccgtgcatggtaggcagtttgactggggcggtctcctcccaaagcgtaacggaggagttcgaaggttacctaggtccggtcggaaatcggactgatagtgcaatggcaaaaggtagcttaactgcgagaccgacaagtcgagcaggtgcgaaagcaggacatagtgatccggtggttctgtatggaagggccatcgctcaacggataaaaggtactccggggataacaggctgattccgcccaagagttcatatcgacggcggagtttggcacctcgatgtcggctcatcacatcctggggctgtagtcggtcccaagggtatggctgttcgccatttaaagtggtacgtgagctgggtttaaaacgtcgtgagacagtttggtccctatctgcagtgggcgttggaagtttgacgggggctgctcctagtacgagaggaccggagtggacgaacctctggtgtaccggttgtaacgccagttgcatagccgggtagctaagttcggaagagataagcgctgaaagcatctaagcgcgaaactcgcctgaagatgagacttcccttgcggtttaaccgcactaaagagtcgttcgagaccaggacgttgataggtggggtgtggaagcgcggtaacgcgtgaagctaacccatactaattgctcgtgaggcttgactctatcatttgaagaacttcaagagataaaagcttactgactgattcagtcattaccgaatatattgattaaggctttaccgatttgtaacagtttaagtttggcggccatagcgagttggtcccacgccttcccatcccgaacaggaccgtgaaacgactcagcgccgatgatagtgtggttcttccatgcgaaagtaggtcactgccaaacacccattcagaaaacccccgattattcgggggtttttgctttgcccggaaaaaatgtttgctttgcccggaaaaaatgtcggtgatggcgggacggcatccgtacggtgtccggtcgggtttgcggaggaacggcttgaaactttgggatattcattttagaatgactcgttttatcgtcgcaagatgcggtttattgtttgcaacccttaaaggaaaaaccatgaagaaaatgttcgtgctgttctgtatgctgttctcctgcgccttctcccttgcggcggtaaacatcaatgcggcttcgcagcaggagttggaggcgctgccgggcataggcccggcgaaggcgaaggccattgcggaataccgtgcgcaaaacggtgcgttcaagtctgtagacgatttgaccaaggtaaagggcatcggccctgcggtgctggcgaagctgaaggaccaggcttcggtcggcgcgcccgcaccaaaagccccagccaaaccggtgctgcccgcggataaaaaataggggaacctgtaaaggaaagggcatcggccgccgtcggtgcttttttgtttggaagggaaatggctaaaatatgtagcattatgttctgtatcgttgtttaccgcttccgcacctttgtccgccttaaagcaggtagacaccgcaatgaatcgacgcaaagaaaatgccgtctgaacatgcgttcgggcggcgttttgttggggggtatcggagcggaacgtctgaaaaagggtttcaggcggtctttgggcgtgtggtgacagtcgaaaacgtgataaggctacctgaaaagtttgggagattttcaggtagcctttggtattgggcgcaacagacgcaggtacagattagcggtgtgccgtaatcgtacgaatgccgattcaacctaagcagacatcagtatttaggaagtggatgtttgatggagcaaaggttgtacgaagggtggaaggcaacctgtgggtgtttggtatggtcgcgcttgaaaaaacgtgttttaagggacaaatgccgtctgaaaatcggtttcagacggcattttctgtttatttaaagcaaacaggaaaaggcagcaatattctgcagtcttcctattcacacaagcgttttatagttaattaaaaacaaaatagtacaatactcaactttgaaggtctaaccatggcatactctgcggacttaagaaacaaagctttaaactaggggctgtactagattagcagatatgttaccctcgaaatatgaagataacgcactgcaaattaaagaaaaaagtacagaaagaactgctccgttttttgtgctggaagttaccgcccgttctgccgccgatattttgggtatccatcccaattcggcagtactgttctaccgtaaaatccgcacggttatcaaccatcatttggccttggctgccgatgaggtttttgagggccctgtcgagccggacgaaagcgatttcggcggacggcgtaaaggcagacgtggtcgcggtgcggcaggaaaagtggttgtcttcggcattctgaaacgcaacggacggggctataccgttgtcgtagataatgccaagtctgaaacgttactccctgtcatcaaaaagaaaatcatgccggacagtattgtttataccgatagtctgagcagctgcgacaagttggacgtgagcggttttatccattaccgcatcaaccattccaaggaatttgcagaccgtcagaaccacattaacggcattgagaatttttggaatcaggcaaaacgcgtcttgcgaaaatacaacggaatcgatcgtaaatctttcccgctgttcttgaaagaatgcgaatttcgatttaacttcggcacaccgtctcaacagcttaaaatcctgcgggattggtgtggaatttagggctaatctagtacagcacctaacaaaaaccagtacggcgttggctcgccttagctcaaagagaacgattctctaaggtgctgaagcaccaagtgaatcggttccgtactatttgtactgtctgcggcttcgtcgccttgtcctgatttttgttaatccactatattttagataatgcgtgatttcaccgtatgggtgtcttacgggaaatggcggaaaaattgggacataaggtattgcctcttgcaccttattcacctgagctcaacccgattgagaaagtgtgggcgaatattaagcggtatctgcgaaccgttttgtctgattacgcccgatttgacgatgcactactgtcctattttgattttaattgactatagaacgttgcggctacgcggaagccgtactcgttggatttggagcggcccattttggttttgtcaccgtccaagacaatctcacggggtttgtagattgttttgtgacggtagtatggatcaaactcgagaccgacgctgtcggtcaactgtttgcctacattcagaccgataccgacactccaacctttggcgcttttgctgacatcgcgggaagcacccatctgggtcgtcatcactttggttttgccgcgcaaatctgcatatgcatccgcccaaggggtcagggatcatccgtcccccaaatcttggcggatttcgccatggactttcaaagcaaggttttcatgcttggtaacggtgtttttccttatcgccgatgatggctttgcctttgccgttagactcgggaatatcggctaccgtaacggcggacacggctgcaagtgagagtgcaagcagggttttttcatgtttttcttcctataatgaggataaataaatggaaaaagtgtgggaaatacccgcattcccattaaatcttttttcaagcaatgagttctttttgttttcaacattttccttgagacctttgcaaaaatagtctgttaacgaaatttgacgcataaaaatgcgccaaaaaattttcaattgcctaaaaccttcctaatattgagcaaaaagtaggaaaaatcagaaaagttttgcattttgaaaatgagattgagcataaaattttagtaacctatgttattgcaaaggtctctccttgtgtatgaaattttgccggatgtgaaggcggaatcggcagcgggggtgttctgtaccggattgtcgtggaaatgggaaaacggatgttccgtgcaggtttgtccaaatgaatggcgggtattgtttttatcaatctgtttctttttatttgaaataaaatttctaaaataataaaaatatgaaatttaaaatctataaaaaaagatatatcagttattttgaaataaaatagctttgtagtaatatgttgcacttgtttgtgcaaggtaaacgatgtaacctaagccgcgtataaaaacccatcaggaaagatgcaagatgacacaccattaccccacagacgatattaagattaaagaagttaaagagttgttgccgccgatagcccatctttacgagctgccgatttccaaagaggcttcgggcttggttcaccgcacccgtcaggaaatttccgatttggttcacggcagggacaagcggctgttggttattatcgggccgtgttcgattcacgatccgaaagcggcgttggaatatgcggagcgtttgttgaaactccgcaagcagtatgaaaacgagcttttgattgtgatgcgcgtttatttcgagaagccgaggacgacggtgggttggaaaggtttgattaacgacccgcatttggacggtacgtttgacatcaatttcggtttgcgtcaggcgcgcagcctgttgttgtcgctgaacaatatgggtatgcctgcctctaccgagtttttggatatgattacgccgcaatattatgcggacttgatttcttggggggcaatcggtgcgcggacgaccgaaagccaagttcaccgcgaattggcaagcgggctgtcctgccccgtcggctttaaaaacggtacggacggcaatttgaagattgccatcgacgcaatcggtgcggcgagccattcgcatcatttcctgtctgtaaccaaggccgggcattccgccattgtccataccggcggcaatcccgactgtcatgtcattttgcgcggcggcaaagagccgaattatgatgcggaacacgtcagcgaggcggcggaacaactgcgtgcggcaggggtaaccgacaagctgatgatagattgcagccacgccaacagccgcaaggattacactcggcagatggaagtggcacaagacattgccgcccaattggaacaggacggcggcaatatcatgggcgtgatggtggaaagccatttggtcgaaggcagacaggacaagccggaagtgtacggcaagagcattaccgatgcgtgtatcggttggggcgcgactgaagaactgttggcattgttggcaggtgcaaacaaaaaacgtatggcgcgcgccagttgagatttttgacgcagaatgtcataaaatgtcgtctgaagcgttcagacggcatttttgtggaggaaatatgctcaaaataaccctaattgcggcgtgtgcggaaaacctgtgcatcggggcgggcaatgctatgccttggcacatccccgaagatttcgcatttttcaaagcctataccttgggcaaacccgtcattatggggcggaaaacgtgggaatccctgcccgtcaaacccctgcccggacggaggaacatcgtcatcagccggcaggcggattattgcgcggcaggcgcggaaacggcggcaagtttggaggcggcattggcattgtgcgcaggcgcggaagaagccgtcattatgggcggcgcgcagatatacggacaagcgatgccattggcgaccgatttgcggataaccgaagtggatttgtctgtggaaggagatgcatttttccccgcaatagaccggacgcattggaaagaagcagagcggacggaacgccgtgtcagcagcaaaggcacgcgctatgcttttgtgcattatttgagatattgaaatataaactctctataaaatcccccgcaaatgatgggctgaaatagaaaatattgttattcccccgaagatgggaatccgggattttaaagttagggtaatttatccgaaataacaacaatcttccatcgtcattcccgcaaaagcgggaatccggaaacgaaaagctaaagcaatttatcggaaaaaaccgaagtttaaagaaccggattcccgcctgcgcgggaatgacgagattttaggttatggggatttattgggaataatggaacaaagaaagcagaaataaggatatagaggctgtctttggatttgcgatggttgtcggagaatgccgtctgaagccgtttcagacggcatttttccagcttgagaacggatgcctgctcaaataagcattggtaaacataccgtcggcagtgatttcccgtcccagccagtccggacggtcaaaatcggcattctcgtcgggcaactcgatttccgcgacgaccaaaggcgcattatcgccaagaaaaacatcgatttcaaacaggctgccgccccatctgaccggataacgccatttttccattttaaacgggcacatcgtttccatcatcttttccgcatcggcaagcgggatttcgtattcaaactcactgcggctgatttccgaaatatagcctttcagcgtcagccacgcctgttttccggcaatgcggacacggacggtgcgttctttttcaacagacagataaccctgcctcaacagcagcggttcgtcggcgtattgccgccagttgtcgtttccaatcaaaaaacggcgttcgatttctatcggcataagatgctccgtcaaaacggtttgaacacgaccagatacagcgcggcaaccatcagcagcacggggatttcgttgaacacgcggtaccagcggtgtgaaaaagcattgctgtaatcctgaaaacggcgcagcagcacgccgcaatacaactggtaagccaagagcatcaagcccaaacacagtttgacgtgtacccagccgctgccccaccagccggcggcaaacggtatcgccgcgccgaacacgaccgcgccgaagcccaacggcgacataaaacggtacagccgcaccgccatgcccgacagacgcacatactcgggattgccgcgcggcacatcaatcatcgccatattgacgaaaatcctcggcaggtaaaacagccctgcaaaccacgaaatgacaaaaaacaagtgaaacagcttgaaccaagaaaacatcatcgcccacaccctgccgaaaagcggtattgtacaggcaaaccgcttgggaaacgtgataaaatcaggcggataaacaaatcgaataaatccttaccgcaaaacggaggcaaaatgctcaaatccatcgaactcaattcccacatccgcaaccgccttgcagaatatctgaaaggcaggggtatggattttcagacggcaatgcaggaagaaaaaggcaacaaagaaatcgccgccatcgtccacagcggtttgcccactctggtccgcaaactgtattccgaacaaaaaatgcagaagtttttttgggaaaagcgggatttgattgccgactacatcagccgccggatgcagggataggtggctgaaatctgttttcaggcaagtgaaaagacaatatggcagattgaaattacgcttatcgtcattcccgcccgcgcgggaatccgacttgtttggtttcggttatttttcgtttcgtaacttttgagccgtcattcccgcgcaggcggtaatccggcttgttcggtttcggttctttttctcgtttcgggtgatttctaaaccgtcattcccgcgcaggcgggaatctaggtctttaaacttcggttttttccgataaatttttgccgcattaaaattctagattcccgctttcgcgggaatgacggcggagggtttttagttttcccgaaaatgcacatcatccaaaatcccgttattcccacaaaacagaaaatcaaaaacagcaacctgaaatcccgtctttcccgcgcaggcggtaatctgaacacgtccgtagtgaaacctatatcccgtcattcgcacgaaagtgggaatccaggatgcagggaaaaccgttttatccgataagtttccgcaccgaaaggtctagattcccgctttcgcgggaatgacggcggagggtttttagttttctcgataaatgcacatcatccaaagtcccgttattcccacaaaaacagaaaatcaaaaacaacaatctgaaattccgtccttcccgcctgtgcgggaatccggcttgttcggtttcggttctttttctcgtttcgggtgatttctaaaccgtcattcccgcgcaggcgggaatctaggtctttaagcttcggtttttcttgataaattcttgccgcattaaaattctagattcccgctttcgcgggaatgacggcggagggttttttgttttcccgataaatgcacatcatccaaagtcccgttattcccacaaaaacagaaaatcaaaaacagcaacctgaaatcccgtccttcccgcgcaggcggtaatctgaacacgtccgtagtgaaacctatatcccgtcattcgcacgaaagtgggaatccaggatgcagggaaaaccgttttatccgataagtttccgcaccgaaaggtctagattcccgctttcgcgggaatgacggcggagggtttttagttttctcgataaatgcacatcatccaaaatcccgttatttccacaaaacagaaaatcaaaaacagtaacctgaaatcccgtcattcccgcgcaggcgggaatccggcttgttcggtttcggttctttttcttgtttcgggtgatttctaaaccgtcattcccgcgcaggcgggaatccagacctttaaaccccgaccatccttgataaattcttgcggcattaaaattctagattcccgctttcgcgggaatgacggcggagggttttttgcttttcctgatttttcattgcgatgtagtataatgtagtatataatcattataattttaacacttgacaaaggaaaatttctcatgacactgaaagcaagcaagcaagcaagcaagcaagcaagcaagcggtcgggttaatctattaacattatctgttttatcgctgttttgcacgccatatgtttgaggttcggatgcgtacgatcccgtcaaagaagccgagattaaaaacaaatttattttagaagcggcggaagacagaaattcccacgtttggcgcggcccgtgcagcatatcttttgattgcttcggtatgttcagagctcagcttggttcaaatactcgttctaccaaaatcggcgacgatgccgatttttcattttcagacaagccgaaacccggcacttcccattatttttccagcggtaaaaccgatcaaaattcatccgaatatgggtatgacgaaatcaatatccaaggtaaaaattacaatagcggcatcctcgccgtcgataatatgcccgttgtcaaaaaatatattacagagaagtatggggctgatttaaagcaggcggttaaaagtcaattacaggatttatacaaaacaagaccggaagcttgggcagaaaataaaaaacggactgaggaggcgtatatagcacagtttggaacaaaatttagtacgctcaaacagacgatgcccgatttaattaataaattggtagaagattccgtactcactcctcatagtaatacatcacagactagtctcaacaacatcttcaataaaaaattacacgtcaaaatcgaaaacaaatcccacgtcgccggacaggtgttggaactgaccaagatgacgctgaaagattccctttgggaaccgcgccgccattccgacatccatacgctggaaacttccgataatgcccgcatccgcctgaacacgaaagatgaaaaactgaccgtccataaggattatgcgggcggcgcggatttcctgttcggctacgacgtgcgggagtcggacgaacccgccctgacctttgaagacaaagtcagcggacaatccggcgtggttttggaacgccggccggaaaatctgaaaacgctcgacgggcgcaaactgattgcggcaaaaacggcggattccggttcgtttgcgtttaaacaaaattaccggcagggactgtacgaattattgctcaagcaatgcgaaggcggattttgcttgggcgtgcagcgtttggctatccccgaggcggaagcggttttatatgcccaacaggcttatgcggcaaatactttgtttgggctgcgtgccgccgacaggggcgacgacgtgtatgccgccgatccgtcccgtcaaaaattgtggctgcgcttcatcggcggccggtcgcatcaaaatatacggggcggcgcggctgcggacgggtggcgcaaaggcgtgcaaatcggcggcgaggtgtttgtacggcaaaatgaaggcagccgactggcaatcggcgtgatgggcggcagggccggccagcacgcatcagtcaacggcaaaggcggtgcggcaggcagtgatttgtatggttatggcgggggtgtttatgctgcgtggcatcagttgcgcgataaacaaacgggtgcgtatttggacggctggttgcaataccaacgtttcaaacaccgcatcaatgatgaaaaccgtgcggaacgctacaaaaccaaaggttggacggcttctgtcgaaggcggctacaacgcgcttgtggcggaaggcattgtcggaaaaggcaataatgtgcggttttacctacaaccgcaggcgcagtttacctacttgggcgtaaacggcggctttaccgacagcgaggggacggcggtcggactgctcggcagcggtcagtggcaaagccgcgccggcattcgggcaaaaacccgttttgctttgcgtaacggtgtcaatcttcagccttttgccgcttttaatgttttgcacaggtcaaaatctttcggcgtggaaatggacggcgaaaaacagacgctggcaggcaggacggcactcgaagggcggttcggtattgaagccggttggaaaggccatatgtccgcacgcatcggatatggcaaaaggacggacggcgacaaagaagccgcattgtcgctcaaatggctgttttgatgcgtcgggaaatgttttgacgcacaggcggtacaccggcacggcaccgcgcgccgccccgcaaaccaatccgaaccctgccgccccgaagggcggggcataatgatgaaaccggcggaaaaccgccggttttttgccgccgtttgaaacccgattctggcttcagacggcattgtcgcggcatcgggcggcagggtttggaacagcggcataaaaaactgatacaatccgccgattgataatggttattttttatttttgtgggaagacatttatgcctgcacgaaacagatggatgctgctgctgcctttattggcaagcgcggcatatgccgaagaaacaccgcgcgaaccggatttgagaagccgtcccgagttcaggcttcatgaagcggaggtcaaaccgatcgacagggagaaggtgccggggcaggtgcgggaaaaaggaaaagttttgcagattgacggcgaaaccctgctgaaaaatcccgaattgttgtcccgcgcgatgtattccgcagtggtctcaaacaatattgccggtatccgcgttattttgccgatttacctacaacaggcgcagcaggataagatgttggcactttatgcacaagggattttggcgcaggcagacggtagggtgaaggaggcgatttcccattaccgggaattgattgccgcccaacccgacgcgcccgccgtccgtatgcgtttggcggcagcattgtttgaaaacaggcagaacgaggcggcggcagaccagttcgaccgcctgaaggcggaaaacctgccgccgcagctgatggagcaggtcgagctgtaccgcaaggcattgcgcgaacgcgatgcgtggaaggtaaatggcggcttcagcgtcacccgcgaacacaatatcaaccaagccccgaaacggcagcagtacggcaaatggactttcccgaaacaggtggacggcacggcggtcaattaccggctcggcgcggagaaaaaatggtcgctgaaaaacggctggtacacgacggcgggcggcgacgtgtccggcagggtttatccggggaataagaaattcaacgatatgacggcaggcgtttccggcggcatcggttttgccgaccggcgcaaagatgccgggctggcagtgttccacgaacgccgcacctacggcaacgacgcttattcttacaccaacggcgcacgcctttatttcaaccgttggcaaaccccgaaatggcaaacgttgtcttcggcggagtgggggcgtttgaagaatacgcgccgggcgcgttccgacaatacccatttgcaaatttccaattcgctggtgttttaccggaatgcgcgccaatattggatgggcggtttggatttttaccgcgagcgcaaccccgccgaccggggcgacaatttcaaccgttacggcctgcgctttgcctgggggcaggaatggggcggcagcggcctgtcttcgctgttgcgcctcggcgcggcgaaacggcattatgaaaaacccggctttttcagcggttttaaaggggaaaggcgcagggataaagaattgaacacatccttgagcctttggcaccgggcattgcatttcaaaggcatcacgccgcgcctgacgttgtcgcaccgcgaaacgcggagtaacgatgtgttcaacgaatacgagaaaaatcgggcgtttgtcgagtttaataaaacgttctgattgctgttccttttcggaggaaaccctgccggcggcggtatcacggcgggcatcggcggctttcgggcggtgctttgcgtgccgccgcgtgtgcggaaacgcattccggtttttccggcataacggcgatgcgaggtaaaatgccgtctgaaacccgattcgggcttcagacggcattgtcgcggttgcggcgggcgggttcaccagattccgtcaaaggttttcgcgccgcgccaaaatttccacctgtcggcgggtttgaaggtcagcgtaccgccgtgttgtccgtccgtggtgatgtccagccgtttgattttgccggtgcggacggcttcgtagattggtgcgaaccagcgttcttcccactgctgcaatattgccgcataccgctccctgtcccctgtcagggcggtcaggcgcaaatcgtccataaacaggatatggtgcgtgtcgggcaggtgtgccgccgtttcttcataggcgcggaagttgtcgggtaatgcgcggcggtcggagtggaaacggctccaaaccgtatcggcgaaaagcgtgccgccttgcgcgccgccgtttgtgccgtcccaaagccataagccgttcaactcgggcagcccgcgtttcttgcggttatggttgacggggtgcgccgccagccacatttggatttcggtttggacgcgcagccattccaacgcatcttctccgtccggctgatcgtcagcgcccaacaatccgcccaagtccaaaacgggcttcgcgccccagcggtacgcgcaaggaagggaaaccagccataattcgggcaggacgggaacgaaacgccatggaatgtcgccgtaaaacgccgacaggtcgcggcagatccgttccgcttcatccgtaccgacgttcagatattccgccgttagcacatttgcctgatgcatccccatcttttgccagacgggcgtggcgagcgcgacggcttcagacggcatattcaggctttgcgccgcgcgttccaccagtctgccgcaccacaaataacgcgcgtaaaatgccgaagccgtgcagctttggcggtgcagcgagccgtattgcaggattttgttgaaagcgtgcaggcatagaggtattcggatttcgtcttcatccaaattgagcgagggaatggcgagggtgagtttcatcgtttgacgtttcagaaatgcaggtcaggcgcaacattatagaggattcggcgcaaacgccgtcaaaaaggaacaatatggctgtcttcccactttcggcaaaacatcggaaatacgcgctgcgtgcgcttgccgtttcgattattttggtgtcggcggcatacattgcttcgacagagaggacggagcgcgtcagaccgcagcgcgtggaacaaaatctgccgccgctgtcttggggcggcagcggcgttcagacggcatattgggtgcaggaggcggtgcagccgggcgactcgctggcggacgtgctggcgcgttcgggtatggcgcgggacgagattgcccgaatcacggaaaaatatggcggcgaagccgatttgcggcatttgcgtgccgaccagtcggttcatgttttggtcggcggcgacggcggcgcgcgcgaagtgcagttttttaccgacgaagacggcgagcgcaatctggtcgctttggaaaagaaaggcggcatatggcggcggtcggcttctgaggcggatatgaaggttttgccgacgctgcgttcggtcgtggtcaaaacgtcggcgcgcggttcgctggcgcgggcggaagtgcccgtcgaaatccgcgaatccttaagcgggattttcgccggccgcttcagccttgacggtttgaaggaaggcgatgccgtgcgcctgatgtacgacagcctgtatttccacgggcagcaggtggcggcgggcgatattttggcggctgaagtcgttaagggcggcacaaggcatcaggcgttctattaccgttcggacaaggaaggcggagggggcggcaattattatgatgaagacggcaaggtgttgcaggaaaaaggcggcttcaacatcgagccgctggtctatacgcgcatttcttcgccgttcggctaccgtatgcaccccatcctgcacacatggcggctgcacacgggcatcgattatgccgcaccgcagggaacgccggtcagggcttccgccgacggcgtgattacctttaaaggccggaagggcggatacggcaacgcggtgatgatacgccacgccaacggtgtggaaacgctgtacgcgcacttgagcgcgttttcgcaggcggaaggcaatgtgcgcggcggcgaggtcatcggttttgtcggttcgaccgggcgttcgaccgggccgcacctgcattacgaggcgcgcatcaacgggcagcccgtcaatcctgtttcggtcgcattgccgacaccggaattgacgcaggcggacaaggcggcgtttgccgcgcagaaacagaaggcggacgcgctgcttgcgcgcttgcgcggcataccggttaccgtgtcgcaatcggattgaagtttgaaccggcgacgaaaacaatgccgtctgaaaacctgcaaacaggttttcagacggcatttatagtggattaacaaaaatcagtacggcgttgcctcgccttagctcaaagagaacgattctctaaggtgctgaagcaccaagtgaatcggttccgtactatttgtattgtctgcggcttcgtcgtcttgtcctgatttttgttaatccactatgcagttgattaaaacaaaactaagccaaggaagcactgccgtcattcccgtacgggcgggaatcctgacaccacggcacggaaacccatccgctgtcattcccacgaaagcgggaatctagaaatacaacgcggcaggagtttatcggaaatgactgaaacccaacgtaccggattcccgctttcgcgggaatgacgaagtgggcgggaatccggatttatccgttccgacagtgtttgcaaataaaagaaaacccaaccgtcccgattcccggcagggctgttttacggattttgcagcgagggcgcggggcggtcttgcgcctgtttggtttgcagggttgtcagttttttcgtcagcagattcagtatcacgccgtaggcgggcaggaagaagagggtgcagacggtaagtttgaacaggtaatcgacaaaagcgatgccctgccagtttgccgccataaatccatcgctgcttgcgtagaaggcaacggcgaaaaataccagcgtatccaaggcgttgccgatgacggttgatgcggtcggtgcaatccaccacgctttcagacggcgtaatttgttgaatacaaaaatatcaaggatttgtccgatcgcgtaggcggcaaagctggctaaggcgatgcgtccgacaaaggtgttgaattcggacagcgcgcccaagcctgtccaactgccgttgtggaacaaaacggaaaagacgtaggaaagcaaaagggcggggaacatcacccaaaagataatccgccgtgccaagtgagaaccgaaaatgcggacggtcaggtcggtggcaaggaagatgaagggaaaggaaaatgcgccccaagtggtgtggatgccgaaaatttggaaagggaactgcaccagatagttgctggcggcgatgatgaggatatgaaaaagcaccagccggaagagtgccttctgttgctgtgcggcggtaaatgcgtacataaaaatctttcggaaaggcgttcagacggcatatcgtatcgaaggaatgccgtctgaaatatgggaaggatggtttattgtgcgtcgtgctcaaacaagcgtttgcgtgccaatgtttcgaactcggtgcctgcttttccgtagttggcaaacggatgaatggcgatgccgccgcgcggtgtgaactcgccgaatacttcgatgtatttcggatccatcagggcaatgaggtctttcatgatgatgttgacgcagtcttcatgaaaatcgccgtggttgcggaagctgaagaggtagagtttcagggatttgctttccaccattttgatgtgcggaatgtagcggatgtagatggtggcgaagtcgggctgcccggtcatggggcagaggctggtgaactcgggacagacgaatttgacgaaatagtcgttgtcgggatgtttgttgtcgaatgcttcgagaatttcaggcgcgtagccggtcggatattgggttttttgattgcccaaaagagagatgccttgcagctcttcgttgttgcgggacatgagggtttccttagttttttaatgtgggaggttttcgaaccacgggcggcgattgtaatataagcggcggtatctgtgtagttttcttcagacggcatggtttggacggcggcgttttccgtgtcatatatagtggattaacaaaaaccagtacggcgttgcctcgccttagctcaaagagaacgattctctaaggtgctgaagcaccaagtgaatcggttccgtactatttgtactgtctgcggcttcgccgccttgtcctgatttttgttaatccattatataaacgaaatatattttcagttttgccgcctgaagcgttgttttttgaatattgcatctaaaatactgacttgattgcgttattgcgcggatatagaatctgcttcctattgaaagaacattgtttatatgaaatcaggaaattcggaacccaatcttatggatacgcacacggacgaaacaaaacttcaaaacacgcaagccaaacgcaaacgccgcctgacggcattgacgctgctgttcgcgcttgccgccgcagccgccgggtcggcgttttttttatggtggcagcacgaagaggaaacggaagacgcttatgttgccggacgcgtggttcaggttacgccgcaaaagggcggtacggtgcggaaggttttgcacgacgatacggatgccgtgaaaaaaggcgacgtgctggcggtattggacgacgataatgatgtgctggcttacgagcgggcaaaaaacgagctggttcaggcggtgcggcaaaaccgccggcaaaatgccgccacttcgcaggcgggggcgcaggttgccttgcgccgggcggatttggcacgcgcacaggatgatttgcgccgccggtctgctttggcggaatcgggcgcggtgtccgccgaagagctggcacacgcccgtgcggcagtgtctcaggcgcaggcggcggtcaaagcggctttggcggaagaatcttcggcacgtgcggctttgggcggtcaggtttctttgcgcgaacagccggcggttcagacggcaatcggcaggttgaaagatgcgtggttgaaccttcagcggacgcaaatccgcgcgccggcggacggtcaggtggcgaagcgttcggtgcaggtcgggcagcaggtggcggcaggcgcgccgctgatggcggtggtgccgctgtcggatgtgtgggtggatgctaattttaaagagacgcagttgcggcatatgaaaatcggacagcctgccgagctggtgtccgatttgtacggcaaacaaattgtttatcgcggcagggtggcaggtttttcggcaggtacgggcagcgcgttttcgctgattccggcgcaaaacgcaacgggcaactggattaaagtggtgcagcgcgtccccgtccgtatcgtgctgaaccgcgaagatgtggacaggcatccgttgcgtatcggtttgtcgatgacggttaaagtggatacttccgccgcaggcgcgcctgtttcaaaaacgccgggtgcggcattgccggaaatggaaagtaccgactggtcggaagtcgatcggacggtcgatgaaatcctcgggcaatccgcgccctgatgccgtctgaaacggaggacacaatggattatccaccgcttaagggtgcggcattggcgtgggttacgctgtctttggggcttgccgtatttatggaagttttagatacgactatcgccaatgtcgccgttcccgtcatcgccggcaacctcggtgcggcaaccactcaggggacgtgggtcatcacttccttttctgtggcaaacgccgtttccgtgccgctgacgggctttttggcaaaacgcatcggcgaggtcaaattgtttaccgccgccgctgtcggtttcgtcatcacatcgtggctgtgcggtattgcccccaaccttcagtcgctggttgttttccgcatcttgcagggctttatcgccgggccgctgattcccttgtcgcaaagcctgttaatggcatcctatccgcccgcaaaacggacgctggcactggcattgtgggcaatgaccgtcgttgtcgcccctgttctcgggccgatactcggcggctggatttccggaaactggcattggggttggattttcttcattaatatccctatcggtatcatatcggcatggattacatggaaacatttgaaatatcgggaaacggaaaccgttaaaatgccgaccgactatgtcgggcttacattgatggtagtcggtatcggcgcgttacagatgatgctggacaggggtaaggaactcgactggttcgcctctggagaaatcattaccttgggcgtagtcgcactggtgtgcttgtcgtattttattgtttgggaattgggagaaaaatatccgattgtcgatttatcgctgtttaaagatcggaattttaccgtcggcgtcattgccacgtcattgggttttatggtgtatatggggacgctgaccctgctgccgttagtgttgcagaccaacctgggctatacctccacgtgggcagggcttgccgccgcacctgtcggcatcctgcctgttttcctgtctccgttaatcggcaggttcggcaataaaatcgatatgcgcctgttcgtaactgccagcttcctgacctttgcctttactttctattggcgtacggatttttatgccgatatggatattggcaacgtcatctggccgcagttttggcagggtgtcggtgtcgccatgttttttctgccgctgaccaccatcacactgtcgcatatgaagggcgggcagattgccgccgcaggcagcctgtcgaatttcttgcgcgtgctgatgggcggtgtcggcgtatccgtcgtcagcaccctgtgggaacggcgcgaagcgttgcaccacacacgctttgccgaacacatcacgccctattccgcaacattgcacgaaacggccgctcatttgtcccagcacggcgtttccgacattcaaaccctaggcatcatcaacaataccattacccagcagggttttattatcggctcgaacgaaatctttatggcgggcagcttgttattcattatcatgatacccgtcatatggctggcaaaaccgccgttccacaacggcggcggcggtggacattgagggatttgaaaacttgaaatgccgtctgaaaatactggaaatatgttcggacggcattttgaatgcagcagttcccgaaatccgctataatcgcgccccatctgtttcgcacctgcaaacgttccacagatgcgacaatcggaaggattatccgcgcaaaacagccgtttttctttaaaacacttgaactaacactgtttttcgtggtataaatcgcgttttactattttagaagtttggagactgattatggcacgagtttgcaaagtgaccggcaaacgcccgatgtccggcaacaacgtatcgcacgccaacaacaaaaccaaacgccgttttttgcccaacttgcaatcacgtcgtttttgggtagaaagtgaaaaccgctgggttcgcctgcgcgtttccaacgctgcactgcgtaccatcgacaaagtaggcattgatgtcgtattggctgatttgcgtgctcgcggcgaagcttaatttaaacactatttaattaaggattactgcaatgcgcgataaaatcaaactggaatccagtgcaggtactggtcacttctacaccactaccaaaaacaaacgcactatgcccggcaaattggaaatcaaaaaatttgacccagttgcccgcaaacacgtagtgtataaagaaactaaactgaaataatttcagtttgaaagcaaagcctccgactgctcggaggctttgttatttttatcgtgtttcctttccgcttgaaacatctgccgtatgcgaatctgctgcaaaccgtctgccaaggatatgaaaaccgcaaaacggttcataacacaaaaatgccgtctgaaacgtttcagacggcatttcggcagttttcaaccggtcagttgtttggtgatcagtttcttcagcggtgggaaattgttgctggcacgcaataccaagccgcgcaacagttttgccggtgcggtctcattggtaaacagtttcagcatcatattggttccgtgataaagcggatgggcgtgcagcatatgtttgctgctgtatttttccaataatgaagatgcaccgatgtcttgaccgcgctgttcggcttcgagtatcagttttgccaaaatatctgcgctggaaagccccaagttgaaaccgtgtgctgtaacggggtgcataccgacggcggcatcgccaatcagcgcgctgcgtttgccgtagaaacgtttggcaatcatgccgacaagggggtaatggtggatgctgctgaccaattccatatcgccgagcctgcccttgagctgttcttttacgcttgccgccaattcttcgggcgaaaggttttgaacgctgttgattttatcggtatcgacggtaatgacggtattggtcaggtgctcttccagcggcagcagtgcgatggtgcgtccgtaatggaagcattcgtaagcggtatgttggttggaaagggtatgtttcatacggcagacgaacatggttcggctgtaatcgtgcatatcggaggagataccgagttgtcgacgggtttgcgagaagcggctgtctgccgccaaaagcaggcgtgcagtcagtattttgccgttttccaaaatgacttgtgcttcgttgtcagatgttttgacttctttgacaaccgtatcggtcagaatgctgacattgtcgagttgtgatacgacttcataggcggcgcggcggatattgtggttggaaatcagatagcccaaacagtcggcaggttcgccgcgcgcttcagtcggttggggaaagtggagctggtagtcggaacgtccgttcagcactttggcatcgcgcaaagggtagatttcgttttcgggaattttgtcccacatacccaaacgctgcatgatttcgcgggaaaaatgggtcagggcgatttcgcgtccgtcatatggaggattttgcagaacagtcagtgggctgcgttcgatcagggtaactttcaaaccgctgccggcaagttcggctgcaaaacttaaacccgccgggcctgcgccgacgacgaggatgtcgctgtgtaaactcataaaatatcctttgcatagacggatgccgatgatttcagacggtatttgtaagggtttgaatgccgtttgaactatctgtaacagataggcgattatatcaaaacccactgttgaagaaatatgcaggggagggtgtatgcggatttttactttcagcttaatgtgtatcaaatcgggtgtggggtatgtatagtggattaaatttaaaccagtacggcgttgcctcgccttgccgtactatttgtactgtctgcggcttcgtcgccttgtcctgatttttgttaatccactataaaaagccgcatcgtgaaaagatgcggcttcaggtatcggttggattattcttcagaaccggtgtaaggacggatgctgacagttttacggttcagcgcgcctttggttttgaattcgacataaccgtcaactttggcgaacaaagtgtggtctttgcccatacctacgttgtcgcctgcgtggaatttggtaccgcgttggcgtacgatgatggaacctgcgggaatcagctcgttgccgtaggctttaacgcccaagcgtttggcttctgaatcgcgaccgttgcgggtgctgccgcctgcttttttacttgccatttgtaatgctcctaagttttaaggttaggcgattgccacgatttcgatttgggtgaaattttggcggtggccttggcgtttttggtagtgtttgcggcggcgcattttgaagatgcggactttttcgccacgaccgtgtgccactactttagccgttacttttgcaccttcgataaagggtgcgccaacttttacagattcgccgtcagcaatcatcaaaacttcggtcagttcgatttggctgtcgagttcggctggtatctgttctactttcaatttttcgccgacggaaactttatactgtttgccgccggtttttacgaccgcgtacatactcaactccataagggttatggttaatatccgcacaccattgtgcggaactcggcattgtattgttatttgcctgttttgtcaaagtttgcgcggttcggataaccatatgccgtctgaaaagatgtaccctgatggctttgctgatataattgcccgctatttgaatcagctttcaagcggtatctgccgtttgacggaaacgtaaacctgagagtctgccatgctcgagaatctgccctatttccagcgacatctgcctgaagaccttgccaaagtcaatgaagtcatcaaccgtgcggtgcaatccgatgtcgcactgatttcgcaaatcggtacatatatcatcagcgcgggcggcaaacgcctgcgtccgattatgacgattttggcgggtaaggcggtcggttatgatgacgagaaactgtattcgctggcggcgatggtcgagtttatccacacttccaccctcctgcacgacgatgtcgtcgatgaaagcgatttgcgccgtgggcgggcaacggcaaacaatctgttcggcaatgcggcggctgtgttggttggcgactttttatacacgcgcgcctttcaactgatggttgcctcgggcagtatgcgcgttttggaagtgatggcggatgcaaccaacattattgccgagggcgaagtcatgcagctgatgaacatcggcaatacggacattaccgaagaacaatatatccaagtcatccaatataaaacggcaaaattgtttgaagctgccgctcaagtcggcgcaattttgggcaaggcttcccccgaacacgaacgggcgttgaaagactacggtatgtatgtcggtacggcattccaaattattgacgatgtgctggactattctggcgaaaccgaagaaaccggcaaaaacgtcggcgacgatttggcggaaggaaaaccgactttgcctttgatttatctgatgcgtcagggttccgaacaggttgcgaacgatgtgcgtactgctttggaaaatgcagatcgcagctattttgagaaaatccacgattatgtcgtccgttcggatgcgttggcatattcgataggcgaggcgcgcaaagcagtcgattgtgccgttaccgccttggatgccctgcccgacagcgaagtgaaggatgccatgattcagctggcgaaggaatctttggtcagggtgtcttgaggcgatgaatttcagttttgttcccctgtttctggttacgctgattctgttgggggtggtcagcaacaacaattcgattaccatctcggcaaccatattgctgctgatgcagcagacggcattgatacagtttgtcccgttggtcgagaagcacgggttgaatctcggtatcattcttttgaccataggggttttgagtccgttggtttcaggaaaggcgcaggttcctcccgttgccgaatttttgaattttaaaatgatatccgccgtttttatcggtattttcgtggcttggctggcgggacgcggcgtgccttatgatgggacagcagcctgttttaattacagggctgttaatcgggacggttatcggggtggcatttatgggcggtatccctgtcgggccgctgattgcggccggcatcttgtcttttgtcgtcggaaagggttaaaatctccttttcatttcggctcgccatagttcaacggatagaacgtatgcctcctaagcgtaaaatacaggttcgattcctgttggcgaggtttgacgatttcatttgtctgtttcccgtgttgcgggaagtttccgatataaggcctttcagtgttggagggcttttttgccatctgaaaactttttcttcctgcttgaaaaaccgacctttaggacggtagaatcatgaaatgattttcaggcttcgtaaaagatgttccggcttggaaatctgttgttttatgatatagtggattaaatttaaatcaggacaaggcgacgaagccgcagacagtacagatagtacggcaaggcgaggcaacgccgtactggtttaaatttaatccactataaaagctgtacaggtataacaatgaataaatttggggataaggtcgtatgagcgtaggtttgctgaggattctggttcaaaaccaggtggttactgttgagcaggccgagcattactacaatgagtcgcaggcgggtaaggaagtgttgccgatgctgttttcagacggtgtcatttcgcccaagtcgcttgcggcattgattgcgagggtgttcagttattcgattcttgatttgcgtcattatccgcgccacagggtgctgatgggggtgttgacggaggagcagatggtggagttccactgtgtgccggttttccgtcggggcgacaaagtattttttgcggtttccgatccgacacagatgccgcaaattcagaaaaccgtttctgccgcagggattgaggttgagttggtcattgtcgaggatgaccagttggcgggtttgctcgattgggtgggttcgcgttcgacatcgctgcttcaggagcttggggaggggcaggaggaagaggaaagccacaccctgtatatcgacaacgaggaggcagaagacggccctgttccgaggtttatccataagactttgtcggatgccttgcgcagcggggcatcggacatccatttcgagttttacgaacacaatgcccgtatccgtttccgtgtggacgggcagctccgcgaggtggttcagccgcccattgcggtaagggggcagcttgcttcacggattaaggtaatgtcgcgtttggacatttccgaaaaacggataccgcaggacggcaggatgcagctgacctttcaaaagggcggcaagcctgtcgatttccgtgtcagcacattgccgacgctgtttggcgaaaaggtcgtgatgcggattttgaattccgatgccgcgtctttgaacatcgaccagctcggttttgagccgtttcagaaaaaattgttgttggaagcgattcaccgtccctacgggatggtgctggtaaccggtccgacgggttcgggtaagacggtgtcgctctatacctgtttgaatattttgaatacggagtcggtaaatattgcaacggcggaagaccctgccgagattaacctgccgggcatcaatcaggttaacgtcaatgataagcagggcctgacttttgccgctgctttgaagtctttcctgcgtcaggacccggacatcattatggtcggtgagattcgtgatttggaaactgccgatattgcgattaaggcggcacaaacagggcatatggtgttttccaccctgcacaccaataatgcgccggcgacgttgtcgcgtatgctgaatatgggtgtcgcgccgtttaatattgccagttcggtcagcctgattatggcgcagcgtcttttacgcaggctgtgttcgagctgcaaacaggaagtggaacgcccgtctgcctctgctttgaaggaagtcggcttcaccgatgaggaccttgcaaaagattggaaactttaccgcgccgtcggttgcgaccgttgccgggggcagggttataaggggcgtgcgggcgtgtatgaggttatgcccatcagcgaagaaatgcagcgtgtgattatgaacaacggtacggaagtggatattttggacgttgcctataaggagggtatggtggatttgcgccgggccggtattttgaaagttatgcagggcattacttcattggaagaggtaacggcaaataccaacgattaggtttgagaatgaaaatgccgtctgaagcgtgtttgtttcagacggcatttgactttcagggtgtttgccgggaaggcggggcggtcagcggtatgccatgtcgggttcggatatttccggcaaactttccgtttggccggaaaccgtatatttcccgtctgcccatccgcccaagtcgatcagtttgcagcgttgcgaacagaaggggcggaatgcgttttcgggtttccatactactgctgtttgacaggtcggacatttgacttgaaggcgtgtttgccgcgattcagtcattgtgttttccttgtgttggttttgaggcgaaaatccctgaataaaacgcgtgcaggcgcattgttttctcacgcaggcttttgaggctgccgtcattgagcagcacatcgtctgcaagcagcaggcgttcggattcggatgcctgatggctgatgacggccgccacctcgccgcgcgtcagcccgctgcgggccatcaccctgccgatacgtttttccacaggggcacttatggtcaggacacgccgtatcaggctgataaattgacgcttttccgtcagcagcggaatttcgacaatgccgtaagctgcatcagtaaaggtttcttgctgttttttgatttctgagaaaatcagcggcaacatcacggattcgagcaaggcttttcgcgatggggaggcaaagacttctttacgcaatatgtcgcgccgcaacaaaccctgtgtgtcaaaaacggtgtcgccgaacagccgcctgatttccggcagggcgatgccgtctgaagccgtcagcgagtgcgccgccgcgtctgcatcgatgcgcggcacgcccaaatcggcaaaacattgcgcggctgccgatttgccgctgccgattccgccggtcagtccgacccataccgtcatcttacagcaccggatgggtcagccaccagttgaccgcccgccatacggaatcgtttgccgtaaaaattatccagcccgaaactgtcagtgcggggccgaaggcaaaatgctgccccttggcgacgcgcataacgattgccgcgaccaaaccgatcagcgaggaaacaaaaatcagtacgggcaatgcggatatgccgagccacgcgcccaatgcggcaatcagtttgaaatctccgttgcccataccggtttttcctgtgagcagtttatacactgcacataagagccataatgaaccatagccggcgaccgcacctaaaacggcagactgcaaaggcacgaagccgccgtccaaattaaatatcagacccagccaaattaagggcagtgtcatcgagtcgggcaggtattgggtgtccgcatcgataaaggtcagggaaatcagaaacgcggtcagtaccaatccgcccagcgtaatccaagaccagccgtattgccaggcgaccagcccgaacaatacgccggtcagcagctcgattaagggataacgtatgctgattttggtttggcaggaagcgcatttgccgcgcaggagcaggtagctgacaatcgggatgttctgccacgcgcgtatcggcacgcggcatttgggacagcaggaatccggtttcatcaggttgaaggtacggctttcctcttcggtcagcggcaggtttaaatattctttggcaaataccgtccagccgcgttccatcatgaccggcacgcggtaaatgacgacatttaagaaacttccgaccagcagcccgaacaccgctgccaaaggcacggcaaacggcgacaatacagacaaatcagacatattttgttctcaatgtattcaaaacaaaaacaaaccggcgcagagcgaatccgcgccggatctgtgcggcaaatcaggcgaccacgttgcccaaattaaacagcggcagatacatggcgaccagaagcgtgccgatgaccaagcctaaaatcacgataatgatcggctccatcatagcggacagcctgccgaccgcattgtccacctcgtcttcgtaaaattcggcggctttgttgagcatatcgtccaaagaacccgattcctcgccgatggaagacatctgcaacatcatattggggaacagttccgtcgcacgcatccccgaagtcatagacaaaccttggatgacgcgcgtacggatttcccgggtggcttcttcatagattaaattgcccgccgcgccggcagtggagtccaatacatcgaccaaaggcacgcctgccgcaatcagcgtcgccgtcgtcctgccccagcgggcaatcgttcctttgcggacaatgtctccgaaaatcggcatacgcagcagtatggcatccatacgccgttggattttaatcgaacgcgccttcaatttaaggaagccgtatatggcaaagcccagtgcgatcagcaccatccagccgtatgagacgaaaaagtcggacatatccatcactgtttgggtcagtgcgggaagctccgcgcccatattggcgtaaacttctttaaaggcgggcagtacgaaaatcatcatcacgaataccaaaccgatggcgacggcgatgacggataccggataggtcagtgcggtttttacctttttgcggatggcctgggttttttctttgtaaattgccaatttgtccagcaggctttccaatacgccgcccgtttcgcccgccgcaaccagattgcagtagaagcggtcgaaatattttgggtggtttgagaatgcgcggctcaacgagctgccctgttccacttcgcctcggatttccatcagcatttccgtcatagacgggttgccgtgtccgcgcgccacgatttcaaatgcctgcatcagcggcaggcccgctttaatcatcgtggacagctggcgggtgaaaacggtgatgtcttcttgtgtgattttgcgcttggagcttgttttcacacgggtaatctgcaacgggcggatgccgcgttttgccagttttttgcgcgcctcttcttcggtaaacgcggatacttcgccgttgaccagtttgtcggaggcggaatgcctgccttcaaagataaagcgtttttctttctttgcgaacaaagaaaatcctccgtttttagccatattctagccccgtaaagtaattggaataaaatgtaagaaacatcgttaaaaaacagtaccggcgtgttcccggtaagatgaaaaccgccgacatcccgcctgcgggcggcaaacgggacagaatcggatgcgattataccttatttaggcggctgtccggcatttatgcgtacacaataaatcttgcaggatattgttgcgggtcaaatgccggccggagggcatttccgccatatggaaataaggtgctattggacgcggcgggcggtgttccggagattcgccaaagccgctgccgtttgttaaactacattctgctacattttaatccggttctgaaaaatcaaggaaaacagatgaatgcttttacccgtgcatggtatgcgctcgaacgccattatcaggatacgcgtcatgtccttttgcgcgaccgctttgcctgcgaaccggaccggtttgagcgtatgcacgagcgtttggacgggatgttgttcgattacagcaaaaaccgtttgggcgaagatacgctgcaactgctctgcaatcttgccgacgcggcggatttggaagggaaaatgcgtgctttgcggacgggtgcgaaagtcaacggcagcgaggggcgtgccgcgctgcatacggctttgcgcctgcccgacggtgcggatgccgtttatgtggacggcagggacgtgttgcccgaaatccgccgcgagttaaatcgtgcgttgaagtttgcacacagtttggacgacggttcgtatcaggggataaccggaaaacggattacggattttgtccacatcggcataggcggatccgacctcgggccggcaatgtgcgtgcaggcacttgagccgttcagacggcatatcaccgtccattttgccgccaacgccgatcctgcctgcctggatgcggttttatgccgtctgaaccccgaaacgacagtgttttgcgttgccagcaagtccttcaaaacaccggaaaccctgctcaatgcacaggcagtcaaggcgtggtatcgcggtgcagggttctcggaatccgaaacggcgtgccatttttgcgcggtgtctgccgacactgcggcagctgcggcttttggtatcgcggcggaacgcgtgtttgcgatgtacgactgggtgggcggacgctattccgtctggtcgcccgtcggtttgcccgtgatggttgcggtcggcggggcgcgtttccgcgagttgttggcgggggcgcacgcgatggacaggcattttttcagtacgccgacgcgtcataatatccccgttttaatggcactgattgccgtgtggtacaacaatttccagcacgcggacgggcagaccgccgttccgtacagccacaacctgcgcctgctgccggcgtggctgaaccagctcgatatggagagtttgggcaaaagccgcgcttcagacggcagtcccgccgtgtgcaaaacgggcggcatcgtgttcggtggtgaaggggtcaactgccagcacgcctatttccaactgctccaccaaggcacgcgcctgattccctgcgattttatcgtcccgatgacggcgcagggcagagaggacggacgcagccgttttaccgttgccaacgcctttgcccaagcggaagccttgatgaagggcaaaaccttggacgaagcacgcgccgaactggcagatttgcccgaagcggaacgcgaacgcctcgcgccgcacaaagagttccccggcaaccgccccagcaacagcattttgattgaccgcctcacgccctacaatttgggtatgctgatggcggcttacgaacacaaaaccttcgtccaaggcgcgatatggaacgtcaaccccttcgatcagtggggggtggaatacggcaaacagttggcaaaaaccatcatcggcgaactggaaggcggcacgtccgtacacgatgcctcgaccgaagggctgatggcgttttaccgcgaatgccgtctgaaaggcggcggcgcggcataaaagtactgccgcctttctgtattgattcgggcgcggaaaaggcaatacctgccgcctgcccgattccgaaacgccaatgtttggcaaccgctcgcgtattgctgacgaatatgcgtttgcgtggcacaatagcgcattcatttcaaatgaacatactgcttgaaaataccggcaagcgtcccacgaaacatctcacataaggaaatattatgtctttgcaaaacattatcgaaaccgcctttgaaaaccgcgcggacatcaccccgaccaccgttactcccgaagtcaaagaagccgtgttggaaaccatccgccaactcgattccggcaaactgcgcgttgccgaacgtttgggcgtgggtgagtggaaagtcaacgaatgggcgaaaaaagccgtgttgctgtccttccgcatccaagacaacgaagtcctcaacgacggcgtgaacaaatacttcgacaaagtgccgaccaagtttgccgactggtctgaagacgagttcaaaaacgcaggcttccgcgcagttccgggtgcggttgcccgacgcggcagctttgtggcgaaaaatgtcgtgctgatgccatcttatgtcaacatcggcgcatacgtcgacgaaggcgcgatggtcgatacttgggcaaccgtcggctcttgcgcgcaaatcggtaaaaacgtgcacttgagcgggggcgtcggcatcggtggtgtactcgaacccctgcaggccgcacccaccatcattgaagacaactgcttcatcggtgcgcgttctgaaatcgttgagggcgtgattgtcgaagaaggcagcgtgatttctatgggcgtgttcatcggtcaatccaccaaaatctttgaccgtacaaccggcgaaatctatcaaggccgcgtaccggcaggttcggttgtcgtatccggcagtatgccttccaaagacggcagccacagcctttactgcgccgtcatcgtcaaacgcgtggacgcgcaaacccgtgcgaaaaccagcgtcaacgaattgttgcgcggcatctgatgccttaaaccgtatttgaaacgtccaatgccgtctgaaatccgcttcagacggcattgccgtttgcacgctgcaacgtgaaaacacagaaacagggacaatttgctataatcaacggtttagaacgaaccgaacactatttgaaggatacaaaatgggttttctgcaaggcaaaaaaattctgattaccggcatgatttccgagcgttccatcgcttacggcatcgccaaagcctgccgcgaacaaggcgcggaactggcgtttacctacgttgtggacaaactggaagagcgcgtccgcaaaatggcggcggaattggattccgaacttgtattccgctgcgatgtcgccagcgacgacgaaatcaaccaagtgttcgccgacttgggcaaacattgggacggcttggacggtttggtgcattccatcggttttgcgccgaaagaagccttgagcggcgacttcctcgacagcatcagccgcgaagcgttcaacaccgcacacgaaatttccgcatacagcctgcccgcgttggcaaaagccgcccgtccgatgatgcgcggcagaaattccgccatcgtcgccctgagctacttgggcgcggtgcgcgcgattccgaattacaacgtgatgggtatggcaaaagccagccttgaggcaggcatccgctttaccgctgcctgtctgggtaaagagggcatccgctgcaacggtatttccgccggcccgattaaaacgcttgccgcctccggcatcgccgatttcggcaaactcttgggacacgtcgccgcccacaacccgctccgccgcaacgttaccattgaagaagtcggcaataccgccgccttcctgctgtccgacctgtcgtccggcattaccggcgaaatcacttacgttgacggcggttacagcattaatgccttgagcaccgagggataatccgccgttttcaaatccgtgcgccgtccgtgccgcatatcggtttcgggcggcgttttgccgtctgaagcgtatttctagggaaatgcccgacttacggcaggcgggatgggaaatgcggacgcttgttttaaccgattgcctttgtgccgacttgctgcaggtgcagcggaaacggttcggatgcgaaaatgccgtctgaaacgccaaacgggtttcagacggcattttttatttaaagcatcagcacacttcaaccagccagccgtatttgtcttccgccaaaccatactggatgtcggtaatcgccttacggatggcatagccgcgttcttggcttttcacttcgatttctttgccgccgatgacgaaggaagtaacgggcgagatgacggctgccgtaccggtcaaaatggcttccgcaccgttttccaccgcagctttgagttcgtcaaccgtgaaattgcgttcgctgacggtatagcccaaatctttggcaaccgtcagtacggaatcgcgggttacgccgtgcaaaaactcgtcggtcagcggtttggtaatgatttcatcgccgttaatcaggataaagttggacgcgccggtttcctgcacgtcgccgttcgggcagaacaggacttgatttgcgccatattcggctttcgccttcagcacccagtgcatggcggaagcgtagttgccgccgcatttgacgcggcccatatgcggggcgcagcggatgtgttcggtttccaccaaaattttgacgggcgatccgactttgaaatagtcgccgacgggggaagccaaaatatacagcagggcggtttcggaaggagaaccggccttgccgataacgggatcggtaccgattaaggtcggacgcaggtacagggcggcaggcgcatcgggaatttcatcggcggcacgtttgaccaatttgattagcgcgtcaagataagcttcggtttcggggcgcggcaggtgcaaaatgtccgcactttgccgcatacgcgcgatattggcagtcggacggaacagcacgattttgccgtctgcctgacggaaggctttcagtccctcgaaacattcgctgccgtagtgcagggcgtgcgcgcccggtgcgagggagaggtcttgggaagattgccattcggtcggctgccatttgccttcgcggtaggcgaggacgggcatttgactgtgaaaaacgctgccgaatacggcgggtacgggtctgctcatgatgtaaagcctttcttattctgatatgtttcaatgaacggtttgaatttgaagattgtaaagatacgcctgcaaacagggttttgacaagtgcgcggcgggtttttctgtcgatgcggtgtccaatccgttatttttcaaatggaaaggaacggtgtatttggtaaaattgtcggcaatcgcatactccgtatgtcgtccgaacacgctgccgcatcctatccgaaaccgtgcaaatcgtttaaactagcgcaatcttggttcagagtgcgaagctgtctgggcggcgtttttatttacggagcaaacatgaaacttatctataccgtcatcaaaatcattatcctgctgctcttcctgctgcttgccgtcattaatacggatgccgttaccttttcctacctgccggggcaaaaattcgatttgccgctgattgtcgtattgttcggcgcatttgtagtcggtattatttttggaatgtttgccttgttcggacggttgttgtcgttacgtggcgagaacggcaggttgcgtgccgaagtaaagaaaaatgcgcgtttgacggggaaggagctgaccgcaccaccggcgcaaaatgcgcccgaatctaccaaacagccttaagaaagccgatatggacaacgaattgtggattatcctgctgccgattatccttttgcccgtcttcttcgcgatgggctggtttgccgcccgcgtggatatgaaaaccgtattgaagcaggcaaaaagcatcccttcgggattttataaaagcttggacgctttggtcgaccgcaacagcgggcgcgcggcaagggagttggcggaagtcgtcgacggccggccgcaatcgtatgatttgaacctcaccctcggcaaactttaccgccagcgtggcgaaaacgacaaagccatcaacatacaccggacaatgctcgattctcccgatacggtcggcgaaaagcgcgcgcgcgtcctgtttgaattggcgcaaaactaccaaagtgcggggttggtcgatcgtgccgaacagatttttttggggctgcaagacggtaaaatggcgcgtgaagccagacagcacctgctcaatatctaccaacaggacagggattgggaaaaagcggttgaaaccgcccggctgctcagccatgacgatcagacctatcagtttgaaatcgcccagttttattgcgaacttgcccaagccgcgctgttcaagtccaatttcgatgtcgcgcgtttcaatgtcggcaaggcactcgaagccaacaaaaaatgcacccgcgccaacatgattttgggcgacatcgaacaccgacaaggcaatttccctgccgccgtcgaagcctatgccgccatcgagcagcaaaaccatgcatacttgagcatggtcggcgagaagctttacgaagcctatgccgcgcagggaaaacctgaagaaggcttgaaccgtctgacaggatatatgcagacgtttcccgaacttgacctgatcaatgtcgtgtacgagaaatccctgctgcttaagtgcgagaaagaagccgcgcaaaccgccgtcgagcttgtccgccgcaagcccgaccttaacggcgtgtaccgcctgctcggtttgaaactcagcgatatgaatccggcttggaaagccgatgccgacatgatgcgttcggttatcggacggcagctacagcgcagcgtgatgtaccgttgccgcaactgccacttcaaatcccaagtctttttctggcactgccccgcctgcaacaaatggcagacgtttaccccgaataaaatcgaagtttaaccaccaccgaaaggaacacaaaaaatgcgcttactccatactatgctccgcgtgggcaatctcgaaaatccctcgatttctaccaaaacgttttgggtatgaaactgctccgccgaaaagattatcccgaaggcagatttacccttgccttcgtcggttacggcgatgaaaccgacagcacggttttggaactgacgcacaactgggatacggaacgatacgacttgggcaacgcctacggacacatcgcggttgaagtggacgatgcctacgaagcctgcgaacgtgtgaagcggcagggcggaaacgtcgtccgcgaagccggcccgatgaaacacggcacaaccgtgatagccttcgtcgaagaccccgacggatacaaaatcgagttcattcaaaagaaaagcggcgacgattcggttgcctatcaaactgcctgataccgccgccgccaatgccgtctgaagcctttaggggtttcagacggcattttgttgccgtcgacctgctgtttgagcctgtgccggttcaaactttatccgttacaccgataaggcaaaaaagatgccgtctgaaacggcatccttgatctgcgaaagggcagttgggaatcaaatacccaattcctgcgccaatgcttgggcacgtttgagtacgtcgccttccgcttcttccagcaatttctgcactgtctcggcagcggcatcgcggtcgccgatttcgagatacatttcggcaaggtcgtatttcgcttcggaaggcgcgtcagaacctacagattccgaagggaaactggtatctgcattatttgggatattttcttccgagaggtagatgctccaatctaccgtttcctcctcgccgtctttcaggaagtcgggcaaagcgtctgcctcagaggtgttggaatcaggcgtttccaaagtgatttccgctgcattttcctcaacggccggtgcttcagcaggttgcaacagtgcggacaaatcatcggcaacggtttccgctgcattttcctcaacggcaggtgcttcagaaggttgaagtaatgcggacaaatcgtctgcggtggcgttgaaatcgggtgtttcggcaacggtttccgttacattttcctcaacggccggtgcttcagcaggttgcaacagtgcggacaaatcatcggcaacggtttccgctgcattttcctcaacggcaggtactttagaaggttgaagtaatgcggacaaatcgtctgcggtggcgttgaagtcgggtgtttcggcaacggtttccgttatattttcctcaacggacggtgcttcggcaggttgaagcaatgcggacaaatcgtctgcggcggcgttgaaatcgggcgtttcaggcgcagtttccgcgacggcatcggtttcgtacactttcaggaaatcgtgcaactcttccggtgtttggacttcggcaactgttttttccaagatggtttcgggcgaggaagccttcaggaagcctgccagtccggagggtgaggcaggttttgcggaagctgtttcttctgtgccgatatggttgtttgagggcaggttgtcggagaaatcggtatcgacggtttccggtttgttttcggcagtttgggcgacagattccggttcgggcgtgtcgatgacgatttcgacagggttgtacgggttgaaggtctcgggctcgtacacgctgtctgtggattcgatggcgttccaatcggcatccgcgcgtttttgggtttcttcatcctgcgtaagtgcgccggataaaatgccgttttgcgcggctgccaggctgtcgaaatccaagtcgatgcggttggaaggcgtatcggtttcgacatcgaacgtttgttttgccgataactcttcttcagattccccatctaaggcaagtgtgtcgtttacatcgtttttcggagcgggttcgggcgttgccggagtttcgacttcggcaaaggtgatttctatgccgtcgtctgccgcgtcgtcaaggtcaggctcttcctcagggacggattcttcggtacggcgcgcgcgtttggattgggcaaggcgcaaaagcagcagcagggcgattaatgccgcgcctccgccggcaagcagcaaggtgtacgaaccgccgaacagaccgtcaaacagtccgctttcggtttcttcttcggcagaaacctgttcgacaggttcggaaacggcgttaccggtttcgtcggtcggcgtgtcgatggcagaagcggcggcttcttggggggcggattcggcagcggtttccgatgcggcagtatttgcagcgggtacaggttcgggtcgaacggccggtttttccgcttttgcttcgggcgcggcaacttttgcttcaggtttttcaaccggtttctctaccgttgcctgtttggacggttcggacggcatggatgcggtttcggctttgggtttcgccgtttgcggtttgggttgttccgctttgatcctgttcagattcggaatgtgaagcacgctgcccgcacgcagtctgccgtgtgcggaaacatttgggtttgccttcagcagcgcatcggcaacctgttcgagcgtcaggtgtttcgggcggatggcggcggcaatctgtttgaccgtttcgcctttgcggacggtatgggttttgccgttgtatgccggtttgacggctgcgttcgcgctgtcttttttatcggttttgcggagggctttggcgttttgattttcttgggactctgctgtcggagcggttttgcggtgtgtcttgccgtctgaaagtgcagatttggttttgggcgagtagccgacaggatcgaggatggcggtgtattcgcgtacctgtgcgcctgcgccgatgcggaacaccaggacgggatcgcggactgcctgttcggaagaaacggcaatgacggctttgtcgcccaacttgtggactttggcggtcaggcctttttcggaaacggtaacgctgccgccgcctagcagggctttggcttcttcgccggttacggtaatgctgccggaaaagggttcgtcaaggttggactggatattcagtccgcccagtccagcatgtgcctgaaaggatgcggcaactgcgacggaggcggcaatcagtttgatttgtctgttgtttttcaagatgtatcccctgtgggttggcggctgaatacggtttgaccgcgtacagtctgtaaatttcgtcatcatcgggcatcggcggggcagtcggccggcgggcatttaatatgtgaatgtaccgaccgccgccacattttaaacggcaatcattcgccgtttttacaaattatgacatatctccatcttttttcaaaaacatctgtgcatatttgcatcaatcaaaacaaaatttgttggttttgcaggtgcaaaaacagggttctgcctgtatgattagcgtttatttgatttgctttctcatttggatatgaaattcgtcagcgaccttttgtccgtcatcctgtttttcgccacctataccgttaccaaaaacatgattgccgcaacggcggtcgcattggttgccggtgtggttcaggcggcttttctgtattggaaatataaaaagctggatacgatgcagtgggtcggattggtgctgattgtggtattcggcggcgcaaccattgttttgggcgacagccgcttcattatgtggaagccgagcgttttgttttggctgggcgcgctgttcctgtggggcagccacctcgccggtaaaaacggcttgaaggcgagtatcggcagggagattcagcttccggatgccgtatgggcgaaattgacgtatatgtgggtcggtttcctgatttttatgggtatcgccaactggtttgtgtttacccggttcgagtcgcaatgggtcaactataaaatgttcggctcgactgcactgatgcttgttttctttattattcagggtatttatctgagtacctgtctgaaaaaggaggattgactgtggaatattttatgttgctggcaacagacggggaggatgtgcacgaggcgcgtatggcggcacgtcccgaacacctcaaacggctggagacgctgaagtcggaaggccggctgttgacggcaggcccgaatcctttgccggaggactccaaccgcgtttcgggcagtttgattgtggcgcagttcgagtctttggatgcggcgcaggcttgggcggaagacgatccctatgttcatgcaggcgtgtacagcgaagtgctgatcaagccgtttaaagcggtgttcaaataatgccggccgtcgatttgatccgcgaacgcctgcagacgctcgatccgctggtgttggaaatcggcgatgagagccatctgcacaaaggacacgcgggcaataccggcggcggacattatgccgttttggtcgttagcggccgttttgaaggcgtaagccgcctgaaccgccagaaaacggtcaaatcgctgctcaaagatttgttttcaggcggcatgattcacgcgctcggcatccgggcggctacccctgacgagtatttccatacggcggactgaatgaagtctgcccgaacatttcaatttaaaatttaaagagagaagattatgaaagcaaaaatcctgacttccgttgcactgcttgcctgttccggcagcctgtttgcccaaacgctggcaaccgtcaacggtcagaaaatcgacagttccgtcatcgatgcgcaggttgccgcattccgtgcggaaaacagccgtgccgaagacacgccgcaactgcgccaatccctgctggaaaacgaagtggtcaataccgtggtcgcacaggaagtgaaacgcctgaaactcgaccggtcggcagagtttaaaaatgcgcttgccaaattgcgtgccgaagcgaaaaagtcgggcgacgacaagaaaccgtccttcaaaaccgtttggcaggcggtaaaatatggcttgaacggcgaggcatacgcattgcatatcgccaaaacccaaccggtttccgagcaggaagtaaaagccgcatatgacaatatcagcggtttttacaaaggtacgcaggaagtccagttgggcgaaatcctgaccgacaaggaagaaaatgcaaaaaaagcggttgccgacttgaaggcgaaaaaaggtttcgatgccgtcttgaaacaatattccctcaacgaccgtaccaaacagaccggtgcgccggtcggatatgtgccgctgaaagatttggaacagggtgttccgccgctttatcaggcaattaaggacttgaaaaaaggcgaatttacggcaacgccgctgaaaaacggcgatttctacggcgtttattatgtcaacgacagccgcgaggtaaaagtgccttcttttgatgaaatgaaaggacagattgcgggcaaccttcaggcggaacggattgaccgtgccgtcggtgcactgttgggcaaggcaaacatcaaacctgcaaaataattctgaaaacgggatatggcggcaagacgttcagacaggcgttttgccgccgcgcaggacagggaataccatgaaacagaaaaaaaccgctgccgcagttattgctgcaatgttggcaggttttgcggcagccaaagcacccgaaatcgacccggctttggtggatacgctggtggcgcagatcatgcagcaggcagaccggcatgcggagcagtcccaaaaaccggacgggcaggcaatccgaaacgatgccgtccgccggctacaaactttggaagttttgaaaaacagggcattgaaggaaggtttggataaggataaggatgtccaaaaccgctttaaaatcgccgaagcgtctttttatgccgaggagtacgtccgttttctggaacgttcggaaacggtttccgaagacgagctgcacaagttttacgaacagcaaatccgcatgatcaaattgcagcaggtcagcttcgcaaccgaagaggaggcgcgtcaggcgcagcagctcctgctcaaagggctgtcttttgaagggctgatgaagcgttatccgaacgacgagcaggcttttgacggtttcattatggcgcagcagcttcccgagccgctggcttcgcagtttgccgcgatgaatcggggcgacgttacccgcgatccggtcaaattgggcgaacgctattatctgttcaaactcagcgaggtcgggaaaaaccccgacgcgcagcctttcgagttggtcagaaaccagttggagcagggtttgagacaggaaaaagcccgcttgaaaatcgatgcccttttggaagaaaacggtgtcaaaccgtaatggcatttccaataccgatgccgtctgaagcctttcagacggcattgcacgttcaggtaaggaggacggcttatgcgtgcggtcatacagaaaacggtaggtgcaaaggtggatgtcgtgtccgaagccggcacggaaacctgtggcaaaatcgacggcgggtttgtcgtgttactcggcgtaacgcatagcgacacagaaaaagatgcacgctatatcgccgacaaaatcgcccatttgcgcgtgtttgaagacgaagcgggcaagctgaacctgtctttgaaagatgtcggcggcgcggtgctgctggtgtcgcagtttacgctttatgccgacgcggcaagcgggcggcggccttcgttttcccaagccgcacctgcagaacaggcgcagcagctttacctgcgaacggcggaactgttgcgcggacacgggattcatgtcgaaacagggcgtttccgcacgcatatgcaggtgtcgctctgcaacgatgggccggtaaccatactgctggactctttcatgacgcggatttccccaaaaatgaaggttgttccggattgaaattgaatccgcaatgataaaatatcgacaatgaacgacaatacacacacccttcccccgcgccacctgtccgtcgcccccatgctcgactggacggacaggcactaccgttaccttgcccgccagattacccgaaatacttggctgtacagcgaaatggtcaatgccggtgcgattgtttacggcgacaaagaccgctttttgatgttcaacgaaggcgagcagcccgtcgccctgcaactgggcggcagcgatccgtccgatttggcgaaagccgccaaagccgccgaggcatacggttacaacgaggtcaacctcaactgcggctgccccagtccgcgcgtgcagaaaggctcgttcggcgcgtgtctgatgaacgaagtcgggctggttgccgactgcctcaacgccatgcaggatgcggtcaagattcccgttaccgtcaaacaccgcatcggtgtggacaggcagaccgaataccaaaccgttgccgatttcgtcggcacgctgcgcgacaaaaccgcctgcaaaacctttatcgtccacgcccgcaacgcttggctggacggtctttcccccaaagaaaaccgcgacgttcccccgttgaaatacgattacgtttaccgcctcaagcaggagtttcccgggctggaaatcatcatcaacggcggcatcaccaccaacgaagcaatcgcaggacacctgcaacacgttgacggcgtgatggtcgggcgcgaggcgtaccacaacccgatggtgatgcgcgaatgggacaggctgttttacggcgatacccgcagcccgattgaatacgccgatttggtgcagcgtctctacacatacagccaagcccaaatccaagccggacgcggcacaatcttgcgtcacatcgtccgccacagccttgggctgatgcacggtctgaaaggcgcgcggacttggcggcgtatgctttccgacgcaacgctcttgaaagacaacgacggcagcctgattctcgaagcgtggaaagaggtcgaacgggcaaatatgcgcgaatagggcggggctgtatgtgtgaaatgccgtctgaaggcttcagacggcatttgtgcgtttgtcgggcggtgtttagggggcggtaacggcgtgtttcggcactttgtccatatcccagtgtgccaccgcccagtcgagcagttcggcagggcggtcggtttccggtgcttcgggcagcttgaggtaacggaacacttggcggaggagttgttcgcggcggtttaaatccaatgcgggggcgagcgtctgtttcgaccatttctgcccttgtgcgttggtcagcagcggcaggtgggcatattgcggtgtcggaacgtccaaacactgctgcaaatagatttggcgcggcgtggaaacgagcaggtcttgtccgcggacgatgtgggtaacgccctgttcggcatcgtcggcaacgacggcgagctggtatgcccagtaaccgtctgcacgaagcaggacgaaatcgccgatgtcgcgggcgaggttttgggcgtaaccgccgacgatgccgtctgaaaaaccgataatgcggtcggggacgcggatgcgccacgccggctgtttgccttgcagtgcagggcgttggccggggtggcggcaacgtccgttatagacgaacccgtctgcgccccgccttgccccggcctgccagtctttgcggctgcaatggcagggatagaccagtccggcggttttcaggcggcatagggtttcttcatacagggcgtaacggcggctctgataggcgacttctccgtcccactcgaatccgaatgcctcaagcgtgtgcaggatatggcttgccgcccccggcatttcgcgcggcggatcgaggtcttccatgcggatcagccatttgccgccgtgcgcgcgcgcatcggcataggaagcgacggcggtcagcagcgagccgatgtggagcagcccggtcgggctgggggcaaaacgtcctgtgtacatatctggtacagcccctttatttaagactattaatcaaagccattatctcatctttattcagttccatcccgggctcttcaagcaaggttaaatcatatagggcattatattgctcttcggtagctgaaccatccataagagcaggcgagaaaaaatcaaaggctctatctgcaattctctcattacttgcatttctactaaccagtttcgtcaattctgtatattttgaaaagtttatggaaaaataaaacagcgaaaaagttttggtttcgctgtttttgatttaattagcactgataatcttcaaattcccacgaaaaaaaacgaagtaaataagtcaatgacttttcccaagtttcttttgaacattctttaagaattttctcaatttccgatttaataacagaatgattaaattcattcataatcatcatacccgccccccatttaaccctttgattttggaaacaattatgcaaaatccatttaggagagcatatgcgaacagaaaatatatctgcagcatcactatcatcagttcctatgtctaaatcaattcccacacaaaaattgtctttgatttcgggaacgaaatcttcaaaggcacaatcgtaaagattgatggctttcaattctaggttaatcattttatattcaatagtatggggaggtaccggatccttaaaaatcagatctgaataaatttcattgggtgaaatgatttcgattgcttttgccatgattctatttccttttgtgttagtgggtaatgtcgtgcattaacttcttgcccattaatatttttagggtgaatccttgatatgccgcactgtgtccggtcaaacgggcgatgccgtctgaaagcctttcagacggcatcgggaaaatgcctaagccaaaggcgcgagcagtttttcaaacgcttcttcaaactgtttcaaaccgtcttcctgcaaacgcgttgccaaggtttcgacatcgatgccgagcgcggcggtttcggcgagctgcgcttgtgcttcttctacgccttcggtcagcgtggctttggctgtgccgtggtcgataaaggctttgagcgtggcatcgggaacggtgttgacggtgtgcgcgccgatcaggctgtcaacgtagagcgtgtcgggataggccgggtttttcacgccggtagatgcccataaaagctgcacgcggtttgcgcctttggtttccagcgcggcaaattcggggctgccgaagtattgcgcccagtcttggtaggcggctttggcaagggcgatggcgattttgcctttgaggtggtcgggcagtgttgtgtccagcgcgccgtccacacgggagatgaagaagctggcgacaacttggatatgggcaacgctttgtccggctgctaagcgtttggcgatgccgcgcgcgtaggcggcgtaggctttgagggtttgggcgcgtgagaacagcagggtcaggttcacgctgatgccgtctgaaacgagggtttcgagcgcatcgatgcctgcgtcggtggcaggcactttaatcatcgcgtttttgcacccgatggcggcgtagaggcggcgcgcttcttcaaccgtgccttgcgcgtctttggacaattcgggcgaaacttcgaggctgacgaagccggttttgccgccggtggattcgtgttcggcaaggcaaacgtcgcaggcggcacgcacatcggcaaccgccattgtttcgtagcgttgtttggggctgaggttttgctgcttgagggcggcgatttcatcggcgtaaagcgcgtcgccggcgaaggctttttggaagatggcgggattggaagttacgccgcacacgccctgtttcaacatttgcgccaattcgccgctttgcactagcgagcgggaaaggttgtccagccagatttgttgtcctaatgctttaacgtccgataaaatggtcatctctgattcctttggatggataggcggggtttgagggcttatgctaccccgattcggaaattttgggtagttttattacagcaaaggcggatggcaatggcagaaaacggaaaatatctcgactgggcacgcgaagtgttgcacgccgaagcggaaggcttgcgcgaaattgcagcggaattggacaaaaacttcgtccttgcggcagacgcgttgttgcactgcaagggcagggtcgttatcacgggcatgggcaagtcgggacatatcgggcgcaaaatggcggcaactatggcctcgaccggcacgcctgcgtttttcgtccaccctgcggaagcggcacacggcgatttgggtatgattgtggacaacgacgtggtcgtcgcgatttccaattccggcgaaagcgacgaaatcgccgccatcatccccgcactcaaacgcaaagacatcacgcttgtctgcatcaccgcccgccccgattcaaccatggcgcgccatgccgacatccacatcacggcgtcggtttccaaagaagcctgcccgctggggcttgccccgaccaccagcaccaccgccgtcatggctttgggcgatgcgttggcggtcgtcctgctgcgcgcacgcgcgttcacgcccgacgatttcgccttgagccatcctgccggcagcctcggcaaacgcctacttttgcgcgttgccgacattatgcacaaaggcggcggcctgcctgccgtccgactcggcacgcccttgaaagaagccatcgtcagcatgagtgaaaaagggctgggcatgttggcggtaacggacgggcaaggccgtctgaaaggcgtattcaccgacggcgatttgcgccgcctgtttcaagaatgcgacaattttaccggtctttcgatagacgaagtcatgcatacgcatcctaaaaccatctccgccgaacgtctcgccaccgaagccctgaaagtcatgcaggcaaaccatgtgaacgggcttctggttaccgatgcagatggcgtgctgatcggcgcgctgaatatgcacgacctgctggcggcacggattgtatagtggattaacaaaaaccagtacggcgttgcctcgccttagctcaaagagaacgattctctaaggtgctgaagcaccaagtgaatcggttccgtactatctgtactgtctgcggcttcgtcgccttgtcctgatttttgttaatccactatataaggcgttgcagccgtttcagacggcatttgtggtaagatatgccgtctgaaaacaaggaaatcccatgcaggcaatttctcccgaattacaggcgcgcgccgccaaaatcaaactgttgatcctggatgtggacggcgttttgaccgacgggcgcatctttatccgcgataacggcgaagaaatcaaatcgtttcacacactggacggacacggtctgaaaatgcttcaggcaagcggcgtgcagactgcgattatcacgggccgggacgcgccctccgtcggcatccgcgtcaaacagttgggcataaattactatttcaaaggtatcagcgacaaacgtgccgcctatgaagaattgcgcgcgcaggcgggcgtggaagaagccgagtgcgcctttgtcggcgacgacgtggtcgatttgccggtaatggtgcgctgcggattgccggttgccgtccccggcgcgcattggtttacgcggcaacacgccgcctatatcacggaacacgcgggcggcgcaggcgcggtgcgcgaagtgtgcgacctgattatgcaggcgcaagggactttgggcgcggctttgaacgagtacatcaaatgaaagtaagatggcggtacggaattgcgttcccattgatattggcggttgccttgggcagcctgtcggcatggttgggtcgtatcagcgaagtcgagattgaagaagtcaggctcaatcccgacgaaccgcaatacacaatggacggcttggacggcaggcggtttgacgaacagggatacttgaaagaacatttgagcgcgaagggcgcgaaacagtttccggaaagcagcgacatccattttgattcgccgcatctcgtgttcttccaagaaggcaggttgttgtacgaagtcggcagcgacgaagccgtttaccataccgaaaacaaacaggttctttttaaaaacaacgttgtgctgaccaaaaccgccgacggcaaacggcaggcgggtaaagttgaagccgaaaagctgcacgtcgataccgaatctcaatatgcccaaaccgatacgcctgtcagtttccaatatggtgcatcgcacggtcaggcgggcggcatgacttacgaccacaaaacaggcatgttgaacttctcatctaaagtgaaagccacgatttatgatacaaaagatatgtaagctatttgttttaatagcatttttttcggcgtcccccgcttttgcccttcaaagcgacagcaggcagcctattcagattgaggccgaccaaggttcgctcgatcaagccaaccaaagcaccacattcagcggaaacgtcgtcatcagacagggtacgctcaatatttccgccgcccgcgtcaatgttacacgcggcggcaaaggcggcgaatccgtgagggcggaaggttcgccagtccgcttcagccagacattggacggcggcaaaggcacggtgcgcggacaggcaaacaacgttgcttattcatctgcaggcagcaccgtagtcttaaccggtaatgccaaagtacagcgcggcggcgatgtcgccgaaggtgcggtgattacatacaacaccaaaaccgaagtctataccatcagcggcagcacaaaatccggcgcaaaatccgcttccaaatccggcagggtcagcgtcgttatccagccttcgagtacgcaaaaatccgaataatcccaaaatgccgtctgaaatataaacccggttcggacggcatatgccgaccgaagatattgaagagatatttatgagtgcaaacgtcagccgccttgttgttcaaaacctgcaaaaaagtttcaaaaaacgccaagtcgttaaaagcttctccctcgaaatcgaaagcggcgaagtcatcggactgctcgggcccaacggtgcgggtaaaaccaccagcttctacatgattgtcggactcatcgccgccgacgcaggcagcgtaaccctagacggacaagaattgcgccacctgcccatacacgaacgcgcccgcctcggtgtcggctacctgccgcaggaagcctcgatattccgcaaaatgaccgtcgaacaaaacatccgcgccatcttggaaatcagaaccaaagataaaaatcaaatcgacagggaaatcgaaaaactgctcgccgacctcaatatcggacacttacgccgcagccccgcgccgtcgctgtccggcggcgaacggcggcgcgtcgaaatcgcccgcgtactcgccatgaaaccgcattttattttgttggacgaaccttttgccggcgtcgatccgattgccgtcatcgacatccagaaaatcatcggtttcctcaaatcgcgcggtatcggcgtactgattaccgaccacaacgtacgcgaaaccctcagcatctgcgatcgggcctacattatttcagacggcacggtgttggcatcgggaaaacctgatgatttggtcggaaacgaacaggttcgttctgtttatctgggtaagaacttcaaatattgaaaatatttttcagacgggcgacctaatatcgtcgggcaggcggcaaaaatacggatttatgttgtttttacataaattaattcaaatttaaaacattgacttaaacctgttttcaaagaatattgcccgatatgcttgcatgtcgtcccgtaatttggtttaatacgcatctcttaacgagacagacaaaggccagatagctcagttggtagagcaacggattgaaaatccgtgtgtcggcggttcgattccgcctctggccaccaaaaaaccgccttgaagcggttattttttttgcctgccgtttttgggaagttgtccgtgtcggacacgttttgtgtctgaccgttatgtagaagggcaaaaatgataatgaccgccccgttgcgttttggagaagagggtaaaggcagaaagcatatgccgtctgaatgatatttcagacggcattttatattgcggcggcactcagtccgtgtcgctttcaggcaactctgccgaacccatgcgtttgagcacgatattggttttgttgcggagccgtttgcttttcggatggtcggcgtagtagagcggggcggggacgcgcgccgtcagttttgccgcctgctgtttggtcagcttggcggcgggtatttgataaaaataccgggacgcggcttccgcgccgaaaacgccgtagtgccattcgattgagtttaaatacagttcaaaaatcctgtctttgtcggtaacggcttccatcatcgcggtaatcgccgcttcttcgcctttgcggatatagctgcggctttcgtttaaaaacaggtttttggcaagctgctggctgatggtcgagccgcccgccttcactttgccgctgttccggttgcgcctgatggcgttttgaatgccgccccaatcgaagccgccgtgcccggcgaaacgggcatcttcggaagcaatcagggcttttttcaggttggtggaaatgcgtttgtagggcatccagcggtaatccagtgcgacatcgcgaccttcctgttcaaactgcttcatccgcatcgacataaaggcagtccgatggggcgcgacggcgcggtaggtaatgatgttgccgtacacataggcattgaaaaagataaagatgccgacgggcagggcaatcagccatttgatgatgcggaacatgtttatagggctttcatgtattcgataacggggcggatatcgggcgtaaatccgcgccagagggcgtaggaagccgccgcttgaccgactagcatacccagtccgtcggcagtttttttcgcacccgattgtcgtgcaaaatctaaaaacggttttgccgcgcagccgtacaccatatcgtaggcaagcgcgcagttttgaaaaatatcgggcggaatatcgggaatctgaccgtttagaccgcccgacgtgccgttgatgatgatatcaaaaccgccgttcacgtccgccatcgggacggcttcaatgccgaaaagctgcgccaattcctcggctttggcgcgggtacggttggcaatgacgatacgggcaggacggtgttctttcaaaacaggaatcacgccgcgcaccgcgccgcctgcgcccaaaagcaaaatggttttgccctcgatggcaatatttttgacctgcgtgatgtcgttggtcaaaccgataccgtcggtgttgtcgccacgcagcttgccgtttttcaacggaatcagcgtattgaccgcacctgccgccaatgcgcgttcggaatgctcgtccgccagatgaaacgcttcctgtttgaacggtacggtaacgtttgccccgcaaccgcctgtttcaaaaaatgtcgaaaccgcctgcgcgaaaccgccgatgtcggcgcaaatgcgttcgtattcaatgtcaacgccttcctgaagggcaaattgttgatgaatttgcggcgatttgctgtgggcgacggggttgccgaaaacggcgtagcgggggagggcggtcatggtcgtgttccaaaagacgggaaggctattttataacggcggcgtacagatggaaacgatgccgtctgaaaccgccttcagacggcatcgtttcctgtatcggtcgggaaaaatccggatgcggtgcgccggcttgtccgcattgttgacaatcttgccgtctgaaactatattttccggcttgaaatttgacgcaaaaccggtttcagacggcatcggcgtggtaaaatcgtgccgactttgcgtcaagccgccgcgttccgcatattttgctatttcccttttccaggagctgaaaaatgtctattaaaaacgccgtaaaattgattgaagaaagcgaagcccgctttgtcgatttgcgctttaccgataccaaaggcaagcagcaccactttaccgtgcctgcgcgcatcgtgttggaagaccccgaagagtggttcgaaaacggtcaggcgtttgacggttcgtctatcggcggctggaaaggcattcaggcttccgatatgcagttgcgccccgatgcgtctacagccttcgtcgatcctttttatgatgatgcgactgttgtgttgacttgcgacgttatcgatcccgccgacggtcagggttacgaccgcgacccgcgctccatcgcccgccgagccgaagcctatttgaaatcttccggcatcggcgagaccgcctatttcggtcccgaacccgagtttttcgtattcgacggcatagaatttgaaaccgatatgcacaaaacccgttacgaaatcacgtccgaaagcggcgcgtgggcaagcggtctgcatatggacggtcaaaacaccggccaccgcccgaccgtcaaaggcggttacgcacctgttgcaccgattgactgcggtcaggatttgcgttcggcgatggtaaacattttggaagaactcggtattgaagtggaagtgcaccacagcgaagtcggcaccggcagccaaatggaaatcggcacgcgctttgctactttggtcaaacgcgccgaccaaacccaagacatgaaatatgtgattcaaaacgttgcccacaacttcggcaaaaccgccactttcatgcccaaacccattatgggcgacaacggcagcggtatgcacgttcaccaatccatttggaaagacggtcaaaacctgttcgcaggcgacggctatgccggcttgagcgacaccgcgctctactacatcggcggcatcatcaaacacgccaaagccttgaacgcgattaccaatccgtccaccaactcctacaaacgcctcgtgccgcactttgaagcgccgaccaaactggcatactccgccaaaaaccgttccgcttccatccgcattccgtccgtgaacagcagcaaggcgcgccgcatcgaagcgcgtttccccgatccgaccgccaacccgtatttggcatttgccgccctgttgatggcgggtttggacggcattcaaaacaaaatccatccgggcgaccctgccgataaaaacctgtacgatctgccgccggaagaagatgcattggtgccgaccgtttgcgcttctttggaagaagcactggccgccctcaaagccgaccacgaattcctcctgcgcggcggcgtgttcagcaaagactggatcgacagctacatcgctttcaaagaagaagacgtacgccgcatccgcatggcgccgcacccgctggaatttgaaatgtattacagcctgtaagcacgtctggttttcagaaaagcaatgccgtctgaacacagtttcagacggcattttgcatttgaacggcaaaccggcggcgcggggcggcatttttcagcaggcgggcgatatttgctacaataggcttttgttttttttgggctgcacgaacgatgactgcatcgaaatcaggttttatcgggcaaatcttttcccgcaatatgcttgtctgtatttttacggggtttacctcggggctgccgctgtactttctgattaacctgattccggcgtggttgcgcagcgagcaggtggatttgaagagcatcgggctgatggcgttaatcggtctgccgtttacttggaaatttttgtggtcgccgctgatggacgcggtcaggctgcccgttttgggacggcggcgcgggtggatgctgctgacgcaggcagggttgctggcggctttggcggtctatgcctttttaaacccccgtaatcatctgccgctgattgccggcttgtcggtgcttgtcgcttttttttccgccagtcaggatattgtattggatgcgttcaggcgcgagattttgtcagacgaagaattgggtttgggcaactcggttcatgtgaacgcctaccggattgccgccctgattcccggttcattgagtttggtgttggcagacaggatgccgtggttagaagtatttgttatcacttcattatttatgctgcccggccttctgatgacgctgtttcttgcgcgcgaacccgtgttgcctcctgccgttcctaaaacgttgaagcagaccgtggtagagccgtttaaagaattttttacgcgcaagggcatcgcttcggcggtgtgcgtgctgctgtttatcttcctttacaaactcggcgacagtatggcaaccgcgttggcaacgccgttttatctggatatgggtttcagcaagaccgacatcggtttgattgcgaaaaatgcaggactgtggccggcagtggcggcaggtatcttgggcggtgtgtggatgctgaaaatcggcgtaaacaaagccttgtggctattcggcgcggtgcaggctgtaaccgttttggggtttgtatggctggcagggttcggacctttcgacacggtcggcacaggcgagaggctgatgctggcggcagttatcggcgcggaagcggtcggcgtggggttggggacggcggcgttcgtatcgtatatggcgcgtgaaaccaatcccgcatttaccgcaacgcagcttgcgctgtttaccagcctgtccgccgtcccgcgcacggtcatcaattcctttgccggttatctgattgaatggctcggttatgtaccgtttttccaactgtgtttcgcactcgccctaccgggtatgctgctgctgctgaaagttgcgccttggaacggggagaaaactcaggatgcaggcagatgaacgcgtcaaactggagcgtttacctgatattgtgtgaaaacagcgcgttctattgcggcatcagcccgaatccgcaacagcggcttgccgcccacacaaccggtaaaggcgcgaaatatacccgcgtattcaaaccggtggcgatgcgtatcgttgcaggcgggatggataaaggaacggcactcaggcaggaaatcgccgtcaaaaaactgaccgccgcacaaaaacggcaattgtgggagcaggcagaaaaaatgccgtctgaaacctgacggttcaggttcggacggcagttggcagcaatcagggaaaagcggggcaggcggtaaggaaaaccgacgtttcaacacacaggacggtacataaagcgtcgccctatgaaagtgaaggcatatatcagtattttttatacgccaacagaaaagaatacgatgaactgtttgttggatttgtattgattaatcagtatattttttatgccggggtatttttccttatcggtatcccttcttttatgaggatgcctgccgctcatataaagaacgggaaaatacgatgggaaaatacggtacagccctcgacatcgcacaatatgtcaacttatagtggattaacaaaaatcaggacaaggcgacgaagccgcagacagtacagatagtacggcaaggcgagacaacgccgtactggtttttgttaatccactatatttgtttgttttatattgtaagtatacgtataggctttgtaaaggtaaattgtgaaaaaagcagttttttaaacgaatgaaacggcttcgggctgaaatatatgctgatgccctgtccttcccgtatatcttgtgtgttgtcaaagtgcaggctgctttgaaatcggtattgccatctatgaaccaccactttgttttatttcagcgggcttgagatgtgtataagaatattgttttgaataaatttaaaaaaatgataatcgttattgaagatttttaaaggaaagcgtagagtgccaattctatgaagcaatacggtaagtaacaatgaaaatatctactgcttgggtatagagcatatttcacaacccgtaactattcttgcggaaacagagaaaaaagtttctcttctatcttggataaatatatttaccctcagtttagttaagtattggaatttatacctaagtagcaaaagttagtaaattatttttaactaaagagttagtatctaccatgaatatattctttaactaatttctaagcttgaaattatgagaccatatgctactaccatttatcaactttttattttgtttattgggagtgtttttactatgacctcatgtgaacctgttaatgaacaaaccagtttcaacaatcccgagccaatgacaggatttgaacatacggttacatttgattttcagggcaccaaaatggttatcccctatggctatcttgcacggtatacgcaaaacaatgccacaaaatggctttccgacacgccagggcaggatgcttactccattaatttgatagagattagcgtctattacaaaaaaaccgaccaaggctgggtgctcgaaccatacaaccagcagaacaaagcacactttattcaatttctacgcgatggtttggatagcgtggacgatattgttatccgaaaagatgcgtgtagtttaagcacgactatgggagaaagattgcttacttacggggttaaaaaaatgccatctgcctatcctgaatatgaagcttatgaagataaaagacatattcctgaaaatccatattttcatgaattttactatattaaaaaaggagaaaatccggcgattattactcatcggaataatcgaataaaccaaactgaagaagatagttatagcactagcgtaggttcctgtattaacggtttcacggtacggtattacccgtttattcgggaaaagcagcagctcacacagcaggagttggtaggttatcaccaacaagtagagcaattggtacagagttttgtaaacaattcaagtaaaaaataatttaaaggatcttattatgaatgagggtgaagttgttttaacaccagaacaaatccaaaccttgcgtggttatgcttcccgtggcgatacctatggcggttggcgttatttggctaatttgggtgaccgttatgcggatgatgctgctgcaattgtcggtaaggatgcaaacttaaatggtttgaatttatggatgaaaaaaggggtggaaaacctatgggatgatacggtcggtaaaaagacccgtttaatgtgtatttccgttttttggattgtggttttcaatttgtagcgaatcggattcggcatatacggcattgcaaaaagcgtttgactctccaatgccgtctgaaaaccggtttcagacggcatttgcgttcagtgagaaaggtcgcgcctgccgcccgaacgtctcgccgcagcctctgcataacggcgcacctctttttccaaattttccaagttcaaaggaaaatcaggcagtctgtctccctgtttctcttcgcggacaatccgcccgccatccaaataccacgtctgttgcgcatgataggtctgcatatccgccgttacgccatccgctttcaatgctaccgtcgaagattgtgcaataaaaagatttccgtttttcaaataatattcgaaactctggcgtttttttccattgtcgaaactccaatagactttttgcggcagaccgtccgcatcatagccgaccacaagactgttcgccttcatccctcggggcatcaattcccgcatattctgataaaacacagaattgcgcgagtccgacgcaattcggttgctctctttgcggaagtcccaaaccttctgctcgtcattcgcgacatcccggtatttcgccaaatatacctgggccatctgataacacccgaggcaatgctcataaacatcttccccgattttcccgcgccccgccgcatcaaataccgaaccgtctggttgccaaacaacccgatattctcctgtcgtttcataattttccccgtgaaccgttccgccgtacacatttacagaaaacggacgatcgttccgatacagatattcggcattaacaaatgcttccggcgagcgttgcgaaagcgaaaccgcaaccaaaccgccctcgccgatatggtaatccagccaaacctctttcccatgttcctgctccgttacgtgaaaccatttcgccttttctttcaaacgactgagccggatagcgagcgcgagataatccttctccgactgcaacggaccgtcatccacagttccggcaagattttcctccgtccttatcgattccttcacgatgacaaccgccctgtcggcatttcggaacaggcgggcaagtttcgccacaaaagcattcggatttttaggtacttcagttgccgtatcgctcaaaaaccaacgcggattaatctcataggcaatacccgttcccagccaaaaggcaaatacaagtgcaaaaaatgacaacagtaccggtttgaattttttaaacatatttatttttcgtttaacagaatatatcgattatatcagacgagctttgattgccgggttttgctattttttgttgtaataatcaaattgcacgttgactatgtctttctcggtaaaaatataacggagcattgttttaagcctttcataacgttcattaattcctacgctatcaggtagccaaggggaagctttaatttcaaaaagtttccaatttggaaccattaagaaatcaataatggtaccgattccaatgacaacatatcttggtatgtccatcggataaggatatttttttctaacctcgattaaatcattctccaacttccaatattcttcatcatcccacaccccgtcatcataccatttgccaataaatgaattttcgtcatacccctcaaaacaagtaatatttcttctgaagttttttaactcacacataatacacataataattaatctccaatacgatttaggtttttatcaaatgtaccgtttcttgtttcttttctgtaatgttattcatcgtagtaaggttctgttgaataattgtctttgcccccggcaatgatagtaacaattttcccttttgcttcccaagcttgtactcctatttcatcaaactcatagacatatgtcggataagattcatttgataaataatatttatcaacaccgtatgatttagggtaatggaaaagctgtttaaaatcttcaaaattcagacctattatattaacgcccataaaatatagctcctgataacaaaatatcgaaataattttgtttttttttttgacggaaatgagtaaatttgagtcgggagattcataatattctgttctaaactcatcaggaggttcatacataaaagtttccagtatgtttttgtactgtgttatatccgcaccaaaacggaatattcctacagaagtaaaaggtaaaaattcgggagttttaacgaccgcgtcgaccatgctcttctccttttgtttttcgattggcatttttggcaatatttctgattttttgcttaatctttaagcgttcatttttggacattccgggaataattttatttgttaattcagcaatttttgattccgctgatatttgacttcgaccgccatctccatgtttttcattcttggagcttcctgttcttttaggcggacaagaattatgaacccaaaccccttccgtttccgcctgattacccttgacgaagtaagtatgccaatcggcaacggtcagattgtaggctttgagcggttttggtttgacaacggttttgcggacggtttgggttctgccgctttcggataacagcctgcttcccgctttcaaatcttccgctttaatccatttgccgtccgaataaaacggatggatgcggttggaaatcaggatttggctgttgccgatgccgtctgaaagccggatatcgcttcagacggcattttgattgccgggttttgctattttttgttgtaataatcaaatcgcacgttgactatgtctttctcggtaaaaatataacggagcatcgttgtgaatctttcataacgttcatgaattcccacactatcaggcaaccaaggggaagctttaatttcaaaaagtttccaatttggaaccattaagaaatcaataatggtaccgattccaatgacaacatatcttggtatgtccatcggataaggatatttttttctaacctcgattaaatcattctccaacttccaatattcttcatcatcccacaccccgtcatcataccatttgccaataaatgaattttcgtcatacccctcaaaataaggaacgtttcttataatatccttgaactcacacataataatgtatctccaatataattaaacttttcgtctcaatctacctttactatgttgtattggaaagtaaaaaaatttccagtcctctacatctagatcagtaaaaatataacggagcattaccctgaacctttcataacgctcattaattttgacacttttaggcaaccaagtagaagctttaatttcaaaaagtttccaattttgaaccattaaaaaatcaataatggtaccgattccaatcacgatgtcccttggtatatccatcggataaggatatttttttctaacctcaattaaatcattctccaatttccaatattcttcatcatcccacaccccgtcatcataccatttgccaataaatgaattttcgtcatactccttaaaacaagggatgtttcttctaaaatccttgaactcgcacataataattaatctccaatacgatttaggtttttatcaaatgtaccgtttcttgtttcttttctgttcagtttttcgggtgaagatgcctctttccaagcacctccattatgtgaatctacatcgcgtgatatataactctttccttttttaaaaatagcagcatcatttctcgttctttcttttatttttctatatcccaattcctttgctgctgcatatgcttctgaatcattcccatatatgggggtagatggtgtttttcttggcggacaatcattatgaacccaaaccccttccgtttccgcccgattgcccttgacgaagtaagtatgccagtcggcaacggtcagattgtaggctttgagcggctgctgtttgagggtaatgttttgaaccgtctgttttgcaccgctttcggaaagcagggtgtcgccttttttcagacgacctgcctgtatccattttccttgactgtaaaacgggtggattttattggaaatcagggtttggttgttgccgatgccgtctgaaatttcaatgtaaacggtttcttgatacggattgccgtatcgggcggtaacgggtttgtatcccgtttttccgcttgcctcgtccttggcgaagacgcggtcgccggttcggatacgggcaatggctttgtagccgtctgccgttttgaccaaggtgctgccgtggaaggagcaggtgtaggatttttaaagaacttagttctcaatatcctgtttcattcatcaaaatgccgtctgaaagctgaataccgcttcagacggcattttggtggttgggtttttaagccaacctacgcttactgaaaaccaaattgagtttcagacagtttttaggtttgggtgtccaatctaacttatatttgtccatttaattagtcgtttgtatcaaatttccattatttattttccaatttactttataattatcttcataataatctaattcaaaaaaacctgatatttcaatatccaattccattattgttttaatacatttttcaaaataaataatgaaataagattttacgcatgcaccaaaaaaaatatagctgctccaattaaaactatttgtcgggaaaacccacccgcttttatatatttttgcagattctttctcttcgatattaaagggacaattattccaaaaattattaatgttttcttggatgatttttatatcatcgtcagagcattcaatccatccttttatggaaacatatgatgccatgtttaatctcctaaacctgttttaacaatgccgccttttgattcaatatatgacttaacttgtgaatgaacaccgtatttaaaccaaaattctgcacgttttccctgttggtttgctgcttcgatggttgctttaatttgctttctatttttttgatttaagaaatttttaggtttatctattgctgaaattgttcttttggcttgtattaaagcatcattcgtaacagcgtcaatttctctgccgttaataaattttgatgaaccatcagtttttcttctaattaaatcttcataatgtatatctagagcttctctatactttgcattttgatataactgtctcgcactatcagacaaagccaatttctttttataagaatcagcaaaatccccgctaaccgcagccttccctggttttgccgcctttgccaacttcgcgactttggctgctgcggcaacgttgaagacggcttcgacggtttcggcggcattgggattttcctgtatccaccggtcaacggcttcgcgcgtattcttttcaaagcccgccacgctgcccaagccgccgatgacggcgaatttgccctcggcgggcaagggggcgatgttgcgcattgcggctttgtctatggcatagcgcgttccgtacagtatgtcgcctatgcccaaggcttcgcccgcgctgataaaggggttgagcgcgccggcggcgacgccgttgataaactccatgctgttgccccagcggtcgagcttggcattgtgctcgaacatttttctgttggcttcatcggcgcggtcggagaaattgctgccgaggttgctgtaattgtcggatatgcgttgccggatgctgcgggtgtcggtcggattgagtttgatactgcgggctgtgccgttgacgtgataggtgtattcgtctcgtgcgcccgtaggtttggggtaattgccgcccttcgggccgtcgtaggcatcggcgggatgatgttcgtgtccttcccagttgagccggtatacggtaaagccttcgtcaacgttgcctttttcttcgctcgcgctgtcggcggcgtggttgtcgaagggggcgtgttcttcgtgtccgtgtccggaaaagcgggtgtggtagccgattgtgccgttgatgtttgcctgttggatgagcaggttgcccatctggtgggtatagtcttggatgacgttgattttgccggtgcggtcggaaacgctgccgcgcgggtcgccgaagaggtggtatttgccgccgggttcgtagtgctgccgttgggcgttatcggtaatgaacgggtcttgcgccaagtccgccgcgagggcgggctgtatgagtgcggccgccgctacggcgcaggcggcaaggaggtttgtcagtctgcgcagcggtttcacggtttatcctcctttgcggcggcggatgacttcgttgccgacatcgggttttttaccgttgttttgtttgaagtcgggacggttttgggcggttgtgtcgccgtagggggtaatgtcggagaaatcgaccatcaggcggtctgaggctttgacggttttgctgactttgtaagggccggtccaaagggcgtattgttcttggtattgggattcgtaggcggcggttttaggggtaatcagcagtttccggctgtcgcggtcaacggcgaaatattcgagcttggtttgggctttaagggtttcggcgttgtagaggtgcagttcggtacggctgcggacggtgccgaatacgtcgacggttacgaatacgtcggtgtcggcgtattcgggcggtacgacttcgatgccgcgcaggtagaagacggtttggatgaggttggtcaggaaggaaacgtcgcgggggttggcgagcagggtttcgttgcggtagtcgcccgtgccgttgacggacagtccggcggagcgttcgcctttgcgtccgctgtttttcgtcagggcggcggcgggggcgttcaaaagcgatgtggaagtggttacgctggagagcgcgtcggatttggtggtggcggtagtgtcgtaggcggggtagctgtattgggtggcactttcggggttgttgtggtagccgccgcgtatcagtgcgtcgatagagtagcgtccgccgcttatgttgcccgaaccttggtcgcccataacggagacgtaaagggcggctttgcgtccttttagggcggacaaatccatttctttgacggcggcgcgggacgatgcggcgacgagttcttgttcgacggcaaagcgtttgccgccgccgtgggcgggtatgccggtcagtgtgccgcaggctgtgaggacgagggggatgaggaggagcagggttttcatagcggggtttgtttgatgttgaacggattttgagtgtaaagggattttaagggtttgtaaacaaaaggggcgaaaatgccgtctgagcggcggaaatggctttcagacggcatttgcgctcaataataatatcccgcgcccagaatacacggtttggatgcgccggttgctttgtgcggactaccgggaatgcgattaatccaacacgccgccaaccacgcaaatgcggcggcttccacccattgcggatcgaggttcaggtcggcggtgctgtgcagggaaacgcgtgtgccgaaacattctgccaaatccgccattaaaacaggattgcggatgccgccgccgcaaatgtacatttgacgggcatctgccgctgcgtgtgagacggcgtcgcaaacggtttgcgcggtaaaacgggaaagcgtccgcaatacgtcgtatcggttttcgccgccgtcaaggtaggtttcgagccaatttagggcaaacagttcgcgccccgtgcttttagggtggggttgtgcgaaatacgggtgggcgagcagcctgtcgagcagttgcggcaatatgttgccttgtgccgcctttgcaccgtttttgtcgtaaggaagctgccagtgtgcctgcgtccacgcgtccatcagcatattgcccggccctgtgtcgaagccgaaggcgggtgcgtcgggggggagtacgctgatgttggcaatcccgccgatgttcagtaccgcgcgtgtttccctgttgtcgcggaacagggcttcgtgaaaggcggggacgagtggcgcgccttgtccgccggccgcaaggtcgcggctgcggaagtcgccgacggtaaaaatccgcgtccgttccgccagcagcggcaaatcggcaagctgtatgctgtaaccgtgttccggcgcgtgtcggacggtttgcccgtggcagccgagggcggtaatgtcggacggtgcgaggttttgactgcacagcagttcggcggcggtttgcgcatataggcggctgagttcttgcgacaaaatcctgctgcggtgcagttcgtctgcgcctgtgtcctgcaaatccagcaattggcggcgtaacctgccggggtagggggtaaaggcgtgcccttccgcgcccagccatttgccgccgtccatccgtatcagtacggcatccgccccgtccatgctggttcccgacatgatgccgatgtaaagctgtgtttccatcatcactcccaaactggtgcaaaacgccattttaacgtgtattgacgctcgtataccgatttgccgccgcagtgtaaataaagtgtaaataaatgtttcaagacggatggaaaaatattataatgcgcccgcaacatccagtagtagaagtgtcatacaaaccgtttccggcagcagttttgcattcggtcaggtttgggggtattcggatgcggttaggaaggatgcgtctgccatatcccgaaacggcagttcgaccggaggcagcagtacagtgtcggcaacactcatgatttccaccacattaaaggaagattgccatggctcaaatccaaatgagcgcaaatgttaaaaccatcaacgccgtctttgccgccatgctggtaggtacagtcggctattttatttattggggcttgggttatacccattacaattacgccgccttattcattattgccacgatgttcggcgtgtttatggcgttcaacatcggcggcaacgatgttgccaattctttcggcaccagcgtcggtgcgggtacgctgaccatcccgcaggctttgctgattgcggcggtatttgaggtcagcggcgcggtcatcgcgggcggcgaggtaaccaataccatacgcaaaggcatcgtcgatttgaagggtgttgatttcgaacccatacagtttgtgtttattatgatgtccgcgcttttggcggcggcgttgtggctgttgtttgcctcgaaaaaagggcttccggtatctaccacccattccattatcggcggcattgtcggcagcgcggtatgtatggcggtaatgaacgatgccgcatcgggcgatttgatacgttggggcaagctgggcggtattggtgtttcttgggtattgtcgcccgtgttgggcggcgcggtgtcctattttctgttttcgcgcgtcaagaaaaacgtcttagattacaacgcttgggcggaaggcacgctcaagggcatcaagcaggaaaaaaaggcctataaagaacggcaccgcctgtttttcgagggtttgtccgaagccgaaaaagtcgagtacgccaccaaaatggcgcacgacgcgcaaatttacgacgaacccgaattcgatccgcaagagctgcaatcggagtattaccgcggtctttatgcgttcgacaaccgtaaaaacaatgtcgattcctacaaggcactgcattcttggattccctttatcgcttcgttcggcgcgatgatgatttccgctatgctgattttcaagggcttgaaaaacctgcatttggggatgagcaacgtcaacagcttcctgaccatctttatgataggcgcggcggtgtggatggggacgtttgtttttgccaaaagcctcaagcgtaaagacttgggcaaatcgacctttcagatgttttcatggatgcaggtctttaccgcctgcggcttcgcattcagccacggtgcgaacgatatcgccaacgccatcggtccgtttgccgcgattatggatgttttgcgtaccaacagcgttgccgcgcaaaatgtcgtccccccgattgcgatgctgactttcggcatcgcgctgattgtcggtttgtggtttgtcggtaaagaggtgattaaaaccgtcggtacgagtttggcggaaatgcatcctgcttcgggttttaccgccgaactgtccgccgcctccgtcgtgatgggcgcgtcgctgatggggctgcccgtgtccagtacgcatatcttggtcggcgcggtactcggtatcggtctggtcaaccgcaatgccaactggaaactgatgaagcccatcggtttggcgtgggtcattaccctgcctgccgccgccgtattgtcggttgtctgctacttggttttacaggcagtattctgattgtaaaatactgatgccgtctgaacccgtgttcagacggcattttgttgatggaatgtgcgggcttgtgccttatgcacaatctgttctgtcgggatatgccgtttggtatagtgattaacaaaaatcaggacaaggcgacgaagccgcagacagtacagctagtacggcaaggcgaggcaacgctgtactggtttttgttaatccactatatcttggtttcggaacggtcggacacaaaggtgcggaacgttatgatatgccgccgcctgttcttgaaaacacttatcctgccggcagcaaaatgccgtctgaaaaagcctttcagacggcatttgtacgttagccacaatcacactgtttgcgaatatttcgccttggtttctttatggcgcaggtggtaatcgaagaccatggcgatgttgcggatgaggaagcgtcctttcggggtaacggtcagcccgtggctgttcaggcgcaccaatcccaaaccggcgagtttttccaaatccgccagttcgtctttgaagtagcggtcgaacgggatgccgaacatactttcgtaaatccgatagtcgagcgcgaaacggcacatcaaatcctgaatgatgttgcggcgcaggatgtcgtcctgattgagctggtagccgcgcatgatgggcagtctgccttcgtcgatggcggcatagtaggcatcgatgtcgcgttcgttttgggaataggtgctgccgattttgccgatggacgacacgccgatggcgaccaaatcgcaatccgcgtaggtcgaatagccttggaagttgcgctggaggaagccttctttgagggcgatggagagttcgtcgtcaggtttggcgaaatgatccatgccgatgaagacgtagccgcgttcggttagggtttggacgcagtattgcagcatatcgagcttctcttcgctgtcgggaacggcggcggtatcgatgcggcgttgcggtttgaacacgtgcggcaggtgggcgtagtgataaagggcgaggcggtcgggatcgagcgacaaaacggtatcgatggtggttttgatgctttccgaagtctggtgcggcaggccgtaaatcaaatcgacgctgacggatttgaaccccgcttcgcgcgccgcatcgatgacttctttggtttcttcgtaactttggatgcggttgaccgccgcctgcactttggggtcgaaatcctgaatgccgatgctcatgcggttgaagccgagtctgccgagcatgaggacggtgtcgcggctgactttgcgcgggtcgatttcgatggagtattcgccggtggggattaactcgaaatgtttgcgtatcatgcggaagacacgttcgatctgttcgtcgctcaaaaaggtcggcgtgccgccgccgaagtgcagttgggcaagctggtgccgtccgttcagatgtggagcgagcagttccatttctttttcaagatattcgatgtaggcatcggcgcggcttttgtctttggtgatgattttgttgcagccgcagtagtagcagatggtgttgcagaacggaatgtgaatgtaaagggaaagcggtttgtttaacgcgcccataccgcgcaaatgtaaagctttgatatattcgccttcgcggaaaccgtcatggaaacggtcggcggtagggtaggaagtgtagcgcgggccgctggcgggcaggctggcaatcagcgcgcggtcaaactcggggcggtcatcgtttacattgtgattgttctgtatctgaatgattttcatggtgtgtgtgtgcggttttatgatgttagtcaaattttggatagtttggtagaatgccacagtatgataaacctgtcttgatatgtgtcaataagcacatatagtggattaaatttaaataaggacaaggcgaggcaacgccgtactggtttaaatttaatccactataatcatgatggggcaaagcgcacaaaaaggtacggtatggcttcgcataatactacacatcagatgaaaacgctgtgttcttcctgttctttgcgggaactctgcctgcctgtcgggctgctgcccaacgagctcagccaactcgatgccgtcatccgtcaaagccgccgcctgaaaaagggcgaatacctgttctgtgtcggcgaagcctttacctcgctctttgccatccgttcgggcttcttcaaaacaaccgtcgccagtcaggacggccgcgatcaggtaacgggtttctttatgtcgggcgaactcatcggcatggacggcatctgttcccatgtgcacagttgcgacgcggtcgccttggaagacagcgaagtgtgcgaactgccgtttacccacatcgaagaactggggcaaaacatccccagcctgcgtacgcacttcttccgcatgatgagccgtgaaatcgtgcgcgaccaaggtgttatgctgctgttgggcaatatgcgcgccgaagagcggattgccgccttcctgctgaacctttcccaacgcctttattcccgaggttttgctgccaacgacttcatcttaagaatgtcccgcgaagaaatcggcagttatctcgggctgaaacttgaaaccgtcagccgcacattatctaaatttcatcaggaaggattgatttccgtcgagcataagcacatcaaaatcctcaatctgcaggtgttgaaaaaaatggtgtccggctgctcgcacgccatttgattaacccgtacgaacatttcagacagcattctcaataaacacagggcagacgaaaacatctgtcctgtttgttgtatctgccgcaaagtgccgtctgaaaaccggcagccgcctaaatcgaaaaatcctcgctgatgggcgtgtacagaatcctatccaccttctcgcgtgtcaggtgcggcgcgaacgcttggataaagtcgtaggcatatccgcgcaaataagtatcgctgcgcaaagcaatccacgtcggcgacggctcgaacaggtgtgccgcatccacaagctgcaaatcgccgtccgtatccgggttgtacgccattttcgccatcagtcccacgcccaaacccaagcgcacataagtcttcaatacgtccgtatctgccgcagccaatgcgacatcgggttgttccaaacgggctttggaaaatgcccgcgcgatgctgctgcccgcattgaatgcaaattcataagtaatcagcggaaacctcgccaaatcttcaatacggagggggtttctgcattcgagcaaggggtggtcgttcggtacgataaccgcatgagtccagtcatagcagggaagttttcccagttcgggatggtcgtctatccgttccgtaacaatcgccaagtccgcctcgcctgaggtaaccatacgtgcgatggcggcagggctcccctgtttgatggtcaggttgactttcggatagcgtttcacaaaatcggcaacaatcaagggtagggcatagcgtgcctgagtatgcgtcgtggcaaccgtcagcgaaccgctgtcctgtccggtaaactcgctgccgatatttttaatgttctgaacatcgcgcaaaatacgttccgcaatatccaaaaccaccttgcccggctgcgagaccgaaaccacgcgcttgccgctgcggataaaaatctgaatgccgatttcttcttccagcaatttgatttgtttggagatgccgggttgcgaagtaaacaaggcttcggccgcttcggaaacgttcaggttgtgctggtaaacttctaaggcgtatttcaattgttgtaatttcatggcgggtcggtgtgggtctgtgtcgggtggctgaacattgtttataatttatcatattttcttgccggtacggtatggggctttgccgttgtgtttgttgtttttgtgcaacggcaatcgtgcgatatggaaaaaatccccctaaagtaatgacacggaattgatttttcggcatgatagactatcaggaaacaggctgttttacggttgttttcaggcgttgagtattgacagtccgccccctgcttctttatagtggagactgaaatatccgatttgccgccatgtttctacagcggcctgtatgttggcaattcagcagttgcttctgtatctgctgtacaaatttaatgagggaataaaatgaccaaacagctgaaattaagcgcattattcgttgcattgctcgcttccggcactgctgttgcgggcgaggcgtccgttcagggttacaccgtaagcggccagtcgaacgaaatcgtacgcaacaactatggcgaatgctggaaaaacgcctactttgataaagcaagccaaggtcgcgtagaatgcggcgatgcggttgctgcccccgaacccgagccagaacccgaacccgcacccgcgcctgtcgtcgttgtggagcaggctccgcaatatgttgatgaaaccatttccctgtctgccaaaaccctgttcggtttcgataaggattcattgcgcgccgaagctcaagacaacctgaaagtattggcgcaacgcctgagtcgaaccaatgtccaatctgtccgcgtcgaaggccataccgactttatgggttctgacaaatacaatcaggccctgtccgaacgccgcgcatacgtagtggcaaacaacctggtcagcaacggcgtacctgtttctagaatttctgctgtcggcttgggcgaatctcaagcgcaaatgactcaagtttgtgaagccgaagttgccaaactgggtgcgaaagtctctaaagccaaaaaacgtgaggctctgattgcatgtatcgaacctgaccgccgtgtggatgtgaaaatccgcagcatcgtaacccgtcaggttgtgccggcacacaatcatcaccaacactaaggctaggcaatatcttgccgatgcatgaggttagtggattttgtaccaggtactgttgcaatattcgtgaaacgtcggtcggcatcgatgatgtgaaacaaacccccgcttttgcggggtttgtttttttgggtggttttctgaaacggctatcgtcagaatcggggtgcaggttcggattcggattcagattcagattcagattcagattcagattcaggtttgtgtcccattgccgcgctttatagtggattaacaaaaatcaggacaaggcgacgaagccgcagacagtacaaatagtacggaaccgattcacttggtgcttcagcaccttagagaatcgttctctttgagctaaggtgaggcaacgctgtactggtttaaatttaatccactatatcggttgaaactctgattttaaggcggtaggatgtgggtttgcccatagaaagggaatcctttctgtatcaagccctgaaagggataattcatacaaattcacgcctttccccctcattgggaaatggatggaatcgtgccagatgtgtgcggcactgtatgccggatatggttttatcatcagcccttttcggttgaaaccccgtcagttgcagcgattgagcctaatcggtggcggaagttgccgctttgcattcggggcggcgtgcagtgcggtgctttgatatgccgtttgtgtgttgaaacagggtggtcggtgcatacgggtacggtatggccaaagctaaaagtgaaatacgctgaaacactgaatgagccgctttattgtttgtacggcctttgctgccttgctatgatttaaattggattcgcccgccggatattttgggatatgaaagaatttgacttcatcaaacggtatttgcaaacaggcacggataatgatgtcgtattgggcataggcgacgatgcggcgattgtccgcccgcgtgaaggcttcgatttgtgtttcagtgcggatatgcttttgaaggacaggcatttttttgcagatgtcaaacctgaagacttggcttggaaggttttggccgtcaatatttcagatatggcggcgatgggtgcgataccgcgttgggtgttgctgagcgcggctttgcccgaattggatgaggtatggctgaaacggttttgcggcagctttttcggtttggcaaaaaagtttggcgtaacgttaatcggcggcgatacgaccaagggcgatatggcgttcaatgtaaccattatcggcgaattgccgaagggtagggcgttgcggcgtgatgcggcggttgcgggcgacgatatttgggtgtcggggcgtatcggtatggcggcggcggctttgaactgccgtctgaaacggtgtgtgttgccagatgaagtgtttgccgaatgcgaacaaaagctgctccatcctgaaccaagggttgggctggggcttgcgctgttgccgtttgccagggcggcgcaggatgtttcagacggcctcgcgcaagatttggggcatatcctgaccgcttctggcaagggtgcggaaatttgggccgattcgctgccgtctttatccgtattgaaagatattttgccccgagcgcaatggctgtcttatactttggcgggcggcgacgattacgagctggtgtttaccgcgccggaaagttgccgcagccgcgtatttgatgcggcggaacggtgcggcgtgccggtaacgcgcatcggcaaaatcaacggaggatgccgtctgaaggttttagatgccgacggcagggaattggaactacattctttaggattcgatcattttggctgattttaaacctgactttgcgtggctgttgaaacggccgttgtgttttttggctttcggtttcggcagcgggctggctccgttcgcgccgggcacattcggcactttggcggcactgcctttggcgtttgtgctgattttgctcggcatagacgggctactgctggcttttttgtgtatcgtgctgtttatgtggggcatacgcatttgcgcttatgcggaacgtgaaacgggtgtcagcgaccacggtgggattgtttgggacgagattgtcgccatgctgtttgtgctggcgtttgtgccgttcaggtggacgtggtggctggcggcatttgtcctattccgtctgtttgacgcgctcaaaccgtctcccgtcggttggtttgacaagaatctgcacggcggtttgggcattatggcggacgatatggcggctgcggtgatgactttgattgtcttgaggattgcaatgctgttttaaacggtgctgccttgtaaaaatgccgcctgaaagcctttcagacggcattgtttcggaggttaacgcgttaccggtttgtatttgatgcgtttcggtttcgcgccttcttcgcccaaacggcgtttcttgtcggcttcgtattcctgatagttgccgtcgaagaacacccatttagagtcgccttcacacgccaagatatgcgtggcgatgcggtcgaggaaccaacggtcgtgcgaaatcaccatcacgctgccggcaaattccaacaatgcgtcttccaacgcgcgcagggtttccacgtcaaggtcgttagacggttcatccagcagcaatacattgccgccgctcaacaaggtttttgccaagtgcagacgaccgcgttcgccgccagacaattgacctgcaattttgctttggtcgctgcctttgaagttgaaacgccccaaatattggcgggcgggaatttcaaactgaccaacctgcaaaatgtcgcggccttcggcaatgttgtcgaacacggttttgtcgttttgcaaaccttcgcggctttggtcaatcaagctcattttcacggtttgtccgattttcacctcgccggaatcaggctgctctttgcccgaaatcattttgaacagcgtagatttacccgcgccgttcgggccgatgatgccgacaatcgcgcccgcaggcactttgaagctcaaatcgtcaatcagcactttatcgccgaacgatttggaaacatttacaaattcaatcacttcgttacccaaacgctcggcaacgggaataaagatttcctgcgtttcattgcgtttttggtattcgtagttgctcatttcttcaaaacgagccaaacgcgctttggacttggcttggcggcctttggcattttggcgcacccattccaattcctgcttcatcgccttcacgcgcgcggcttcggattttgcctcgttttccaagcgtttttctttctgctccagccaagacgagtaattgcctttccacggaataccatggccgcggtcgagttccaaaatccattcggcggcgttgtcgaggaagtagcggtcgtgcgttaccgcaacgactgtgccggggaagcgcacgagaaattgctccagccactcgaccgattccgcatccaagtggttggtcggctcgtccagcaaaagcatatcgggcttgctcaacaagagtttgcacaaggcaacgcggcgtttttcaccgccggacaaattatcgattttggcatcccattccggcaggcgcagcgcgtcggcggcgatttccaattcgtgttccgcaccgccgcccgtggacgaacctgccgcaataatcgcttccaagcggccctgctcttctgccaacgcgtcaaaatccgcatcaggattggcgtactcggcatacacttcttccaaacgtttctgcgcggcagccacttcgcccaaaccgctttccacttcctcgcgcacggttttttccggatcaagctcaggctcttgcggcaggtagccgattttgatgccgcccatcggcacggcttcgccctcaaattccttatccacgcccgccataatccgcagcacggtggacttgcccgcgccgttcaaaccgagcaggccgattttcgcgccggggaagaaagaaagggaaatatctttaatgatggttttctgcggcggcacaaccttgctcacgcgcagcatagaatagacgtattgttgggacatggttttctcgttttcatcaaacaaatttcagacggccattttaaccgataatttgatttaagccagtttatccgcgaaccggtattgccaaaatcgggcaggattcataaaatccgcttatccctttgaaattatatagacaaaaaaataataatgataggggatcgccgccccggcaaccatttcggattttccaaagcaaatatagtggattaacaaaaatcaggacaaggcgacgaagccgcagacagtacagatagtacggaaccgattcacttggtgcttcagcaccttagagaatcgttctctttgagctaaggcgaggcaacgccgtactggtttttgttaatctactatacttttcaaatcaaaaaaggatttaccttatgtcggaatatacgcctcaaacagcaaaacaaggtttgcccgcgctggcaaaaagcacgatttggatgctcagtttcggctttctcggcgttcagacggcctttaccctgcaaagctcgcaaatgagccgcatttttcaaacgctaggcgcagacccgcacaatttgggctggtttttcatcctgccgccgctggcggggatgctggtgcagccgattgtcggccattactccgaccgcacttggaagccgcgtttgggcggccgccgtctgccgtatctgctttatggcacgctgattgcggttattgtgatgattttgatgccgaactcgggcagcttcggtttcggctatgcgtcgctggcggctttgtcgttcggcgcgctgatgattgcgctgttagacgtgtcgtcaaatatggcgatgcagccgtttaagatgatggtcggcgacatggtcaacgaggagcagaaaggctacgcctacgggattcaaagtttcttagcaaatacgggcgcggtcgtggcggcgattctgccgtttgtgtttgcgtatatcggtttggcgaacaccgccgagaaaggcgttgtgccgcagaccgtggtcgtggcgttttatgtgggtgcggcgttgctggtgattaccagcgcgttcacgattttcaaagtgaaggaatacgatccggaaacctacgcccgttaccacggcatcgatgtcgccgcgaatcaggaaaaagccaactggatcgaactcttgaaaaccgcgcctaaggcgttttggacggttactttggtgcaattcttctgctggttcgccttccaatatatgtggacttactcggcaggcgcgattgcggaaaacgtctggcacaccaccgatgcgtcttccgtaggttatcaggaggcgggtaactggtacggcgttttggcggcggtgcagtcggttgcggcggtgatttgttcgtttgtattggcgaaagtgccgaataaataccataaggcgggttatttcggctgtttggctttgggcgcgctcggctttttctccgttttcttcatcggcaaccaatacgcgctggtgttgtcttataccttaatcggcatcgcttgggcgggcattatcacttatccgctgacgattgtgaccaacgccttgtcgggcaagcatatgggcacttacttgggcttgtttaacggctctatctgtatgcctcaaatcgtcgcttcgctgttgagtttcgtgcttttccctatgctgggcggcttgcaggccactatgttcttggtagggggcgtcgtcctgctgctgggcgcgttttccgtgttcctgattaaagaaacacacggcggggtttgagcgatgagcgatacccccgctacccgcgatttcggtctgatcgacgggcgtgccgtaaccggctatgtgctgtccaaccggcgtggtacgcgtgtctgcgtgctggacttgggcgggattgtgcaggaattttccgttttggcagacggcgtgcgcgaaaacctcgtggtgtcgttcgatgatgcggcttcctatgcggacaatccgtttcagattaacaaacagatagggcgcgtggccggacgcatccgcggtgcggcgttcgacatcaacggcaggacttaccgcgtggaggccaacgaaggcaggaacgcgctgcacggcggttcgcacgggctggccgttacccgtttcaacgcggtggcggcagacggccgttcggtggtgctgcgcagccgcctgcaacagtcggccgacggttatcccaacgatttggatttggatatttcctaccgcttggacgaggacgaccggcttaccgttagctatcgcgccaccgcgctcggcgacacggtgttcgacccgacgctgcacatttactggcggctggacgcgggcctgcacgatgcggttctgcatattccgcagggcggacatatgccggccgatgccgaaaaactgcccgtctcaacggtttcagacgacctcgaagtatttgatttcagccggcccaagccgctggatgccgccgttgccgccctgcgccgcgaaacgggtcgggccggttttgacgacgcttaccgcgtgccgtccgatataggccgtcccgccgctgtgttgcaagccggacgccgccgtcgtatcagcatatacagcgaccgcaatggcttggtcatctttaccgccgccccgcaggatttcgcgcggcacgatgcgggcgtttacgacgcgctggcgaccgaggcgcagacgctgcccgacagcctgaattggcccgagttcggcaatattcgtctgaacaagggtgataccagggaggcgacgattgcttacggcatcgaatccctttcttaggagcttcctaacaccggttgcagacgacctttttatagtggattaacaaaaaccggtacggcgttgcctcggcttagctcaaagagaacgattctctaaggtgctgaagcaccaagtgaatcggttccgtactatttgtactgtctgcggcttcgtcgccttgtcctgatttttgttaatccactataagatttcaccattccctcaaatcaatccaaacaggagcttcataaatgtacacaagaatcatggaaatcagcccttggacgctgcgttcggcaaaactggaaaaagaacacaaacggctgcaagagagcctgaccagcttgggcaacggctatatgggtatgcgcggcagctttgaggaaacctattccgccgacagccacttaggcacctacatcgccggcgtgtggttccccgacaaaacccgcgtcggctggtggaaaaacggctatcccaaatatttcggcaaagccatcaacgcgttcaatttcagcaaagtcaaaatctttgtcgacgggcaggaagtggacttggcgaaaaacgacgttgctggcttctccgtcgaactcgatatgcagcacggcgtgttgcgccgctcgttcaccgtattcggtgtgcgtttcaatgtgtgcaaattcctgtctgtcgcacaaaaagagctggcggtcatccgctgggaagccgtatccgttgacggtaaaacccaccaagtccgcatcgattccatcatcgatgccgacgtgaaaaacgaagactccaactacgaagaaaaattctggcaggtattggacaaaggcgtttcagacagtctctcctacattgccgcccaaaccgtcgccaatcccttcggcgtggaacaattcatcgtcaacgccgagcaaacctttgccggcagcttcaaagccctcggcggcagccaaaccgactggcaggtctccaattcttttgaatccgaagtcggcagcacacccgaaacctttgaaaaacgcgtgattgttaccaccagccgcgattatcagagcttggaagcagtgaaagccgcaggccgcgccttgtcggaaaaaattgcaggcgttgcgtttgaaaccttgctggacgcgcacaaagcaggctggctgcaccgttgggaaatcgccgacgtggtcatcgaaggcagcgacgaagcgcagcagggcatccgcttcaacctgttccaactgttctccacctactacggcgaagacgcgcgactgaacatcggcccgaaaggctttaccggcgaaaaatacggcggcgcgacctattgggacaccgaagcctacgccgtaccgctctacctcgcactggccgaacccgaagttacccgcaacctgctgcaataccgccgcaaccaactgccgcaggcgcagcacaacgcgcgcgaacagggcttggcgggcgcactctatccgatggtaacgtttacgggcatcgagtgccacaacgaatgggaaatcaccttcgaggaaatccaccgcaacggcgcgattccttacgccatctacaactacaccaactacaccggcgacgagggctatcttgccaaagaaggcttggaagttttggtcgaagtgtcccgcttctgggcggaccgcgtccacttctccaaacgcaacggcaaatacatgattcacggcgtaaccggtccgaacgaatacgaaaacaacatcaacaacaactggtacaccaacaccctcgccgcatgggtattggactacacccgcgaagccttggcgaaatacccgcgtccggatttgaacgtgcgtgccgacgagttggaaaaatgggcggacatcagcgcgaatatgtaccgtccgcatgacgaagaactcggcgtattcgtgcagcacgacggcttcctcgacaaagacatccgccccgtgtccgcgctttcgcccgacgatttgccgctcaaccaaaaatggtcgtgggacaaaatcctgcgttcgccctttatcaaacaggcggacgtattgcaaggcatctacttcttcagcgaccgtttcaatatcgacgaaaaacgccgcaacttcgacttctacgaaccgatgaccgtgcatgaaagctcgctgtcgccctgtattcactctattctcgccgccgaactgggcaaagaagaaaaagccgtggaaatgtaccagcgcaccgcccgcctggacttggacaactacaacaacgacaccgaagacggcctgcacatcacctccatgaccggctcgtggctcgccatcgtccaaggtttcgcccaaatgaaaacctggggcggcaaactcagcttcgcaccgttcctgccgagtgcgtggacaggctacgccttccacatcaactaccgcggccgtctgattaaagtcgccgtcggcaaagaaaacgtcgtcttcactctgctcaaaggcgagtcgctcgatttgcaggtgtacggcaaagacatcacgctcgacggcagccacaccgttgcgttggaaaaataaggagggcgcaaaatgactttcactgcagtcctatttgacctcgacggcgtcatcaccgacaccgccgaataccactaccgcgcatggaaaaagctcgccgaagaactgggcatcagcattgaccgcaagtttaacgagcagctcaaaggcgtgtcgcgcgacgattcgctcaaacgcatcctcgcgcacggcggcaaaaccgtcagcgaagccgagttcgccgaactgacccgccgtaaaaacgacaactacgtcgagatgattcaggcagtcaaacccgaagacgtgtatcccggcattttgcccctgctggaagcattgagggcaaacggcaaaaaaatcgcccttgcgtccgccagtaaaaacggcccgttcctgctggaacgcatggggctgacccacttcttcgacgccattgccgaccctgccgccgtcgcacattccaaacccgcccccgacatcttcctcgcagcagccgagggcgtagatgcggacatccgccaatgcatcggcattgaagacgccgccgccggcgtcgccgccatcaaagccgccggcgccttgcccatcggcgtgggcaaagccgaagacttgggcagcgacatcgcgctggtctccggcaccgccgagctgacctacgcctacctgcaaagcgtgtgggaacagtcgggcaggtaaaacgcgtcagataaagtgtcaaggaagcaaaagaccgtctgaacagtgtttcagacggcctttttgcttttagaacagaatgataacccaacttacgcaaccctaaaaactaaatgccaatctcttaaccatgctattcaaatttatttgaacgattttttttctaaccagccaaccttaacaatcactattaaaatgcgcgccgatgttctgtctccgcctgtatgcggcttgggcgacggcgaggctgcattcgagcaggttgcggttttcgtattcggacgcggtgtgcggttcggcttggttttgcttccaaagctgcagttgggcgatggcgcggcgcaggccggtatcgttgcgtaggatgcctagatggcgttggttgaacgtttgcaggacggggcggctgaatgtgttttgaaggtcgtctgaaaagatgcctgcttcggcggagaggctttcagacggcctttggaatggttcggcttggaatgcttgtccgtctgcgatggcttgggcgcagagccttgcggtcacgacgcattcgagcagggagttgctggcaaggcggttggctccgtgcagcccagtgcaggcggtttcgcccaaggcgtagagctgcggcagggaggttctgccgcaggggtcggtttggatgccgccgcaggtgtagtgttgcacggggcggacggggatggcttggcgcgtgatgtctaggccgcattgggataaacagtgtcgatggatggatgggaaatgccggcggacgaacgctgcgggttgatggctgatgtcgagcgagacgaagtcttgcgtttgtttggcgatttcggctgcgatggcgcgggcaacgatgtcgcgcggtgcgagttcggcgcggcggtcgtaatgcggcataaatcgttcgcccgcttggttggtcaggatgccgccttcgccgcgcacggcttcggaaatgaggaaggtgcgtccgttttcagacggtcttgccaagcctgtggggtggaattggataaattcgaggtttccaactgcgcagcctgcgcgtatcgccatggcgatggcgtcgcccgtgcattcgggcggcgtggtggtggcggcgtaaatctgtcccaagccgccgcctgcgagtacggtatggcgggcgcggatgcggtaggtttcttgtgttcggcagtcgaggacggtcagtccgcacgccgcgcctgattcggtttgaatgtccaacgccatctgccgctcgcaaacgcggatgttcgggcggcggcgtatttgggcaatcaggctctgcatgacggcttcgcccgtgtagtcggcgacgtgggcgattcgtcggcaggtatgcccgccttcacgcgtcaggtgcaggccgttatgattccggtcgaacgccacgccctgcgccagcagccattcgattgccggtttgccctgcgacaggatggcgcggacggcggcttcatcacacaaacccgcgcccgcttccaaagtatcggcaacgtgtttttcgatgtcgtcctctcccgaccacgccgccgcaatcccgccttgcgcatgacggctggcggtgtcgtccagccggtttttgcacaaaataacgatgcggaacgattcaggcagcgacagggcgagcgtcagtgccgccagcccgtttccggcaatcaatacgtcgcaatcggtttgcatggtgttgtccttgtttgagaggccgtctgaaacggtatagtggattaatcaatgccccgacatatgcgacatggtattgagaagcaccacgcccagcaaaatcaaaccgatgctgacaatcccaatgaaatcagctttctcaccgaaaaacaccacgctgactaaagccgttaaaaccagtcccacgcctgcccaaatggcgtatgctgtagccagcggcatggttttcagtgtcatagacaaggcccaaaaacacaccgaaaagctgactaccacgccaatagaaggccacagtttgctaaacccgccactcagtttgagcatggaagaaccgcagacttcgcttaaaattgctacagtcagaaagagccagtgcatttgcatgtttttacctgataaatgaaagaaagtataattatatcaatgcaataaaataaaaaaacagtcttgttgttaaagattttttgtgtgcaaatcccgtcttgggaaagcaggcgggcggtattttcaggctgcacccattacgaacgacaaatcaggcggggcccatgccgttgaacacatcttttttcttcagccctgccgcaaagtcgagcatacgctgcaaaggcagtttggcggcttcgcccagcttcctgtccaacaggatttcgttacgtccgcttgtcagggcgtatttgatgccgcccagcgaattcatcgccatccacgggcagaacgcgcagcttttacagcttccaccgttgcccgccgtcggcgcggcgataaattgtttgtcgggcgcctgcttttgcatttcgtgcaggatgcccaaatcggtcgccacgatgaattttttttcaggacgcgatacggcggctttgagcagtttgctggtcgagccgaccacgtcgcccagttcgatgacgctttgcggcgattcaggatgaaccagcaccaccgcttcggggtgttccgccttcaacgccgccagctcttgccctttgaattcgttgtgaacgatgcacgaaccctgccacaacagcatatccgcgcccgtttcgcggcagatgtagtcgccgaggtggcggtcgggtccccaaatcagcttctcgccgcgtgatttcaaatacgatacgatttctaacgccaccgaagacgttaccacccaatcggcacgcgctttcacggcggcggaagtgttggcgtacaccaccaccgtgcggtcggggtgttggtcgcaaaacgctgaaaacgcttcttccgggcaacccaaatccaaagaacattccgcctccaaatcaggcatcagcaccgttttttcagggcagaggattttcgcgctctcgcccatgaagcgcacaccagccaccaccagcgtaccggcttcgtgttccgcaccgaagcgcgccatttccagcgaatcgcccacgcatccgcccgtctccaaagccaaatcctgaatcagcggatcaacgtaataatgcgccaccaagaccgcgtttttctccttcagcaaagccttgatttcgtctttcagacgatctgccgtctcgcggtcgggcgtgtcggcaaccttcgcccacgcctgacggatttggcaggcggaagtcggcgtttggatgagtggcatatcgtagtcgaacgagcggcgggcggcggtttgcatgatgtttccttgtagctgtttttcagacggcatgaaggtttgccgtctgtttttcaaactgtttttacattatgctcaacttgagtataatatgcaaggtcgtctgaaaacaggtttgcaataccgtaaaaccgacccgcttcgttccgacaaaccgctttggtttacaataaagcctttcccacccgcagaaagccgagcatggatgcctaccccgaagccgaagccccgccgcaaagcatcgtcgagctggttcccgtattgattgccgttaccgacggcggcctgcgggtattgaccgtcgcccaaggcatgctcctgcccaacggcccgctctcccccctgcgcaattccttgcaggcaggcgtaaaactgtgggtcgccaagcagacttcgcagcctatgggctatgtggaacagctttacacctttgtcgatacccaccgccgcaacgaacacggcatgcccgtgctgtacgtcagctatttggggctggtgcgcgaggcagccgacagcatcctgcacccggatgcgaaatggcaggactgctacggctatttcccgtgggaagacttgcgcaccgacggcgggcagcgcgacgccgtcgtcggccgcctgcgcatttgggcaaactcggcggacacggaggaagtgcgccaaaagcggctcaagcgcattcatttgtgctggggggtcgaaccggaaaactggtcggaagaatacgttttgcaacgctatgaaatgctgtatgaaagcggcctgatagcggaagccgccgagccgcaggcaaacttcgacttcgcgcttacggggcagcccatgcgccacgaccaccgccgcgtactggcgaccgccctgtctcgcctgcgcgccaaaatcaaataccgccccgtgatttttgaactgatgccgcccgaattcacgctgctgcaactgcaaaacagcgtcgaagccatcagcggcagattgctgcacaagcaaaacttccgccgccagattcagcagcaaaacctcatcgagccgtcggataccggcgtatcgggcagcaaaggccgtcccgcgcagctttgccgcttccgcgacgacgtcctgcccgacaggctgatttcggacatcggactgccgctgggcagccgttagcccgttttcagacgacctatagtggattaacaaaaatcaggacaaggcgacgaagccgcagacagtacaaatagtacggaaccgattcacttggtgcttgagcaccttagagaatcgttctctttgagctaaggcgaggcaacgccgtaccggtttttgtaaaatgaagttttgccccatcggtgcaacatcaatctttttcaacaaaggaaaccccatgccgtctgaaaaaaccctctttcccctgcccgacaccctgttgcgccccatagtagaacaagccttgagcgaagacttgggcaggcgcggcgatattacgtccgccgccgtcatcgcccccgacaaaaccgccaaactcttccttgtcagccgcgaagacggcgttatcgccggcatggacttggcgcgtctcgcctttcagacgatggatccgtccgtccgcttccaagccgaaatccgagacgggcaagccgtccgcgcaggtcagacgcttgccgccgtcgaaggcaacgcccgcgcgctgctcgccgccgaacgcaccgcgctcaactacctcacgcacttaagcggcatcgccaccgccaccgcgcgtgccgttgccgaagtcgccgaatacggtacagacatcgtgtgcagccgcaaaaccatccccctgctgcgtgtcctgcaaaaatacgccgtcagggcaggcggcggtgtgaaccaccgcatgggtttggacgacgccgtgctcatcaaagacaaccacctcgcctattgcggcagcatcgcccaagccgtgcagcaggcaaaacaggctgtcggagcattgacctgcgtggaaatcgaagtggatacgttggcacaactggacgaagccatcgcagcgggcgcggaacggattttgctggataacatggacgacgaaaccctgaaagaagcggcaaaccgctgccacacgcaaaccgcccacccccacaccatctattgcgaagcatcgggcggcatcggcttcgaccgcctgaagcgcgtggcgcaaaccggagtggacggcatcgccctcggctatctgacccacagcagccgttcgttggacataggtttggatttcgtggcgtgagttttagggtgcgggcggctgtctgatatgtcaggcaaggaaccgcttaaccctaatccggttattgcctcagggaggaaatgccgtctgaaagattcttcagacggcatttttcgtaaaggtcgtgatgctttagaaaaaacagcatttcaggcaggtattttgtttgcccgacagcgcggcggcatcggtagggcaggaaaaaggacggggggcggcagttttatgccgtctgaaagcccgcctttacgcttgtttgcaaaaaaagtgggaaaaggaacatacaatcctgtacaatcatccataaatatttgatttataatacgatttataaagataatcacaatcatccatatctgccgcccgtcaatccgcttggcgggcggcaaaggttttaggaataccgatgaacacaataccgctccacaccatactcaaacttatggcgcatcccgaacgtatggcgatactgattcaattgttggacagcgaacgcaatatcgccgaactggcaaaatccttatccctgccggccaccgcagtttccaaccatttgaaccgcctgcgcgtggaaggtctagtcgattttacgcgttaccaccgcattatcgaataccgcctggtttccgaagaagcggcggcgattctgcacacggttcgcgatttggaaaacaaacgcgtggcatagtgttagaatcctttccttttgccgtctgaacgtttcagacagcatttttcggaaatgttatgaaaatcaccacttggaatgtcaattcgctcaatgtgcggctgccgcaggtgcaaaacctgcttgccgacaatccgcccgatattttggttttgcaggaactcaaactcgatcaggacaaatttccggccgccgctttgcaaatgatgggctggcactgtgtttggagcgggcagaaaacctacaacggcgtggcaatcgtcagccgcagcgtgccgcaggacgtgcatttcggtttgcccgcactgccggacgatccgcaacggcgcgtgattgcggcaaccgtcagcggcgtgcgcgtcatcaatgtctattgcgtcaacggcgaggctttggacagccccaaattcaaatataaggaacagtggtttgccgcactgacggagtttgtccgcgatgaaatgacccgccacggcaaactggtgttgctgggcgatttcaatatcgcgcctgccgatgcggactgttacgaccctgaaaaatggcacgaaaaaatccactgttcgtccgtcgaacggcagtggtttcaaaacctgctggatttgggactgaccgacagcctgcgccaagtccatcccgaaggcgcgttctatacctggttcgactatcgcggcgcgatgttccaacgcaaactgggcctgcgtatcgaccatattttggtgtcgcctgcgatggcggcggcgttgaaggatgtccgcgtcgatttggagacgcgcgcgctggagcgtccgagcgaccacgcgccggtgacggcagaattcgattggtaaaagaccgtgttttgatatggcgttgacaagcatccttatcttcaatttattcaataggatagctttctatctgactgaaaaataattgcctttccccggcaaacagccgaaatcggcggattgttcaaacacagcctattttcctgaaaaatttatgaaatacatagggttaatatcagattttggagcagtaaaatttattatgtacactaatccaaaacaaaatcaaatattgaaaactagatttattttcgaataaatagaaagccgtcttatatatagtaataaattaataaccctgtttttcctattgcctttattgtgccatgcagttgagtttgatgaaactcaatataacgactgtaaagataaatctatgttatgtgctgtcagaattgattctcccaaaggcaataactatagtggattaacaaaaatcaggacaaggcgacgaagccgcagacagtacaaatagtacggcaaggcgaggcaacgacgtactggtttaaatttaatccactatataaatctatgtggtttgacaatggcaagttagtatttatatcctttactaatcaacaaatggaaaatcaaagtcgcccatctctagcgatgtttattagtgatgacaaaatatccagtaccaatattgatgaatttttagcatctttcgatcctgataaatatcgaatatttcatgatccaagatataaatttttacctagtatgtcgaactcattgtaatccttattctctttttgatattgatagcaaatataaacctgatgagaaagataaaatctttttttcaatcccgacagataacacagatttttataagggtttttatttaaataaggattatatagaaggtatatatcctagtaggcataatggcagctattacaaaatatagtggattaaatttaaaccagtacagcgttgccgtactatttgtactgtctgcggcttcgtcgccttgtcctgatttttgttaatccactatatctgcatcagtttcatgaaacgcaagtcggaagcgtcaaacaactgattgcccattttgaccggctgattgacgaattggacaaacaaatcgacgaccacacccacacgcattttgacggcaaagcccaagtggcagaacaaatcaaaggcatcggttcgataacgacggctacgctgatggcgatgctgcccgaattgaggcggctgtcgcacaaacggatagcgggtttggccggcattgccccgcacccgagggagagcggggaaaccaaattcaaaagccgctgctttggcggaaggtctgcggtgcgtaaggcactgtatatggctaccgtggcagcgacacgttttgaaccgcttattcgggatttccaccaacgcccgctgtccgagggtaagccgtataaggttgccgttacggcatgtatgcgcaaactgctgacgatatcgaatgcccggatgcgtgattattttgccgaaaacgataccgccgaaaacggtatctaaacggcttgatttgagttttggtatttttgcccgacggggtgaaaaatacagttgctacggctcgatgaatcgtcagaaatacctgcatcgtcattcccgcgcaggtgggaatccagaccggtcggtgcggaaacttatcaggtaaaacggtttcttgagatttttcgtcttggattcccactttcgtgtgaatgacggaatgtaggttcgtgggaatgacgtggtgcaggtttccgtatggatggattcgtcattcccgcgcaggcgggaatctagtctgttcggtttcagttattttcgataaatgcctgttgcttttcatttctagattcccactttcgtgggaatgacgggattttaggtttctgattttggttttctgtccttgtgggaatgacgggatgtaggttcgtaggaatgacgtggtgcaggtttccgtgcggatggattcgtcattcctgcgcaggcgggaatccagtctgttcggtttcagttatttccgataaatgcctgttgcttttcatttctagattcccactttcgtgggaatgacggttcagttgctacggttactgtcaggtttcggttatgttggaatttcgggaaacttatgaatcgtcattcccgcgcaggcgggaatctggaatttcaatgcctcaagaatttatcggaaaaaacaaaacccttccgccgtcattcccacgaaagtgggaatctagaaatgaaaagcaacaggaatttatcggaaatgaccgaaactgaacggactggattcccgcttttgcgggaatgacggcgacagggttgctgttatagtggatgaacaaaaaccagtacggcgttgcctcgccttagctcaaagagaacgattctctaaggtgctgaagcaccaagtgaatcggttccgtactatctgtactgtctgcggcttcgtcgccttgtcctgatttttgttaatccattataaaaatgccgtctgaaaggttttcagacggcattggttcacgggccgcgcccgggtatttcggcaaaatcagtcggcgaccgccatcaggctggcgttgccgccggcggctgtggtgttgacgctgcaagagatttcttcaaacacttgcaggatgtcgagtccgttttccgaagggaggatgcggatgagtgcgccgtcgtgggcggcaagttcctgtttgcgcgcgctgtccaaaggcgacagggcggcaacgtggctgatgccggcggtttcgggtttgccgttgaccagcagcagaccttccaagtcggcagtgtaggaagccaaggggctgtcgggttcgaccactgcctgtatgccggaggcggcaagttcggtcagtgcggcaaaggcttgaaccgtgctgccgccgtgtatccaaacgcgtttgggcgcgtgccatgagatgctgttgcgctcgccggtcggtccggtaaggacggtttcggcacggcgcagggtgcggatgcgggcgtgtcccaaagcggccgctgcggcttttttctcttcggcgttgaacggtagtttgtgaaccagtgcttcgaggcgtttgagtgcggcttcgtccgcctgtccgatttggctcagggtcggggcaacccattcgccggcgcgggtcagtttttgcaggtagaacgaaccgcctgctttggggcctgtgccggacagaccgtgtccgccgaagggctgtacgccgacgactgcgccgacgatgttgcggttgacgtaaacgttgccggcttcgatgcggctgcggatgtggcgtaccgtgccttcgatgcggctgtgtacgccgtgggtcagggcgtagcctttgctgttgatttggtcgatgacgttgtcgagttcgtcggcgcggtagcggacgacgtgcaggacgggaccgaagacttcgcgttgcagttcgttgaggttgttcaattcaaacaggatggggcgaacgaacgtggattttttggaatcgacatcggcggcggttttgacttcgtggtaggacttggcaacacctttcattttgttgatgtggttcaacaggttttgctgtgcttcggcatcgatgacggggccgacatcggtagtgagctgaatcggtttgccgacgacgagttcgtccatagcgcctttgatcatgtcgagcatacggtcggcaacgtcttcttggacgcacaaaatgcgcagggcggagcagcgttgtcccgcgctgtcgaaggcggagttcaatacgtcggcgcagacttgctcggcaagtgcggtggaatcgacaatcatggcgttttgtccgccggtttcggcaatcaggacgggattgtcgccgcgtttggcaagggctttgttgatcaggcgcgccacttcggtcgagccggtgaaaatcacgccgccgatgcgggcatcgttggtcaatgccgcacccacgtcgcctgcgccgaggacgagttgcagggcggaagtcgggatgccggcttcgtgcatgagggaaacggcataaccggcaatcaggctggtttgttcggcgggtttggcgatgacggtgttgcctgccgccaatgcggaaacgacttcgccggtaaagatggcgagcgggaagttccacgggctgatggcgacaatcgcgccgacggcttttgcgtcttgaggcagggtatgttcggcttcgtttgcgtagtagcggcagaaatcgacggcttcgcgcacttcggcaatggcgttgttcagcgttttgcctgcttcgcgcacggcaagcatcatcagtgctggggtgtgctgctccagcaaatcggcaaaacggcgcaggcaggcggcgcgttcggcggcaggtgtcgcactccattcggggaacgcggcaacggctgcgccaaccgcttcttgggcaagcgcggcatcggcaaagctgactgtgccgacgatgtcgtcgtggtcggcagggtttttaatcggttgcgcttcgccgacatcgcgggctttgccgttgacgatggatgcggcgtggaagtcttgcgcggcggctttgttcatctgttcttgaagctgctgcaatacgttttcgttgctcaagtccacgccttgcgagttcagacggcatttgccgtacaaatcgcgcggcagcggcagggcgttgtgcaggtggatgccttgttcggcgatggtgtcgaacgggctgcggatgagcgtgtcgatgctgatgttttcatcgacgatttggttgacgaaagacgagttcgcgccgttttccaacaggcggcgcaccaagtaggcgagcagggtttcgtgtgtgccgactggggcgtacacgcgcacgcggcggcctaagttttgcgggccgacgacttggtcgtacagggtttcgcccataccgtgcaggcattggtgttcaaaatctttgcctttacccatttggtagattgcgcccaaagtgtaggcgttgtgggtggcaaattgcgggaataccgcgtcttgcgcggaaagcagtttgcgcgcgcaggcgaggtaggagatgtcggtgtggactttgcgggtgtaggtcggatagccgttcaagccgtccacttgcgcccatttgatttcgctgtcccaatacgcgcctttgacgaggcggatcattagtttttggttgttgcggcgggcaaggtcgatcaggtagtcgataacgaacggacaacgtttttggtaggcttggacaacgaaaccgatacctttgtagccagccaagtcagggtctgaaaccaaagcctccatcaaatccaaagacagctccagacggttggcttcttcggcatcgatgttgataccgatatcgtattttttacccaaaaggaacagctctttcaggcgcggcaacagttcgcccatcacgcggccgtgttgggtgcgcgagtagcgcggatggatggcggaaagtttgacggaaataccgttaccttcgtaaacgccttgtcctgccgcatctttgccgatggcgtggatggcttcgacatagtcgcggtagtagcggtcggcatcggcttgggtgtaggcggcttcgcccaacatatcgaaggagaagcggtagcccattttttcgcgttctttgccgttttgcagggcttcttcaatggtctgtccggttacgaactgtttgcccagaagccgcatggcgtaatttacgccttggcggatgagcggtgcgccgcctttgctgatcaggcggctgagtgcggaactcatttgtttgtcgtttgtggcggtcagtttgccggtaatcagcaggccccaggcggcagcattgacgaagagggaagggctgttgttcaaatggcttttccagttgccgtctgaaatcttgtcggcaatcaggcggtcgcgcgtggcgttgtcggggatacgcagcagggcttctgccagacacatcagcgcgatgccttcttcgctggagagtgaaaactcgtgcatcagcgcatccacgccgccggctttggtgcggccggcgcggacttgggtaaccaaacggcgggcaagctcggaggcggcgttgcgctcttcgtcgctcatctgtgcacgttgcaacatatcctgtacggcttcgatttcattacggcggtaggcatcggttatcgcttggcgcagggcagtttgtgccggaaatgcaaaatgaaacattttttggattctccaaagtttttcggggggcaggcggcatcggtgcggcctgaatacggtaatatcgtaataaatccgcagatgaaatacaaggcttcaaatgcgggcagggtaggtgcttccgtttctttgaaaatgaaacgggtaaaacacaaataaggcctgtatgcaggcaaggtttatttgtgtttgacccggaaacgggttcagacggcacgaaccgggatgccgtgccgtctgaaaggggtttatcgggtggcgcggtaatctgcgtcggctttttcaaagcgttcttgggtttcgcgcgaaggttctttgttgaacagggaaaccaacacggcaacgatcaagcaaacaataaagcccggcacgatttcgtacatcgtcaacaagccgctttctcctgccgcttgagccggttttttcacccattccgcccatacgactacggttaacgcacctgcaaccatacccgacaacgcgccgtaggcagtgatgcgtttccacaatacggacagaatcacaatcgggccgaatgccgcgccgaaacctgcccacgcgtaagacaccagtcccaatactttgctgttcggatcggaagcaatcaggatggaaatcacggcaatcgccaagaccatcaggcggccgacccataccaattccgactgttgcgcgtttttacgcaaaaagcctttgtagaagtcttcggtaatcgcgctggagcaaaccaaaagctggcaggacagggtggacatcaccgccgccaaaatcgcgctcaaaataatgccggcaatccaagggttgaacagcagggtggaaagcgcgatgaagatgcgttcgtggttgccgctcatagaagaaactttgtcgggatttgcaccgaaatacgcaatgccgaaataaccgaccgctaccgcgcccgcaaggcacaacgccatccaagtcataccgatgcggcgtgcggataccagcgatttcgcgctttcggccgccataaagcgcgccaaaatgtgcggctgtccgaaatagcccaagccccatgcggcggtggaaatgatgccgatgacggtcgtaccggcaaacaggctgccgtattctttgcccgtgcctgcggcgacactttgaatcgcggcagacatctgttccgcgccgcccaagcccagatagaccatcacaggcgttaaaatcagcgcgaaaatcatcaaagaagcctgcagcgtatccgtccagcttaccgccaaaaagccgcccaagaaggtataggcgatggtcgcgcccgcgcccagccacattgcctgattgtaagtcataccttcaaacaggctttggaacagggttgcgcccgccacaatgcccgaggcgcaataaatcgtgaagaaaaacaggataatcagtgcggaaaccactttcatcaagtgtccgcccgcgccaaagcggtggaagaaataatccggcagcgtcagcgcgttgttggcgtattcggtatgtacgcgcagacggcccgccaccaaaagccagttgaaatacgcgccgaccaagaggccgatggcaatccaagcctcattcaaaccgctcaaataaatcgcgcccggcagacccatcaaaagccagccggacatatcggacgcgcctgccgacatcgcggtaacaaacgggcctaggctgcgcccgcccaaaatataatcgtcgaaattgcgcgtagaaaaataggcggcaagcccgatgagaaggactgcaaccagatagattgcaaaagtaatgtacatgggattcatgtgctattcctcgtctaaaacttcagaattacaggctttgaaattgcaagcaacttgcgcctgaaatgtttttctaataaaagtacaacggaaaatccggatacccgaaagggggattcggataaattatcttcaatcacaataagatatgtaataaaactatatgaaattgtaaataatccgtttcaggataacccaatttctgttgtttgcaaagcacttaatggcttaaaaagccgagtttgaaacgatgcgcgtcggaaaaatcatttaaaacagcatattgttttgtagtgtcttgtaatcgggcgttgcgcggaatatgaaatccgttttcaggcggcaggtgttttgaggtgtaatttagcaaccgcaaaggaggcgcggtatgttttgccgattatccgccgcccgttttcagacggcatttttccttatacaatagccgattgaatttgatatgttcaggaaggatacagattatgttcggcaagcagctttttgaggaagtcggctcgaaaatcagcgaaaccatcgccaacagccctgccaaagatgtggaaaaaaatattaaggcgatgctgggcggcgcgttcaaccgtatggatctggttacgcgcgaagaattcgacatccagcagcaggttttaatcaaaacccgtaccaaactggcggctttggaagcgcgtttggaaaaactcgaagccgcgcaaaatcccgaacgggcagcattggaagcggctgaagccgctgccgaagaagccgtcgccgaaatcaggcagcaaaccgaagccggcgaataaggtcgtctgaaatatgtcgcttgccttggtttacagccgcgccttgagcggtatgaatgcgccgttggtcgaagtggaagcccaccttgccaacggcctgccacatttcaacatcgtcggactgcccgatatggaagtaaaggaaagtcgcgaccgtgtccgtgccgccattattcaaagcggttttgaattccccgccaaaaaaattaccgtcaacctcgcccccgccgacctgcccaaagagtcggggcgtttcgatttgccgattgcaatcggcatccttgccgcatcggggcaggttgcgcccgaaaaactggaggaatacgagtttgcgggggaattggcactgtcggggctgttgcgccccgtgcgtggcgcgttggcgatggcgtggcagggtatgcaggcaaaacgtgcatttgttttgcctgaagaaaatgcaggacaagccgccgtgatgcgcggcattaccgtttacggcgcgcgctctttgggcgaagtcgccgcccatttgaacggcatcgaacctttggcgcaaaccgaatgccaagttcctcagatgccgtttgaacatggcggacaacctgatttgtgcgatgtgaaaggtcagcacaccgcgcgccttgctttggaaatcgctgccgcaggcggacacagcctcttgatgatgggtccgccgggaacgggcaagtctatgctctcccaacggctgcccggcatcctgccgccgctgaccgaagacgaattggtagaagtttgggcattgcgttcgctcctgcccaaccaccaacaacaactcgacagcaaccgtcctttccgcagtccgcatcacagcgccagcgcggcggctatggtcggcggcggttcggatccgcgtccgggcgaaatttcattggcgcaccacggcgttttgtttttggacgagctgcccgagtttgaccgcaaagttttggaagttttgcgcgaaccgttggaaaacggcgaaatccacatttcccgcgcggcgcgccaagccgtctatcctgccaaattccaacttgttgccgccatgaacccctgcccgtgcggttatctcgggcatcccgtcaaaccctgccgctgcacgcccgaaagcgtcgcgcgttaccgcagcaagatttccgggccgctgctcgaccgcatcgatttgaccatcgaagtcccgagcctgtccgccgccgaactgatgcagcaggaagcaggggaaagcagcgcgtccgttttggaacgcgttatcgccgctagagacaaacaatacgcacggcaaggcaaagtgaatgccgccttgagtgtcagtgaactcgacacatccgcccgcattcaaaaagaagcgcaggaagcattgggcggcctgctggaaaaactctccctttccgcccgcagcttccaccgcattatgcgcgtggcgcgtacattggcggatttggcgggcgacgaagaagtcggcagaagccacgtcatgaaagccataggtttccgtcgtgctttataggaatgggaatggaagcaggttttgcccaaatatggcgatattgttagaatatccgcccgtaagcaaacggcgttaatgccgtctgaaacacattaaggtatgtttatgaacaaattttcccaatccggaaaaggtctgtccggttttttcttcggtttgatactggcgacggtcattattgccggtattttgttttatctgaaccagagcggtcaaaatgcgttcaaaatcccggcttcgtcgaagcagcctgcagaaacggaaatcctgaaaccgaaaaaccagcctaaggaagacatccaacctgaaccggccgatcaaaacgccttgtccgaaccggatgctgcgacagaggcagagcagtcggatgcggaaaaagctgccgacaagcagcccgttgccgataaagccgacgaggttgaagaaaaggcgggcgagccggaacgggaagagccggacggacaggcagtgcgtaagaaagcgctgacggaagagcgtgaacaaaccgtcagggaaaaagcgcagaagaaagatgccgaaacggttaaaaaacaagcggtaaaaccgtctaaagaaacagagaaaaaagcttcaaaagaagagaaaaaggcggcgaaggaaaaagttgcacccaaaccaaccccggaacaaatcctcaacagcggcagcatcgaaaaagcgcgcagtgccgccgccaaagaagtgcagaaaatgaaaacgtccgacaaggcggaagcaacgcattatctgcaaatgggcgcgtatgccgaccgtcagagcgcggaagggcagcgtgccaaactggcaatcttgggcatatcttccaaggtggtcggttatcaggcgggacataaaacgctttaccgggtgcaaagcggcaatatgtctgccgatgcggtgaaaaaaatgcaggacgagttgaaaaaacatgaagtcgccagcctgatccgttctatcgaaagcaaataattatgaagctcaaacatctgttgccgctgctgctgtcggcagtgttgtccgcgcaggcatatgccctgacggaaggggaagactatcttgtgttggataaacccattcctcaagaacagtcgggtaaaattgaggttttggaatttttcggctatttctgcgtacattgccatcatttcgatcctttgttattgaaactgggcaaggcattgccgtctgatgcctatttgaggacggagcacgtggtctggcagcctgaaatgctcggtttggctaggatggcggctgccgtcaatttgtcgggtttgaaatatcaggcaaaccctgctgtgtttaaagcagtttacgaacaaaaaatccgcttggaaaacaggtcggttgccggaaaatgggctttgtctcaaaaaggctttgacggcaaaaaactgatgcgcgcctatgattcccccgaagctgccgccgccgcattaaaaatgcagaaactgacggaacaataccgcatcgacagcacgccgaccgttattgtcggcggaaaataccgcgttatcttcaataacggctttgacggcggcgttcatacgattaaagaattggttgccaaagtcagggaagaacgcaagcgtcagacccctgctgtacagaaatagccgaactcccgtatccgaaagaagcgcaagcaatggattttctgattgtcctgaaagccctgatgatgggcttggtagaaggttttaccgaatttttaccgatttccagcaccggacatttgattgtgttcggcaatctgattggttttcacagcaatcacaaggtttttgaaattgccatccagctcggtgcagttttggcggtagtgtttgaataccggcaacgtttcagcaatgtgttgcacggcttgggaaaagaccggaaagccaaccgcttcgtccttaatcttgccattgcttttatacctgccgccgtgatggggctgttgttcggcaaacaaatcaaagagtatctgtttaaccccttgagtgttgcagtcatgctggttttgggcggtttttttattttgtgggtggagaaacgccaaagccgagcagagcctaaaattgccgatgttgatgcattgcgtccgattgatgccttgatgatcggcgttgcccaagtgtttgcactggttccgggtacgtcccgttcgggcagtacgattatgggcgggatgctttggggcatcgaacggaaaactgcgacagaattctcgtttttcttggctgtgccgatgatggttgccgcaacggcttatgatgtcctgaaacattaccgatttttcaccctgcatgatgtcggtttgattctgataggctttattgctgcctttgtttcaggcttggtagcggtaaaagcgttgctgaggtttgtttccaagaaaaattatattccttttgcctattaccgcattgtttttggtattgccatcattatattgtggctgtcaggctggataagttgggaatgaaaccataaacccgacctgaagacattattcgggtcgggtttgtctggcgggctgatatagtgaattaacaaaaatcaggacaaggcgacgaagccgcagatagtacggcaaggcgagccaacgctgtaccggtttaaatttaattcactataaaatcaggacaggcggggcgataggtttaaagtcgattgcctgttttgaaggcagtggtttattctttatttgctggcaatcaggcaataaaaaagcacatacctttttacggtctgtgcttttttatctggtggaggtaagcgggatcgaaccgctgacctcttgcatgccatgcaagcgctctaccaactgagctatacccccgaaaatttggtggcgaatcagggactcgaaccccggacacaaggattatgattcctctgctctaaccgactgagctaattcgccgtttcgtgaagacgctattatatgtttttctgtttttttgacaagccgtattttttaattttgaattagttgactgtttttaaatgttaaaaagtttatgccgtctgaagcggattcaggcggcatgagggttagagtttgtggcagatgtcgccgaagcggaatcctgcccagtcgatgccgatattttttccgaatgcgatgactttaaacagttcgcccatttcatgctggtcaatcagtttctgaacggcagcagcttcacagatgtaggctgccgaatccgttttccccgtctgtgccaatagctcggtaatgcccaagttcaataagaaatgggattggggaaggtaacctatcaaatctaatccggcatccgtccctgcttgtgcaatgtcggtaaagttgacatgtgcggtcaggtcggccaatccgatgaagtcaaaaggattgtggataatgtgatgtcggtagtgtccgatcagagtaccttgattgcgttgagggtggtaatactgcgctgcatcaaaaccgtagtcgatgaatatcatgcagccgtgttcgagtcttgaggcaagggtgcggataaaggcatattgttgcggatgtagttcgctggtatagggataatctgtttgaggaaaatagagggaagccaaggcagatagctgcaagtcgtgcagcggtcgtgccgaataggtaaaacggtcattatctaggcaaacgccgacatgctcgaatgagccgccttcatttttacggacgatttcgacaggcatggcatcgagtacttcgttgccgatgatgatgccgtcaaacgcttcgggaagtgcggtcaagtggacaactttttgagatgcttccggtgcgcgtgcttgaatcaggtttttctgacgtgctgccagctccggcgatatttcaataatatagtaacggctgatgccgtccgaaatgctgcccaacaaatcggcggcaagctgtccggttcccgcgccgaattcatagatattgcccgccgtttgggatagaagttcttgaagttggcgtgccagtgtctgtgcaaacagagaggtgagggtcggtgcggtaataaaatccccggtattgccgattttatggctgccgccggtgtagtagccgtattgcggagcgtataaaaccaattccataaaacgtgaaaatggaatccagttgccgtgtttgccgattttttcggcaatgagggtttgcagtttgagcgagaattgccgtgcttcgggagaggggaggggcatgataagtgttagcttgtgtaaatttattggatttcccgacatattacacgttggtacgggtgctgtcatggctttatcttaatactatatattgtgtttatattattaaattaatcatatatagttgtttattggttcgattattctgtaccgcacccgccgtgccgttgtcgtcattttttatcttattgtttttaaaaggaataaaaatttcagatatgttaatgagttttcatgccctgatttgaccgagtgtttaaaatttcttatagtgtcgattggtggggaattgtggggcaaagtgtctcttttacccttgtgattttgatttcggcttgggacatgtcatgttcggcggcgcacacgaattaagcatcgacagtaaggggcggttggctgttcctgccaaattccgtgacattctgtcgcgcctctatacgcctgccgtagtggtaacgctcgagtcgaaacacaagctgttgatgtaccctgttgcggagtgggaaaaggttgcggcgcaacttttaaacttaaaagtggcggataaccctgttttgcggcggtttcaaaatcttttgctgcataacgcggaaattttggaatgggacagcgccggccgggtgctggtttctgccggactgaggaagagggtggatttcgaccgtgaagtcgttttggtcggtcgtgccaaccgtttggagctttggggtcgcgagcagtgggaggctgagatggttcaggctttggatgacgatcctgacgaacttgccttccagttgagtcagacggatttgcaattgtgagtggagcagaaagttaccggcatatcacggtcttgctgaatgaggcggtggatgcgcttgccgtgcgcgaagacggtgtctatgtggacggtacgttcggcaggggagggcattcccggctgattttgtcgcgtttgggcgatgcggggcggttgattgttttcgacaaagacccgcaggcgattgctgtggcagaagagctggcgcgttcggacaaacgggtcggtgtcgtgcatggcggttttgcttcgtttcagacggcattggacggtttgggtatcggcaaggtggacggtgcgctgtttgatttggggatttcgtccccgcaaatcgatgacggcagccgcggtttcagcttccgtttcgatgcccctttggatatgcgtatggatacgacgcgcggtatgtctgccgcagagtggatagcggttgcgtcggaacaggatttgcacgaggtaatcaagaattatggtgaagagcggtttagccgccggattgcgcgcgccattgttgcgcaacgggcggaaagtccaatcgatacaacccgcaagctggcgcagatcgtggcacaaaacgtccgtactcgcgagcgggggcaggatcctgcgacgcgcaccttccaggcggtccgcatctttattaaccgcgagcttgaagaagtaggggcagtattgccgcaggtcatgtgtcgtctgaaagagggcggacgtttggcggtcattgctttccattcgttggaagatcgcattgtgaagcagtttgtcaaaaaatattcgcaacacgcgcccctgccgcgctgggcggcggtcagggaagcggatttgcccgagctgcccctgaaaatcgtgggcagggcattaaagccgggtgaggcggaaattgccgccaatccgagggcgagaagtgcggttttgcgtgtggcggagcggactgccggtccgataccggaacaatcacagagaaaaacgtctgaatggcaatgaacaaattgaatttccttctgctgcttgcggtgtgcgtttccgctttttccgttgtgatgcagcaaaaccagtacaggctcaatttcacagctttggataaggcgaaaaaacaggaaatcgccttggagcaggattatgcgcaaatgaggctgcaacaggcgcgtttggcgaaccacgaagcgatcagggcggcggcagaaaaacaaaacctccatccgccggtttcgggcaatacctttatggtggagcatcaaagatagaagcagcctgtgtgccggaatcggattcctgcgtcaggataataataacgagaagtaaaaatgttgattaagagcgaatataagcctcggatgctgcccaaagaagagcaggtcaaaaagccgatgaccagtaacggacggatcagcttcgtcctgatggcaatagcggtcttgtttgccggtctgattgctcgcggactgtatctgcagacggtaacgtataactttttgaaagaacagggcgacaaccggattgtgcggactcaaacattgccggctacacgcggtacggtttcggaccggaacggtgcggttttggcgttgagtgcgccgacggagtccctgtttgccgtgcctaaagagatgaaggaaatgccgtctgccgcacaattggaacgcctgtccgagcttgtcgatgtgccggttgatgttttgaggaacaagctcgaacagaaaggcaagtcgtttatctggattaagcggcagctcgatcccaaggttgccgaagaggtcaaagccttgggtttggaaaactttgtatttgaaaaagaattaaaacgccattacccgatgggcaacctgtttgcacacgtcatcggatttaccgatattgacggcaaaggtcaggaaggtttggaactttcgcttgaagacagcctgcatggcgaagacggcgcggaagtcgttttgcgggaccggcagggcaatattgtggacagcttggactccccgcgcaataaagccccgaaaaacggcaaagacatcatcctttccctcgatcagaggattcagaccttggcctatgaagagttgaacaaggcggtcgaataccatcaggcaaaagccggaacggtggtggttttggatgcccgcacgggggaaatcctcgccttggccaatacgcccgcctacgatcccaacaggcccggccgggcagacagcgaacagcggcgcaaccgtgccgtaaccgatatgatcgaacccggttcggcaatcaaaccgtttgtgattgcgaaggcattggatgcgggcaaaaccgatttgaacgaacggctgaatacgcagccttataaaatcggaccgtctcccgtgcgcgatacccatgtttacccctctttggatgtgcgcggcatcatgcagaaatcgtccaacgtcggcacaagcaaactgtctgcgcgtttcggtgccgaagaaatgtatgacttctatcatgagttgggcatcggtgtgcgtatgcactcgggctttccgggcgaaactgcaggtttgttgagaaattggcgcaggtggcggcctatcgaacaggcgacgatgtctttcggttacggcctgcaattgagcctgctgcaattggcgcgcgcctataccgcactgacgcacgacggcgttttactgccggtcagctttgaaaaacaggcggttgcgccgcaaggcaaacgcatattcaaagaatcgaccgcgcgcgaggtacgcaatctgatggtttccgtaaccgagccgggcggcaccggtacggcgggtgcggtggacggtttcgatgtcggcgcgaaaaccggcacggcgcgcaagttcgtcaacgggcgttatgccgacaacaaacacatcgctacctttatcggttttgcccccgccaaaaatccccgtgtgattgtggcggtaaccattgacgaaccgactgcccacggttattacggcggcgtagtggcagggccgcccttcaaaaaaattatgggcggcagcctgaacatcttgggcatttccccgaccaagccactgaccgccgcagccgtcaaaacaccgtcttaatccgagtatcaacgagattgttttatgttcagcaagttaacccctttggctgaaaccggcatcccgactctgtcgtgtgcaaacgcggcagggcgtttgttgcattcagacagccgccaaatcaaacaaggcgatattttcgttgcctgtccgggcgaatatgccgacggacgcagttatatccccgccgccgttgccaacggcgcggcttttgttttttgggacgacgacggcaaatttgcgtggaatcccgaatggaaagtccccaatcaaggcatcaaagatttgaaacaccgtgccggcatattggcggcgcaagtttacggcaacgtttcagacggcctcaaagtttggggcgtagccggaaccaacggcaaaacctccatcacacaatggctggcgcaagctgccgatttgttgggcgaaaaaaccgccattgtcggcacggtcggcaacggcttttggggtgcattggaagaaaccacgcataccacacccgcccccgtcgatgtccaaaccctgctctaccgtttccgtcaacaaggcgcaacagtcgccgcgatggaagtctccagccacgggcttgaccagtcgcgcgtcaacggcgtgtcattccgcagcgcaatctttaccaacctcacccgcgaccacctcgactaccacggcacgatggaagcctacggtgccatcaagtcgcgcctgttttactggcacggcttgaaacacgcagtcatcaacgtggatgacgaatacggcgcggaactcgtaggtcgtctgaaaaaagactgtcccgatttggccgtttacagctatggtttcagcgaacacgccgacatccgcattaccgactttaccgcctcttcagacggcatagcagccgtattccaaaccccgtggggcgaagggaaatgccgcacgcgcctgctcggacggttcaacgcgcaaaacctcgccgcctgcatcgccttgctgtgcgccaacggctatccgcttgataaggtattggatgtgctggcaaaaatccgtcccgcttcagggcgcatggactgcatcatgaacagcggcaagcccttggtcgttgtcgattatgcccacacgcccgacgcattggaaaaagcactcgccaccttgcaggaaatcaaaccgcagggtgcggctttatggtgcgtattcggttgcggcggcaaccgcgatcgcggcaaacgcccgctgatgggcgcggcagccgtacagggcgcggataaagtcgtcgtcaccagcgacaacccgcgtttggaaaatccgcacgacatcatcaacgacatcctgcctgccgttcccgcgcccgaatgcgtcgaagccgaccgtgccgccgccgtccgttatgcggttgaacaagccgccgcaaacgacatcatcctgattgccggcaaagggcatgaaaactatcaggatgtacaaggcgtgaagcaccgtttttccgatcttgaaatcgtcggacaggctttgttaactcgtaaataatgggatattcggacggcatcgtatgaaacaatccgcccgaataaaaaatatgaatcagacattaaaaaatacattgggcatttgcgcgcttttagccttttgttttggcgcggccatcgcatcaggttatcacttggaatatgaatacggctaccgttattctgccgtgggtgctttggcttcggttgtatttttattattattggcacgcggtttcccgcgcgtttcttcagttgttttactgatttacgtcggcacaaccgccctatatttgccggtcggctggctgtatggtgcgccgtcttatcagatagtcggttcgatattggaaagcaatcctgccgaggcgcgtgaatttgtcggcaatcttcccgggtcgctttattttgtgcaggcattatttttcatttttggcttgacagtttggaaatattgtgtatcgggggggggtatttgctgacgtaaaaaactataaacgccgcagcaaaatatggctgactatattattgactttgattttgtcctgcgcggtgatggataaaatcgccagcgataaagatttgcgagaacctgatgccggcctgttgttgaatattttcgacctgtattacgatttggcttccgcgccggcacaatatgccgccaagcgcgcccacattttggaagcagcaaaaaaagcgtcaacatggcatatccgtcatgttgcgcccaagtataaaaattatgttgtggttatcggtgagagcgcgcgttcggattatatgaatgtttacggtttcccattgcccgatacgccttttttgagtcagaccaaagggctgttgataaacggttaccaatcgaccgcccacgcgacgaatctttcgctgccgcagactttggggctgccgggagaaccgaacaataacatcgtcagcttggcgaagcaggcgggttttcggacggcgtggctgtctaatcaaggaatgttggggcattttgccaacgaaatttccacctatgccctacgcagcgattatccgtggtttacccaaaggggtgattatggcaaaagcgcggggttgagcgaccgccttttgttgccggcgttcaaacgggttttgataggaaatgcaggcacgaagcctcggctgattgtgatgcacctgatgggttcgcacagtgatttttgcacacgtttggataaggatgcgcggcggtttcagtatcaaactgaaaaaatatcctgctatgtttccaccatcgcgcaaaccgataaatttttagaagatacagttaagatattgaatgaaaataaagaaagctggtctttggtttacttttccgaccacggtttgatgcatgtcggtaaaggcggcgagcgaacgttgacacatggtgcgtggaagcgtcaaagctacggcgtgccgctggttaaaatttcgtccgatgacacgcggcgcgaaatgattaaagtgaggcgcagcgcgtttaattttttacgcggattcggcagttggacgggtatcgaaaccgacgagttgcccgatgacggctatgatttttgggggaatgttcccgatgtgcagggcgaaggcaataaccttgcctttatcgacggactgcccgacgaccccgcgccgtggtatgcgggaaaaggcaaatcgactaaaaatacgtctaaaaaatgatacgtacagaaaaaatgccgaatgagaatgggaaaataatctgtgttttaccacagcaaaacaggcgataaaaaaatcagccgctaccgatgtgtccgccgcccgaatattaacgaaagtaaatatgaaaccactggacctaaatttcatctgccaagccctcaagcttccgatgccgtctgaaagcaaacccgtgtcgcgcatcgtaaccgacagccgcgacatccgcgcgggcgatgtgtttttcgcattggcgggcgagcggtttgacgcgcatgattttgttgaagacgtattggctgctggtgcggcggcggttgtggtttcgcgcgaagattgtgctgcaatggatggcgcgttgaaagtcgatgacacgcttgccgcattgcaaacgctggcaaaggcgtggcgtgaaaatgtgaatccgtttgtgttcggcattaccggttcgggcggcaagacgacggtgaaggaaatgctggctgcggtattgcgccgccgtttcggcgatgatgccgtgttggcgacggcaggcaacttcaacaaccatatcggattgccgctgactttgttgaagttaaacgaaaaacaccgctatgccgtgattgaaatgggcatgaaccatttcggcgaactggcggttttaacgcaaatcgccaaaccaaatgccgcattggtcaacaacgccatgcgcgcccatgtcggctgcggtttcgacggagtgggcgatattgccaaagcgaaaagcgagatttaccaaggtttatgttcagacggcattgcactgattcctcaagaagatgccaatatggctgtcttcaaaacggcaacgcttaatttgaatacgcgcactttcggcatcgatagcggcgatgttcacgcggaaaatattgtgctgaaaccgttgtcgtgcgaatttgatttggtgtgcggcgatgagcgcgccgccgtggtgctgcctgttcccggccgccacaatgtccacaacgccgccgctgccgccgcgctggctttggctgcgggtttgagtttgaacgatgtggcggaaggtttgaaaggcttcagcaatatcaaaggccgtctgaacgtcaaatccggaatcaagggcgcaaccctgattgacgatacttataatgcgaaccctgacagcatgaaagctgcgattgacgtgttggcgcgtatgcctgcgccgcgtattttcgtgatgggcgatatgggcgaactgggcgaactgggcgaggacgaagccgccgctatgcacgccgaagtcggcgcgtatgcccgcgaccaaggcatcgaagcggcttattttgtcggcgacaacagcgtcgaagcggcggaaaaatttggcgcggacggtttgtggttcgccgccaaagacccgttgattcaagtgttgcgccacgatttgcccgaacgcgccaccgtgttggtgaaaggttcgcgctttatgcagatggaagaagtggtcgaggcattggaggataagtgaaaatgaaaagccgacgtttttttaaagccttattgctgattgccgcgctggtcggcgcgttttatgccggaatgcggacgcaggcgtatctttatgaagatttatgtttagacttgggcggcggtaaaaatccggggagttacccaatttgcgtgattgagaaagtccctgcacgttaatctgcaaaagccgtccgaaaccttgccgggcggcaagccaacctcaaacgggcgcaggcccgatgtatagtggattaacaaaaatcaggacaaggcgacgaagccgcagacagtacaaatagtacggaaccgattcacttggtgcttcagcaccttagagaatcgttctctttgagctaaggcgaggcaacgccgtactggtttttgttaatccactataacgacaaaacaaaaaaaggaagccccatgtttttatggctcgcacatttcagcaactggttaaccggtctgaatatttttcaatacaccacattccgcgccgtcatggcggcgttgaccgccttagcgttttccctgatgttcggcccgtggacgatacgcaggctgaccgcgctcaaatgcgggcaggcagtgcgtaccgacggtccgcaaacccacctcgtcaaaaacggcacgccgacgatgggcggttcgctgattctgaccgccattaccgtgtccaccctgttgtggggcaactgggcaaacccgtatatctggattctcttgggcgtattgctcgccacgggcgcactcggtttttacgacgactggcgcaaagtcgtctataaagaccccaacggcgtgtccgccaaattcaaaatggtgtggcagtcaagcgttgccattatcgccagtttggcattgttttaccttgccgccaattccgccaacaatattttgattgtcccgttcttcaaacaaatcgccctgccgctgggcgtggtcggctttttggtgttgtcttacctgaccatcgtcggcacatccaatgccgtcaacctcaccgacggcttggacggccttgcgaccttccccgtcgtcctcgttgccgccggcctcgccatcttcgcctatgccagcggccactcacaatttgcccaatacctgcaattaccttacgttgccggcgcaaacgaagtggtgattttctgtaccgccatgtgcggcgcgtgcctcggtttcttgtggtttaacgcctatcccgcgcaagtctttatgggcgatgtcggtgcattggcattgggtgccgcgctcggtaccgtcgccgttatcgtccgccaagagtttgtcctcgtcattatgggcggattatttgtcgtagaagccgtatccgttatgcttcaggttggctggtataagaaaaccaaaaaacgcatcttcctgatggcgcccatccatcaccactacgaacaaaaaggctggaaagaaacccaagtcgtcgtccgcttttggattattaccatcgtcttggtgttgatcggtttgagtaccctcaaaatccgctgaacctatgccgtctgaacatctttcagacggcatttgaacgcgcaataaacctgcggcgacaatccgcccagccctatcgttaacggtggctgaaacccgccttatactaaaacagaagtaaaaccatgaaacagacagtcaaatggcttgccgccgccctgattgccttgggcttgaaccgagcggtgtgggcggatgacgtatcggattttcgggaaaacttgcaggcggcagcacagggaaatgcagcagcccaatacaatttgggcgcaatgtattacaaaggacgcggcgtgcgccgggatgatgctgaagcggtcagatggtatcggcaggcggcggaacaggggttagcccaagcccaatacaatttgggctggatgtatgccaacgggcgcggcgtgcgccaagatgataccgaagcggtcagatggtatcggcaggcggcagcgcagggggttgtccaagcccaatacaatttgggcgtgatatatgccgaaggacgtggagtgcgccaagacgatgtcgaagcggtcagatggtttcggcaggcggcagcgcagggggtagcccaagcccaaaacaatttgggcgtgatgtatgccgaaagacgcggcgtgcgccaagaccgcgcccttgcacaagaatggtttggcaaggcttgtcaaaacggagaccaagacggctgcgacaatgaccaacgcctgaaggcgggttattgaacagctcgcgatgccgtctgaaagcggcttgggcaggggcggacatctcctgctcaatatgatttgttttaggacaaaccaaaatgacttttcaaaacaaaaaaatcctcgtcgccggactcggcggtacgggtatttccatgattgcctacctgcgcaaaaacggcgcggaggttgctgcgtatgatgcggagctgaagccggaacgcgtgtcgcaaatcggtaagatgtttgacgggttggtgttttacacgggccgtctgaaagatgcgctggacaacggtttcgatattctggctctcagtcccggcatcagcgagcggcagccggatattgaggcgttcaagcaaaacggcggacgcgtgttgggcgacatcgaattgctggcggacattgtgaaccgccgggacgacaaggtaattgcgattaccggcagcaacggcaaaaccacggtaacgagcctggtcggctatctctgtatcaagtgcgggctggataccgttatcgcgggcaatatcggcacgccggttttggaggcggaatggcagcgcgaaggcaaaaaggcggacgtgtgggtgttggagctttccagcttccaactggaaaacaccgaaagcctgcgtccgactgcggcgacggtgctgaacatttccgaagaccatctcgaccgctacgacgacttgctcgactatgcgcataccaaagccaagattttccgtggcgacggcgtgcaggttttgaatgcggacgatgcgttctgccgcgcgatgaagcgtgccgggcgcgaggtaaaatggttttcgttggaacacgaagctgatttctggttggaacgcgagacaggccgcctgaaacaaggcaatgaagatttgattgtcacgcaagacattccgttgcaaggtctgcacaacgccgctaacgtcatggctgccgtggctttgtgtgaggccatcggtttgtcgcgcgaagcattgctcgaacacgtcaaaaccttccaaggcctgccgcaccgcgtggaaaaaatcggcgagaaaaacggcgtggtgtttatcgacgacagcaaaggcacgaatgtcggcgcgactgccgccgcgattgccggtttgcaaaatccgctcttcgtgattttgggcggcatgggtaaagggcaggacttcacgcccctgcgcgatgcactggtaggcaaggcaaaaggcgtgttcttgattggtgtcgatgcgccgcaaatccgccgcgatttggacggctgcggcttgaatatgaccgactgcgccactttgggagaagccgttcagacggcatatgcccaagccgaagcaggcgatattgtgttgctcagccccgcctgcgcgagctttgatatgttcaaaggctacgcgcaccgttcggaagtgtttatcgaagcgtttaaggctttgtgatgccgtctgaaatgcaaacgccgtcattgttgggcggcaagtaaagatttagaataccgatttgggatgtatcgtatgttcggacggcattgtctgccgtctgaaatttttgccctttgcggcaggtgcaaacagactggcaggtggtttttttgaagatttcggaagtattggtaaaagtgggcgacggtgtccacactctgctgctcgacaggccgattgtgcgcgacggcaggaaattcgacgcgccgcttttgtggatggtggtgctgatgacggcgttcagcctgctgatgatttattcggcttctgtgtatttggcatcaaaagaaggcggcgatcagtttttctatttgaccagacaggcggggttcgtcgttgccggcttgatagcgagcggtttgttatggtttctttgcaggatgaggacatggcggcggcttgtgccgtggatttttgccctatccggcctgttgctggtagtcgtattgattgccgggcgcgaaatcaatggcgcgacccgttggatacctttgggtccgttgaatttccagccgaccgagctgttcaagctggcggtcatcctttatttggcaagcctgttcacgcgccgtgaagaagtgttgcgcagcatggaaagtttgggttggcagtcgatttggcgggggacggccaatctgatcatgtccgccaccaatccgcaggcacgtcgtgaaacattagaaatgtacggccgtttccgggcgatcatcctgccgattatgctggtggcgttcggtttggtgctgataatggtacagccggatttcggttcgtttgtcgtcattaccgtcattgccgttggaatgctgtttttggcaggattgccgtggaaatattttttcgtcctggtaggcagcgtcttgggcgggatggtgctgatgattaccgccgctccctaccgtgtgcagcgggtagtggcatttttggacccgtggaaagacccgcagggtgccggctaccagcttacccactctctgatggcaatcgggcgcggagagtggttcggtatgggtttgggtgcgagtttgagcaaacgcggctttctgccggaagcgcataccgattttatttttgccatcatcgccgaagaattcggtttcttcggtatgtgcgtgctgatattctgttacggctggctggtggtgcgggcgttttccatcggcaagcagtcgcgcgatttgggtttgactttcaacgcctatatcgcttcgggtatcggcatttggatcggtatccaaagtttcttcaatatcggtgtgaacatcggtgctttgccgaccaaaggtctgacgctgccgttgatgtcctatggcggttcgtcagtctttttcatgctgatcagcatgatgctgctgttgcgtatagattatgaaaaccgccggaaaatgcgcggttatcgggtggagtaaatcatgggcggtaaaacctttatgctgatggcgggcggaacgggcggacatattttccccgcgctggcggtggcggattcattgcgcgcgcgcggccatcatgtgatttggctgggcagcaaggattcgatggaagagcgtatcgtgccgcaatacggcatacgcttggaaacgctggcgattaaaggcgtgcgcggcaacggcatcaaacgcaaactgatgctgccggttactttgtatcaaaccgtccgcgaagcgcagcggattatccgcaaacaccgtgtcgagtgcgtcatcggcttcggcggcttcgttaccttccccggcggtttggcggcgaagctattaggcgtgccgattgtgattcacgagcaaaacgccgtggcaggtttgtccaaccgccacctgtcgcgctgggcgaagcgggtgttgtacgcttttccgaaagcgttcagccacgaaggcggcttggtcggcaaccccgtccgcgccgatattagcaacctgcccgtgcctgccgaacgcttccaagggcgtgaaggccgtctgaaaattttggtggtcggcggcagtttgggcgcggacgttttgaacaaaaccgtaccgcaggcattggctttgctgcccgacaatgcgcgtccgcagatgtaccaccaatcgggacggggcaagctgggcagcttgcaggcggattacgacgcgctgggcgtgaaagccgaatgcgtggaatttattaccgacatggtgtccgcctaccgcgatgccgatttggtgatttgccgtgccggcgcgctgacgattgccgagttgacggcggcgggattgggtgcgttgttagtgccgtatcctcacgcggttgacgatcaccaaaccgccaacgcgcgttttatggtgcaggcggaggcgggattgctgttgccgcaaacccagttgacggcggaaaaactcgccgagattctcggcggcttaaaccgcgaaaaatgcctcaaatgggcagaaaacgcccgtacgttggcactgccgcacagtgcggacgacgtggcggaagccgcgattgcgtgtgcggcgtaaactgccgaaccatgccgtctgaaaagccgttcagacggcatggatgttttttatttcaatccgctatatatttgtcagaaaactatggcgcgcaaacggtcagccctttaaaataacgcctttacgcatcgaaaatccaccggaacgcaacattatgatgaaaaatcgagttaccaacatccattttgtcggtatcggcggcgtcggcatgagcggcatcgccgaagtcttgcacaatttgggctttaaagtttccggttcggatcaggcgcgaaatgccgctaccgagcatttgggcagcctgggcattcaagtttatcccggccataccgccgaacacgttaacggtgcggatgtcgtcgttacctctaccgccgtcaaaaaagaaaatcccgaagttgtcgctgcgttggagcagcaaattcccgttattccgcgcgccctgatgttggcggagttgatgcgcttccgtgacggcatcgccattgccggcacgcacggcaaaaccacgaccaccagcctgaccgcctccatcctcggcgcggcaggacttgacccgactttcgttatcggcggcaaactcaacgccgcaggcactaacgcccgcttgggcaaaggcgaatacatcgttgccgaagccgacgagtcggatgcatcctttctgcacctgacaccgattatgtccgtcgttaccaatatcgacgaagaccatatggatacctacgggcacagcgtcgaaaaactgcatcaggcgtttatcgatttcatccaccgtatgcccttctacggcaaagcctttttgtgtattgacagcgaacacgtccgcgcgattttgcccaaagtgagcaaaccttatgctacttacggtttggacgataccgccgacatctacgccaccgacatcgaaaacgtcggcgcgcaaatgaaattcaccgtccatgttcaaatgaaaggacatgagcaggggtcgtttgaagtcgtgctgaatatgcccggcagacacaacgtgctgaacgcattggcagccatcggcgtggcgctggaagtcggcgcatcggttgaagcgatccaaaaaggcttgctcggctttgaaggcgtcggccgccgcttccaaaaatacggcgacatcaagttgccaaacggcgggaccgcgctcttggtggacgactacggacaccaccccgtcgaaatggcggcgacccttgccgccgcacgcggcgcgtatctggaaaaacgtttggtactcgccttccagccgcaccgctatacccgcacgcgcgatttgtttgaagactttaccaaagtcctcaataccgttgacgcgctggtgctgaccgaagtttatgccgccggtgaagagccgattgccgccgccgattcccgcgctcttgcccgcgccatccgcgtgttgggcaaactcgagccgatttactgcgaaaacgttgccgatctgcccgaaatgctgttgaacgttttgcaggacggcgacatcgtgttgaatatgggcgcgggaagcatcaaccgcgtccccgccgcgctgctggcattgtcgaaacagatttgaggcacacccgcctgacagacggaacatcatataaagatcgtctgaaaccgcaaatcaggtttcagacgacctctggcaacaagcataaagcaatcaggaaagaacaaaaacaatgcagaattttggcaaagtggccgtattgatgggcggtttttccagcgaacgagaaatctcgctggacagcggcaccgccattttgaatgctttaaaaagcaaaggcatagacgcatacgccttcgatcctaaagaaaccccattgtctgaattgaaggcacaaggttttcagacggcattcaacatccttcacggtacttacggcgaagacggggcggttcagggtgcattggaactgttgggcattccctataccggcagcggtgtcgccgcatccgccatcggcatggacaaataccgctgcaaactgatttggcaggcattgggattgcccgttcccgagttcgccgtcctgcacgacgacactgatttcgatgccgtcgaagaaaaattgggcctgccgatgtttgtgaaaccggcggccgaaggcagcagcgtaggcgtggtaaaagtcaaaggaaaaggccgtctgaaaagcgtttacgaagaattgaaacaccttcagggcgaaatcattgccgaacgttttatcggcggcggcgaatattcctgccccgtcctgaacggcaaagggctgcccggcatacacatcattcccgcaaccgagttttacgactacgaagccaagtacaaccgcgacgacaccatttatcaatgtccttcggaagatttgaccgaagccgaagaaagcctgatgcgcgaactggcggttcgcggcgcgcaggcaatcggtgcggaaggctgcgtgcgcgtcgatttcctcaaagataccgacggcaaactctatctgttggaaatcaacaccctgcccggtatgacgagccatagtttagtaccgaaatccgctgccgttacgggcgtgggttttgccgatttatgtattgaaattttgaagaccgcacatgtgggataatgccgaagcgatggaacggctgacgcgctggctgcttgtcatgatggcgatgctgcttgctgcgtccgggctggtttggttttacaattcgaatcatctgcccgtcaagcaggtgtcgctgaagggcaacctggtttattccgataagaagacattgggcagtttggcgaaagaatacatccatgggaatattttgaggacggacatcaatggcgcacaggaggcctaccgccggtatccgtggattgcgtcggtcatggtgcgccgccgttttcccgacacggttgaggtcgtcctgaccgagcgcaagccggtcgcgcgttggggcgaccatgccttggtggacggcgaaggcaatgtttttgaagcccgcttggacagacccggaatgccggtattcagaggcgcggaaggaacgtctgccgaaatgctccgccgttatgacgaattttcgactgttttggcaaaacagggtttgggcatcaaagagatgacctatacggcacgttcggcgtggattgtcgttttggacaacggcatcaccgtcaggctcggacgggaaaacgagatgaaacgcctccggctttttaccgaagcgtggcagcatctgttgcgtaaaaataaaaatcggttatcctatgtggatatgaggtataaggacggattttcagtccgctatgcttccgacggtttacccgaaaaagaatccgaagaatagtgggaacaggtatcggacagattacggccgtgccgtctgaaacggtgcgacgcaaatttcaatcagttttaagagcagacgaacaatggaacagcagcaaagatacatcagcgtactggatatcggtacgtctaaagtcctcgcactgatcggggaagttcaagatgacgacaaaatcaacatcgtcggtttggggcaggctccttcacggggcttgcgcgcgggcatggtaaccaatatcgatgccaccgtccaagccatcaggcaggcggtcaatgatgccgagctgatggcggataccaaaattactcacgttaccacaggtatcgcaggcaaccacatccgcagtctcaattcgcaaggtgtggttaaaattaaagatggggaagtcacgcaggcagacatcgatcgcgccattgaaacggcaaaggcaatcaatatcccgcccgatcaaaaaattctcgatgccgtggttcaagactacattattgacacccaacttggcgtgagggagcccatcggtatgagcggtgtgcgtctggatacgcgggtgcacatcattaccggtgcaagtacggcagtgcagaatgtccaaaaatgtatcgagcggtgcggtttgaaaagcgatcagatcatgcttcagccgttggcaagcgggcaggcggtgctgactgaagatgaaaaagacctcggcgtatgcgtcatcgacattggtggcggaacgaccgatattgccgtttatatgaacggtgccatccgccatacgtccgtcattccggccggtggtaatctgattaccaaagatttgtccaaatcgttgagaacacctctcgatgccgccgagtacattaaaatccattatggcgtggcatcatgcgatacggaaggcttgggtgagatgattgaagttccgggcgtgggtgaccggacatcgcgtcaggtttccagtaaggttctggcagcaatcatcagtgcacggattcaggagatttttggcgtagtgctgggcgagctgcaaaaatcgggtttccccaaagaagtgctgaatgcgggtatcgttctgaccggcggtgtgtccatgatgaccgggattgtggaatttgccgaaaaaatcttcgatttgcctgtacgcaccggtgcaccccaagaaatgggcggtttgtccgaccgcgtccgcacaccgcgtttttctaccgctatcgggctgcttcatgcagcatgcaagctggaaggaaacttgccgcagccggaaaacggtgcagtgcaagagagggaagggggcggcggtttgttggcaagattgaaacggtggattgaaaacagcttctgaacaggtggattgccgtttgacaggtgagaagtattttgccagcagcaagatacttcttatataatgaataataatttatttaaaccgtcctctgaatggggcgagcaggagtttttgaatggaatttgtttacgacgtggcagaatcggcagtcagccctgcggtgattaaagtaatcggcttgggcggcggcggttgcaatgcaatcaataacatggttgccaacaatgtgcgcggtgtggagtttatcagtgccaatacggatgcgcagtctctggcaaaaaaccatgcggcgaagagaatccagttgggtacgaatctgacacgcggtttgggcgcgggcgcgaatcccgatatcggccgtgcggcagcccaggaagaccgggaagccattgaagaagccattcgcggtgcgaatatgctgtttatcacgaccggtatgggcggcggtaccggtaccggttccgcgccggttgttgctgagattgccaagtctttgggcattctgaccgttgccgtggttacccgaccgttcgcatatgaaggtaagcgcgtccatgtcgcacaggcagggttggaacagttgaaagaacacgtcgattcgctgattatcatcccgaacgacaaactgatgactgcattgggtgaagacgtaacgatgcgcgaagccttccgtgccgccgacaatgtattgcgcgatgcggtcgcaggcatttccgaagtggtaacttgcccgagcgaaatcatcaacctcgactttgccgacgtgaaaaccgtgatgagcaaccgcggtatcgctatgatgggttcgggttatgcccaaggtatcgaccgtgcgcgtatggcgaccgaccaggccatttccagtccgctgctggacgatgtaaccttggacggagcgcgcggtgtgctggtcaatattacgactgctccgggttgcttgaaaatgtccgagttgtccgaagtcatgaaaatcgtcaaccaaagcgcgcatcccgatttggaatgcaaattcggtgcggctgaagacgagaccatgagcgaagatgccatccggattaccattatcgctaccggtctgaaagaaaaaggcgcggtcgattttgttccggcaagggaggtagaagcggttgctccgtccaaacaggagcaaagccacaatgtcgaaggtatgatccgcaccaatcgcggtatccgcacgatgaaccttaccgctgcggatttcgacaatcagtccgtacttgacgactttgaaatccctgcgattttgcgtcgtcaacacaattcagacaaataatgtgctgtttgcccgtaaacctgctgcctcccgaatcggtttgtccggtttgggaggtatgtttttcaagatgttgcaatttcgtacggtttgcggtcggcggattcagatttttccacttgatacagactttcagatatggacacttcaaaacaaacactgttggacgggatttttaagctgaaggcaaacggtacgacggtgcgtaccgagttgatggcgggtttgacaacttttttgacgatgtgctacatcgttatcgtcaaccctctgattttgggcgagaccggcatggatatgggggcggtattcgtcgctacctgtatcgcgtctgccatcggctgttttgttatgggttttgtcggcaactatccgattgcactcgcaccggggatggggctgaatgcctatttcacctttgccgtcgttaagggtatgggcgtgccttggcaggttgcgttgggtgcggtgttcatctccggtctgatttttatcctgttcagcttttttaaagtcagggaaatgctggtcaacgcactgcctatgggtttgaaaatgtcgattgctgccggtatcggtttgtttttggcactgatttccctgaaaggcgcaggcattatcgttgccaatccggcaaccttggtcggtttgggcgatattcatcagccgtccgcgttgttggcattgttcggttttgctatggtggtcgtattgggacatttccgcgttcaaggcgcaatcatcatcaccatcttgaccattaccgtcattgccagcctgatgggtttgaatgaatttcacggcatcatcggcgaagtaccgagcattgcgccgacttttatgcagatggattttgaaggcctgtttaccgtcagcatggtcagtgtgattttcgtcttcttcttggtcgatctatttgacagtaccggaacgctggtcggcatatcccaccgtgccgggctgctggtggacggtaagctgccccgcctgaaacgcgcactgcttgcagactctaccgccattgtggcaggtgcggctttgggtacttcttccaccacgccttatgtggaaagcgcggcgggcgtatcggcaggcggacggaccggcctgacggcggttaccgtcggcgtattgatgctcgcctgcctgatgttttcacctttggcgaaaagtgttcccgcttttgccaccgcgcccgccctgctttatgtcggcacgcagatgctccgcagtgcgagggatattgattgggacgatatgacggaagccgcacctgcgttcctgaccattgttttcatgccgtttacttattcgattgcagacggcatcgctttcggcttcatcagttatgccgtggttaaacttttatgccgccgcaccaaagacgttccgcctatggtatggattgttgccgtattgtgggcactgaaattctggtatttgggctgattgattcgatattaaaaatgccgtctgaaaggttttcagacggcattttgtttgccgatatatttaatttttattaaattatataaaaatcaaatacataataaaatacatcggattgcttaaaaataatacattgtttttatgtataaaatattttataagttttcaggattttgattatcaaaaatttttcttgatttcctgacaattttattgaaacaaataattcaaaattaatctagtttaatcatggaattaaaataaaatattaaaattatgtaatgagtctccttaaaaatgtttgacattttcagtcttgtgttttagattatcgaaaaataaaactacataacactacaaaggaacattactatgaaaccaattcagatgttttccccttttctgaataatccccttgttttcttcttgtctgcggttttgccgcataattccgaacggtctgctgtttttctttgattcgttttaaatatcaataagataatttttcccatatatttttaatgattggattgggatgcccgacgcgtcggatggctgtgttttgccgtccgaatgtgatggaagcctgtccatactgaaaaaaagtctataaaggagaaatatgatgagtcaacactctgccggagcacgtttccgccaagccgtgaaagaatcgaatccgcttgccgtcgccggttgcgtcaatgcttattttgcacgattggccacccaaagcggtttcaaagccatctatctgtccggcggcggcgtggcagcctgttcttgcggtatccctgatttgggcattaccacaatggaagatgtgctgatcgacgcacgacgcattacggacaacgtggatacgcctctgctggtggacatcgatgtgggttggggcggtgcattcaatattgcccgtaccattcgcaactttgaacgcgccggtgttgcagcggttcacatcgaagatcaggtagcgcaaaaacgctgcggccaccgtccgaacaaagccattgtatctaaagatgaaatggtcgaccgtatcaaagctgccgtagatgcgcgcgttgatgagaacttcgtgattatggcgcgtaccgatgcgctggcggtagaaggtttggatgccgctatcgaacgcgcccaagcttgtgtcgaagccggtgcggacatgattttccctgaagccatgaccgatttgaacatgtaccgccaatttgcagatgcggtgaaagtgcccgtgttggcgaacattaccgagtttggttccactccgctttatacccaaagcgagctggctgaaaacggcgtgtcgctggtgctgtatccgctgtcatcgttccgtgcagcaagcaaagccgctctgaatgtttacgaagcgattatgcgcgatggcactcaggcggcggtggtggacagtatgcaaacccgtgccgagctgtacgagcatctgaactatcatgccttcgagcaaaaactggataaattgtttcaaaaatgatttaccgctttcagactgcctttcaacaaatccgcatcggtcgtctgaaaacccgaaacccataaaaacacaaaggagaaataccatgactgaaactactcaaaccccgaccctcaaacctaaaaaatccgttgcgctttctggcgttgcggccggtaataccgctttgtgtaccgttggccgtaccggcaacgatttgagctatcgcggttacgacattctggatttggcacaaaaatgcgagtttgaagaagtcgcccacctgctgattcacggccatctgcccaacaaattcgagctggccgcttataaaaccaagctcaaatccatgcgcggcctgcctatccgtgtgattaaagttttggaaagcctgcctgcacatacccatccgatggacgtaatgcgtaccggcgtatccatgctgggctgcgttcatcctgaacgtgaaagccatccggaaagtgaagcgcgcgacatcgccgacaaactgatcgccagcctcggcagcatcctcttgtactggtatcaatattcgcacaacggcaaacgcattgaggttgaaagcgacgaagagaccatcggcggtcatttcctgcaactgttgcacggcaaacgcccaagcgaatcacacatcaaagccatgcacgtttcactgattctgtatgccgaacacgagttcaacgcttctacctttaccgcccgcgtgatcgccggtacaggctctgatatgtactccagcattaccggagcaatcggcgcgttgaaaggtccgaaacacggcggcgcgaacgaagtggcttacgatattcaaaaacgctaccgcaatgccgacgaagctgaagccgacatccgcgaacgcatcggccgcaaagaaatcgtgatcggtttcggtcatccggtgtacaccatttccgaccctcgcaacgttgtcattaaagaagtggcacgcggtttgagcaaagaaaccggcgatatgcgcctctttgacattgccgaacgtttggaaagcgtgatgtgggaagagaaaaaaatgttcccgaatctggactggttctctgccgtttcctaccaaaaattgggcgtaccgaccgctatgttcacaccgctgttcgtaatttcccgtacaaccggttggagcgcacacgttcttgagcaacgcaaagacggcaaaatcatccgtccgagcgcaaactacacaggccctgaagatttggcgtttgtggagattgaagaacgataattgaagaatgcaatagcagtttgttctttaatttcggtatgcaaagctaaggatttcagacgaccttgccttattggaaaggttgtctgaaataagtttaatctaataggagaagataatcctgtattggcgcaagtaacaggataagaaacatggaagatttatatataatactcgctttgggtttggttgcgatgattgccggatttatcgatgcgattgcgggcgggggtggtttgattacgctgcccgcactcttgttggcaggtattcctcccgtgtcggcaattgccaccaacaagctgcaagcagccgctgctacgttttcagctacggtttcttttgcacgcaaaggtttgattgattggaagaaaggtctcccgattgccgcagcatcgtttgtaggcggcgtggccggtgcattatcggtcagcttggtttccaaagatattctgctggcggtcgtgccggttttgttgatatttgtcgcactgtattttgtgttttcgcccaagctcgacggcagtaaggaaggcaaagccagaatgtctttttttctgttcgggctgacggtcgcaccgcttttgggtttttacgacggtgtgttcggaccgggtgtcggctcgttttttctgattgcctttattgttttgctcggctgcaagctgttgaacgcgatgtcttacaccaaattggcgaacgttgcctgcaatcttggttcgctatcggtattcctgctgcacggttcgattattttcccgattgcggcaacgatggcggtcggtgcgtttgtcggtgcgaatttaggtgcgagatttgccgtccgcttcggttcgaagctgattaagccgctgctgattgtcatcagcatttcgatggctgtgaaattgttgatagacgagagaaatccgctgtatcagatgattgtttcgatgttttaaaccctttcagacgaccccttcaaaacgtcggctgaaacctcaaaccacaagaaaaacagatccacaggagaaccgacatggctgccaaccaacgttaccgcaaaccgctgcccggtacggatttggaatactacgacgcgcgtgcggcgtgtgaggacatcaagcccggctcttacgacaagctgccttacacgagccgcattttggcggagaatttggtcaaccgcgcggacaaagtcgatttgccgacgctgcaaagctggctggggcagttgatagaagggaagcaggaaatcgactttccgtggtatccggcgcgggtggtgtgccacgatattctggggcagaccgcgttggtggatttggcaggcctgcgcgatgcgattgccgaaaaaggcggcgatcctgccaaagtgaatccggtggtgcaaacccagctcatcgtcgaccactctctggcggtggagtgcggcggttacgatcctgatgccttccgcaaaaaccgcgaaatcgaagaccgccgtaacgaagaccgtttccacttcatcaactggacaaaaaccgcgtttgaaaatgtggacgtgattccggcgggcaacggcatcatgcaccaaatcaatctagaaaaaatgtcgcccgtcgtccaagtcaaaaacggcgtggctttccccgatacctgcgtcggtactgactcacatacgccgcacgtcgattcattgggcgtgatttccgtgggcgtgggcggattggaagcggaaaccgtaatgctgggacgcgcgtccatgatgcgcctgcccgatattgtcggcgttgagctgaacggcaaacggcaggcgggcattacggcgacggatattgtgttggcactgaccgagtttctgcgcaaagaacgcgtggtcggggcgtttgtcgaattcttcggcgagggcgcgagaagcctgtctatcggcgaccgcgcgaccatttccaacatgacgccggagttcggcgcgactgccgcgatgttcgctattgatgagcaaaccattgattatttgaaactgaccggacgcgacgacgcgcaggtgaaattggtggaaacctacgccaaaaccgcaggcttgtgggcagatgccttgaaaaccgccgtttatcctcgcgttttgaaatttgatttgagcagcgtaacgcgcaatatggcaggcccaagtaacccgcatgcccgttttgcgaccgccgatttggcggcgaaagggctggcgaagccttacgaagagccttcggacggccaaatgcccgacggctcggtcatcatcgccgcgattaccagttgcaccaacacttccaacccgcgcaacgttgttgccgccgcgctcttggcacgcaatgccaaccgtctcggcttgaaacgcaaaccttgggtgaaatcttcgtttgccccgggttcaaaagtagccgaaatctatttgaaagaagcgggcctgttgcccgaaatggaaaaactcggcttcggtatcgtcgccttcgcctgcaccacctgcaacggcatgagtggcgcgctggatccgaaaatccagaaagaaatcatcgaccgcgatttgtacgccaccgccgtattatcaggcaaccgcaacttcgacggccgtatccacccgtatgcgaaacaggctttcctcgcttcgcctccgttggtcgttgcctacgcgctggcaggcagtatccgtttcgatattgaaaacgacgtactcggcgttgcagacggcaaggaaatccgcctgaaagacatttggcctgccgatgaagaaatcgatgccgtcgttgccgaatatgtgaaaccgcagcagttccgcgatgtgtatgtaccgatgttcgacaccggcacagcgcaaaaagcacccagtccgctgtacgattggcgtccgatgtccacctacatccgccgtccgccttactgggaaggcgcgctggcaggggaacgcacattaagaggtatgcgtccgctggcgattttgcccgacaacatcaccaccgaccacctctcgccgtccaatgcgattttggccgtcagtgccgcaggcgagtatttggcgaaaatgggtttgcctgaagaagacttcaactcttacgcaacccaccgcggcgaccacttgaccgcccaacgcgctaccttcgccaatccgaaactgtttaacgaaatggtgaaaaacgaagacggcagcgtgcgccaaggctcgttcgcccgcgtcgaacccgaaggcgaaaccatgcgcatgtgggaagccatcgaaacctatatgaaccgcaaacagccgctcatcatcattgccggtgcggactatggtcaaggctcaagccgcgactgggctgcaaaaggcgtacgcctcgccggcgtagaagcgattgttgccgaaggcttcgagcgtatccaccgcaccaaccttatcggcatgggcgtgttgccgctgcagttcaaacccgacaccaaccgccataccctgcaactggacggtacggaaacctacgacgtggtcggcgaacgcacaccgcgctgcgacctgaccctcgtgattcaccgtaaaaacggcgaaaccgttgaagttcccgttacctgctgcctcgatactgcagaagaagtattggtatatgaagccggcggcgtgttgcaacggtttgcacaggattttttggaagggaacgcggcttagaggtcgtctgaaaagcaagacgtagcgtgggtcgggttcaacattttgctcattcacgtaattctcgatatggcaggcatctactgtaaatcgtcattcccgcgcaggcgggaatccagaaagtggaattgaggaaaccttatttatccgatgagtttctgtgcggacaaatttggattcccgcctgcgcgggaatgacggggtttaataatctgccgtatcacaacacagtagccgtagattgtggcgaaccccgacagtttgcggaatcaaacggctttgtcggagtggcagcctaatgtacttctggaaagtgggtgtagcgtgggctttgcccgcgaaataaaggctgaattgacatggtatagaggattaacaaaaatcgggacaaggcggcgaagccgcagacagtacagatagtacggaaccgattcacttggtgcttgagcaccttagagaatcgttctctttgagctaaggcgaggcaacgctgtactggtttttgttaatccactataaatttaatccactatactgtaaatcgtcattcccgcgcaggcgggaatccagaaagtggaattgaggaaacctttttatccgatgagtttctgtgcggataaatctggattcccgcctgcgcgggaatgacggggtttaataatctgccgtatcacaacacagtagccgtagattggggcgaaccccgacagtttgcggaatcaaacggctttggtcggagtggcagcctaatccactataaaaatcgtgggcagagcccacgctacataaggagaatctagaaatgccgcaaattaaaattcccgccgtttactaccgtggcggtacatcaaaaggcgtgtttttcaaacgttccgacctgcccgaggcggcgcgggaagcgggaagcgcacgcgacaaaatcctcttgcgcgtactcggcagcccggatccctacggcaagcagatagacggtttgggcaacgccagctcgtccaccagcaaggcggtgattttggacaagtccgaacgcgccgatcacgatgtcgattaccttttcgggcaagtttccatcgacaaaccttttgtcgattggagcggcaactgcggcaacctcaccgctgccgtgggcgcattctccatcgaacagggcttggtcgataaaggcaagattccttcagacggcatctgcacggtcaaaatctggcagaaaaacatcggcaaaaccattattgcccatgtaccgatgcaaaacggcgcagttttggaaacaggcgattttgagctcgacggcgtaacgttcccggcagccgaagtacaaatcgaatttcttgatccagccgacggcgaaggcagtatgttcccaaccggcaatttggtcgatgaaattgatgtgccgaatataggccgtttgaaagccacgctcatcaacgcgggcattccgaccgttttcttgaatgccgccgacttgggctacacaggcaaagagttgcaagacgacatcaacaacgatgccgcggctttggaaaaattcgagaaaatccgcgcttacggtgcgctgaaaatgggtctgatcagcgacgtatccgaagctgccgctcgcgcgcacacgccgaaagtcgccttcgtcgcgcccgccgccgattacaccgcctccagtggcaaaaccgtgaacgccgccgacatcgatttgctggtacgcgccctgagcatgggcaaactgcaccacgcgatgatgggtaccgcctctgttgccattgcgaccgccgccgccgtacccggtacgctggtcaaccttgccgcaggcggcggaacgcgtaaagaagtgcgcttcgggcatccttccggcacattgcgcgtcggtgcagccgccgaatgtcaggacggacaatggacggccaccaaagcggtcatgagccgtagcgcacgcgtgatgatggaaggttgggtcagggtgcctgaggattgtttttaaattgacgtagcatgggtttgcccgcgagccataaaaaggtcgtctgaaaaacaagtaaacatcaaatcactgaccattcctttcccttgccctgtggcggaaggcggcaaatcacaaggaagaacacggaaaccccgataaaagacagcttcccgtattaccgtcattcccgcgcaggcgggaatccagacctgtcaatatggaggattggcaggggaaaacaggtttcgtgagttctacattctggattcccgccacagcctgtcctcgcgtaggcggggacggaataacgatagaaaatgcggcatacgctttgcccaaagaggccgtctgaaacaccttgcgcctgatgtctgcctttttcagacgaccccacaccaaaaaaacaaccacaaactacaaggagaaacatcatgtccgaccaactcatcctcgttctgaactgcggcagttcatcgctcaaaggcgccgttatcgaccgaaaaagcggcagcgtcgtcctaagctgcctcggcgaacgcctgaccacgcccgaagccgtcattacgttcaacaaagacggcaacaaacgccaagttcccctgagcggccgaaattgccacgccggcgcggtgggtatgcttttgaacgaactggaaaaacacggtctgcacgaccgcatcaaagccatcggccaccgcatcgcccacggcggcgaaaaatacagcgagtctgttttgatcgaccaggccgtaatggacgaactcaatgcctgcattccgcttgcgccgctgcacaaccccgccaacatcagcggcatccttgccgcacaggaacatttccccggtctgcccaatgtcggcgtgatggatacttcgttccaccaaaccatgccggagcgtgcctacacttatgccgtgccgcgcgagttgcgtaaaaaatacgctttccgccgctacggtttccacggcaccagtatgcgttacgttgcccctgaagccgcacgcatcttgggcaaacctctggaagacatccgcatgattattgcccacttaggcaacggcgcatccattaccgccatcaaaaacggcaaatccgtcgataccagtatgggtttcacgccgatcgaaggtttggtaatgggtacacgttgcggcgacatcgatccgggcgtatacagctatctgacttcccacgccgggatggatgttgcccaagtggatgaaatgctgaacaaaaaatcaggtttgctcggtatttccgaactttccaacgactgccgcaccctcgaaatcgccgccgacgaaggccacgaaggcgcgcgcctcgccctcgaagtcatgacctaccgcctcgccaaatacatcgcttcgatggctgtgggctgcggcggcgttgacgcactcgtgttcaccggcggtatcggcgaaaactcgcgtaatatccgtgccaaaaccgtttcctatcttgatttcttgggtctgcacatcgacaccaaagccaatatggaaaaacgctacggcaattcgggcattatcagcccgaccgattcttctccggctgttttggttgtcccgaccaatgaagaactgatgattgcctgcgacactgccgaacttgccggcatcttgtagccaaaaaagggacgagtccgcaaaaatgccgtctgaaaccccaaacgcccgattaggctgatgaggattttagacggcattgttcatttttttgttatcttgcatttttgtgcggacggtggaatttcatcctgtaaacataaatatttgtcggaaaacagaaaccctccgccgccatttctacgaaagcaggaaaccagcaacgcaaagcgacagggatttgttggaaatgaccgaaaccgaacgaaccggattcccgcctgcgcgggaatgacgggattttctgtttttgtggaaatgacgggattttgaatttcgggcgtacaatacggaaaacatgacgataaggaaacaaaccatggcacagtttttcgctattcatcccgacaatccccaagaacgcctcatcaagcaggcggttgaaatcgtcaataaaggcggcgtggtcgtttatccgaccgattcctgttatgccttgggctgcaaactcggcgataaggcggcgatggaacgcatactctccatccgcaaaatcgatttgaaacaccacctgaccctgatgtgcgcagatttgagcgagttgggcacatacgccaaagtcgacaacgtacagtttcgtcagcttaaagccgccacacccgggccttatacttttattttacaggcgacgaaggatgtgccggcgcgcacgctgcacccgaaacgcaaaaccatcgggctgcgtattcccgataatgccattgcacaagccctgctgggggaattgggcgagccgcttttaagctgcaccctgatgctgcccgaagacggcgaaccattgaccgatccttatgaaatccgcgagcgtttggaacacgccgtcgatttggtgattgacggcggctggtgcggaaccgagccgaccaccgtcgtcgatatgaccgacggcacggaattggtgcgccaaggttgcggcgatacggcggtgttcggtttgtagggaaaccgatgccgtctgaagcatcggctgttcagacggcattgcgcgccttgccggcggcagtccgaaatgccggcgcgtatcgcgctcggtcggaatatccgtttgaaacggcattttgatgcattactgcaccgcaatcggaattctcggttcgtagagcaggtcgtaggtcggcttgttgagcaggtcttggagcgtgaaaccgtccagatacgtgaaaaacgacttcatcgcgccgccgagtatgcccgtcagccggcaggacggtgtaatcaggcattcgttgttctcgcccatgcactcgaccagctgcatcggttcgaggtggcggacaaccgagccgatgttgatgcggtcgggcggtgcggcaagccgcagaccgccgccttttccgcgcacactgtggaggaagccgcctttgaccagcgcggtaacgaccttcatcagatggcttttggaaatgccgtaggttacggcgatggtactgatgttgaccagcgcatcgtcgttgatggcagtgtagataaggacgcgcagcccgtagtccgtatgttgtgtcaaatacatgattttctcggtatggattgttattcttatcggtacggtttaaggttcacggacaataccttaatggttgaaaccctgtccgtcggggcggtagaatgcagcctgtctgcggcggtatgccgtctgaaacatccgcgctaccgtttgagaatttgttattgtaactcaaaatcatgaaaccgttgaaacgacatcccgcccttatcgggctttcgcgtgaccaccaccattcgctttccctgtgcgtgcgtctgttgcggacgccggaagaaaggcatcgggacgaactcgaaccgcatttttccgaattggaaacccattttcgcgaagaagaaaccaagtttgccccaatttggcagaatgtcgcccccgaattgaaacaacgtttcgagaaagaccacgcccgactgcggcagatgatggcaagccccgaatacggtaacgcggcgtggaataccgcttttgccacaaccctgcgcgaccacgcgcgctttgaagaacgcgagctgtttcccgccgccgaaccgtttttgccggcatgattccgttttgcggtaaatatattaatgataaacaaggaacacacatgaaatttaccaagcaccccgtctgggcaatggcgttccgcccattttattcgctggcggctctgtacggcgcattgtccgtattgctgtggggtttcggctacacgggaacgcacgagctgtccggtttctattggcacgcgcatgagatgatttggggttatgccggactggtcgtcatcgccttcctgctgaccgccgtcgccacttggacggggcagccgcccacgcggggcggcgttctggtcggcttgactatcttttggctggctgcgcggattgccgcctttatcccgggttggggtgcgtcggcaagcggcatactcggtacgctgtttttctggtacggcgcggtgtgcatggctttgcccgttatccgttcgcagaatcaacgcaactatgttgccgtgttcgcgctgttcgtcttgggcggcacgcatgcggcgttccacgtccagctgcacaacggcaacctaggcggactcttgagcggattgcagtcgggcttggtgatggtgtcgggttttatcggtctgattggtacgcggattatttcgttttttacgtccaaacgcttgaatgtgccgcagattcccagtccgaaatgggtggcgcaggcttcgctgtggctgcccatgctgactgccatgctgatggcgcacggtgtgttggcttggctgtctgccgtttttgcctttgcggcaggtgtgatttttaccgtgcaggtgtaccgctggtggtataaacccgtgttgaaagagccgatgctgtggattctgtttgccggctatctgtttaccggattggggctgattgcggtcggcgcgtcttatttcaaacccgctttcctcaatctgggtgtgcatctgatcggggtcggcggtatcggcgtgctgactttgggcatgatggcgcgtaccgcgcttggtcatacgggcaatccgatttatccgccgcccaaagccgttcccgttgcgttttggctgatgatggcggcaaccgccgtccgtatggttgccgtattttcttccggcactgcctacacgcacagcatccgcacctcttcggttttgtttgcactcgcgcttttggtgtatgcgtggaagtatattccttggctgattcgtccgcgttcggacggcaggcccggttgagacaaaccgccgcagatttcgggtctgggcggtttgcttttcagacggcagggcggtcagttgccgtccagccagcggtcgcgtgtggttttggcttcttcaaaatagcggtacagggcttcgcggtcgtcggtggtcaggatgtttgccaaaacgtccaactgtttgcccaagccttgaaccagttgcagcaggctgtctttgttggcaaggcagatgtccgcccacacggcgggatgaccggaggcgatgcgggtgaagtcccgaaagcccgtggcggcgaatttcagatattcctgtccgtcggggtggtcgagaatctggtggacataggcgaaggcggtcaggtggggcatatgggagacggcggcgaaaaccgcgtcgtggcgttgcgcgtccatcgtataaatttccgcaccgaccgcgtgccacaggttttctaccaaggcaatgccgtctgaatgttcgccgccgtgtggcgtgatgatgagttttctgtggcggaacagcccgaactgcgcggcttgcgcaccgcttctgtccgaaccggcaattgggtgggcggcgatgcagtggtgcaggcggtcgggcagacagcggcggaaggcttcgatgaccgaagatttggtgctgccgacatcggaaatccaagtgtgttccggcaaaacggggcgcagcgcggtcaaaatggcgggaacggtggcgacgggcgtggcaatcagtaccaagtccgcaccgccgatgctgtccgcgtcgatggcaacggaagcctggtcaatcacgccgcgttccaatgcacgttcgaggttgtcgcggtcggtgtcgataccggtaacggtgcggacgagtccctgccttttgaggtcgagaacgaacgaaccgccgatcagccctacaccgatgagggcaatatggttcaaaatgggcatttgtgtaaacggttttcgcaaagtaccgtcatggtagcctatcggcggaatatgccgcaaggtcggcaggaaaaaggagaagaaatggacaaaatcagagttgccgccgtgcagatggtgtcgggcgtgtcgccggaaaccaacgtcgccgccatgaaacgcctggtcgcacgggcggcggagcagggtgcggattgggtgctgctgcccgaatattgggtgctgatgggcgcaaacgataccgacaaactcgcgcttgccgagcctttgggcggcggacgctttcagacggcattgagcgaaacggcgaaagaatgcggcgtggtgctgttcggcgggactgtgccgctgcaaagctgcgaggcgggtaaagtgatgaatacgctgttggtgtacggacgggacggcgtaaggacggggctgtaccacaaaatgcacctcttcggtttttccggtttgggcgaacgctatgccgaagccgataccatccgcgcgggcggggatgtgccgcacttgtcggcagaaggcgtgccggtggcggcgggcatttgttacgatgtccgctttcccgaatttttccgacgccagttgccgtttgacgtattgatgctgcccgctgcgtttacgcacacgacgggcaaggcgcattgggagctgctgctgcgcgcgcgtgccgtcgaaaaccaatgttacgtcgtggcggcggcacagggcggtttgcacgaaaacggacggcgcacgttcggacacagcatgattgtcgatccgtggggcgacgtgttggacgtattgcccgagggcgaaggcgttgttacggcagacatcgatgccaaccgcctgaacagcgtccgcaaccgcctgcccgccttgaaataccgggttttggatgccgtctgaaggttcagacggcatcggtgccggggaatcagaagcggtagcgcatgcccaatgagacttcgtgggttttgaagcgggtgttttccaagcgtccccagttgtggtaacggtatccggtgtccaaggtcagcttgggcgtgatgtcgaaaccgacaccggcgatgacaccaagacccacgctgctgatgctgtggctttcgtgatagggaggtttgctgggatcagtttgtataatagggcctccctgtggagagccgttctttggtttagaggtaatagtcgtggtttttgtttccaccgaatgaacttgatgtttaacgtgtccgtaggcgacgcgcgcgccgatatagggtttgaatttatcgttgagtttgaaatcgtaaatggcggacaagccgagagaagaaacggcgtggaagctgccgtttccctgatgttttgtttgggtttctttgtagttgttgtttatctcttcagtaacttttttagtagaagaattactttctttccattttctgtaactggcataatctgccgctattctccagccgccgaaatcatagccgaccgacacccgggggtggatggaatgcgcacggatgtttctgaaataatcgcttaccgtgcttgtgttgtttgcaccggttgcttgcggataatcgtgggtaatgcgttcggcggcataagctaaatccgcctgcacataatacgggctgcggctgccgtcttcacttgccgcctgcgctgcggaagagaagagaagagaagagaagagaagagaagagaagagaagagaagagaaggttttttgggggctggattcattttcgactccgtattcggttttaactgattaaaaagaaagattttcactgatgttgcaggggtggattgtatcgggtttggggcgatgtttcaacacaatatagcggatgaacaaaaaagagaacgatgctctaaggtgcccaagcaccaagtgaatcggttccgtactatagtggattaacaaaaaccagtacagcgttgcctcgccttagctcaaagagaacgattctctaaggtgctgaagcaccgagtgaatcggttccgtactatttgtactgtctgcggcttcgtcgccttgtcctgatttttgttaatccgctataaagaccgtcgggcatctgcagccgtcattcccgcgcaggcgggaatctagaccttagaacaacagcaatattcaaagattatctgaaagtctgagattctagattcccacgaaagtgggaatccaggatgtaaaatctcaagaaaccgttttatccgataagttcctgcactgacagacctagattcccgcctgcgcgggaatgacgggattttaggtttctgattttggttttctgtccttgtgggaatgacgggatgtaggttcgtaggaatgacgtggtgcaggtttccgtgcggatggattcgtcattcccgcgcaggcgggaatctagaccttagaacaacagcaatattcaaagattggcggattcgcatttgaagtgcaactttccctaacagaaaaaggccagtatgcggtagcatacggcctttcctgcaagaaagattgccatgagctacacgcaactgacccaaggcgaacgataccacatccaatacctgtcccgccactgcaccgtcaccgaaatcgccaaacagctgaaccgccacaaaagcaccatcagccgcgaaatcagacggcaccgcacccaagggcagcaatacagcgccgaaaaagcccagcggcaaagccagactatcaaacagcgtaagcgacaaccctataagctcgattcgcagctgattcagcacatcgacccccttatccgccgcaaactcagtcccgaacaagtatgcgcctacctgcgcaaacaccaccagatcacgctccaccacagcaccatttaccgctaccttcgccaagacaaaagcaacggcagcacgttgtggcaacatctcagaatatgcagcaaaccctaccgcaaacgctacggcagcacatggaccagaggcaaagtacccaaccgtgtcggcatagaaaaccgacccgctatcgtcgaccagaaatcccgtatcggcgattgggaagccgacaccattgtcggcaaaggacagaaaagcgcattattgaccttggtcgaacgcgttacccgctacaccatcatctgcaaattggatagcctcaaagccgaagacactgcccgggcagctgttagggcattaaaggcacataaagacagggtgcacaccattaccatggataacggcaaagagttctaccaacacaccaaaataaccaaagcattgaaagcggagacttatttttgtcgtccttaccattcttgggagaaagggctgaatgagaacaccaacggactcatccggcaatacttccccaaacaaaccgatttccgtaacatcagtgatcgggagatacgcagggttcaagatgagttgaaccaccgaccaagaaaaacacttggctacgaaacgccaagtgttttattcttgaatctgttccaaccactaatacactagtgttgcacttgaaatccgaatccaagattatctgaaagtctgagattctagattcccactttcgtgggaatgacgggattttaggtttctgattttggttttctgtccttgtgggaatgacgggatgtaggttcgtaggaatgacgtggtgcaggtttccgtgcggatggattcgtcattcccgcgcaggcgggaatttggaatttcaatgcctcaagaatttatcggaaaaaaccaaaacccttccgccgtcattcccacgaaagtgggaatctagaaatgaaaagcagcaggcatttatcggaaatgaccgaaactgaacggactggattcccgcttttgcgggaatgacggcgacagggttgctgttatagtggatgaacaaaaaccagtacggcgttgcctcgccttagctcaaagagaacgattctctaaggtgctgaagcaccaagtgaatcggttctgtactatttgtactgtctgcggcttcgtcgccttgtcctgatttttgttcatccgctatacttttgtatgaccatctgactttatcactcactatgttttaccaaatccttgccctgattatctggagcagctcgtttattgccgccaaatatgtctatggcggcatcgatcccgcattgatggtcggcgtgcgcctgctaattgccgcgctgcctgcactgcccgcctgccgccgtcatgtcggcaagattccgcgtgaggaatggaagccgttgctgattgtgtcgttcgtcaactatgtgctgaccctgctgcttcagtttgtcgggttgaaatacacttccgccgccagcgcatcggtcattgtcggactcgagccgctgctgatggtgtttgtcggacactttttcttcaacgacaaagcgcgtgcctaccactggatatgcggcgcggcggcatttgccggtgtcgcgctgctgatggcgggcggtgcggaagagggcggcgaagtcggctggttcggctgcctgctggtgttgttggcgggcgcgggcttttgtgccgctatgcgtccgacgcaaaggctgattgcacgcatcggcgcaccggcattcacatctgtttccattgccgccgcatcgttgatgtgcctgccgttttcgcttgctttggcgcaaagttataccgtggactggagcgtcgggatggtattgtcgctgctgtatttgggtttggggtgcggctggtacgcctattggctgtggaacaaggggatgagccgtgttcctgccaatgtttcgggactgttgatttcgctcgaacccgtcgtcggcgtgctgctggcggttttgattttgggcgaacacctgtcgcccgtgtccgccttgggcgtgtttgtcgtcatcgccgccaccttggttgccggccggctgtcgcatcaaaaataaagttgggaagcggtatttgatgattgccgaataggctgaaatctttccatctccattcctgcgaaagcgggtatccggaacgaaaagacggatatttatccgaaataacgaccatctttgcgtcgtcattcccgcgcaggcgggcatccggttttttgagtttcggttatttccgacaaattgctgcagcgttggatgtccggatttccgcctgcgcgggaatgacgggattttatagtggattaacaaaaatcaggacaaggcggcgagccgcagacagtacagatagtacggaaccgattcacttggtgcttcagcaccttagagaatcgttctctttgagctaaggcaaggcaacgctgtactggtttttgttaatccactatatcgttccggttcgtccggttttgccggggcttttgttgccgcctgtttgtgccggtgtgttaaaattttccgtttccgcgtattgtgttttccgccgccgggcggtttgtttgcgaatcggacgagaatttatgccttctgcccattatcctgaaatgagcgaaaaactgatggcggttttgatggcgatgctggttacgctgatgccgttttccatcgatgcctacctgcccgcgattcccgaaatggcgcaatcgctgaacgcggatgttcaccgcatcgaacagagtttgagtttgtttatgttcggcacggcgttcggacaggtggtcggcggttcggtgtccgacatcaaagggcgcaaacccgtcgccctgaccggtttgattgtatattgccttgccgttgccgccatcgtatttgtttcgagtgccgaacagctcctcaacctgcgcgtcgtgcaggcattcggtgcgggcatgactgtggtcatcgtcggcgcaatggtgcgcgattattattccggacgcaaagccgcccagatgtttgcccttatcggcatcattttgatggttgtgccgctggtcgcacccatggtcggcgcattgttgcagggcttgggtggctggcaggcgatttttgtttttctggcggcgtattcgctggtgctgctcggtttggtacagtatttcctgcccaagcccgccgtcggcggcaaaatcggacgggacgtgttcgggctggtggcggggcggttcaagcgcgtattgaaaacccgtgctgcgatgggttatctgttttttcaggcattcagcttcggttcgatgttcgcctttctgaccgaatcttccttcgtgtaccagcagctctaccgtgttacgcctcatcaatacgcttgggcgtttgcactcaacatcatcacgatgatgtttttcaaccgcgttaccgcgtggcggctcaaaaccggcgtgcatccgcaaagcatcctgctgtgggggattgtcgtccagtttgccgccaacctgtcccaactcgccgccgtgctgtttttcgggttgcccccgttttggctgctggtcgcgtgcgtgatgttttccgtcggtacgcagggcttggtcggtgcaaacacgcaggcgtgttttatgtcctatttcaaagaagagggcggcagcgcaaacgccgtattgggtgtattccaatctttaatcggcgcgggggtgggtatggcggcgaccttcttgcacgacggttcggcaaccgtgatggcggcaacgatgaccgcgtccacctcttgcggcattgcgcttctgtggctctgctcgcatcgtgcgtggaaagaaaacgggcaaagcgaatacctttaacggaaaatgccgtctgaaaccgtttcagacggcatttgatgttagaatgcacgataaattactgttcaggcgaaattatgtcccaaactatcgacgaactcctccttccccaccgcaacgccatcgacaccatcgatgccgaaatcctgcgcctgctcaacgaacgtgcgcaacacgcccacgccatcggcgagctgaaaggcacgggcgcagtgtaccgccccgaacgcgaagtcgccgtgttgcgccgcattcaggatttgaacaaaggcccgctgcccgacgaatcggtagcacgcctgtttcgggaagtgatgagcgagtgcctcgccgtcgaacgcccgctgaccatcgcctatctggggccgcagggcacgtttacccagcaggcggcaatcaaacatttcggacacgccgcgcacaccatggcgtgtccgaccatagacgactgcttcaagcaggttgaaacgcgtcaggcggattatctggtcgcccccgtggaaaattcgaccgaaggctcggtcggtcgcacgttagacctgcttgccgttaccgcgttgcaggcgtgcggcgaaatcgttttgcgcatccaccacaaccttttgcgtaaaaacaacggcagcaccgaaggcattgccaaagtcttttcccacgcgcaggcgttggcgcagtgcaacgactggttgggcagacacctgcccaacgccgaacggattgccgtgtccagcaatgccgaagccgcaaggctggttgccgaatcggacgacggtacggttgccgccatcgccggacgcacggcggcggaaatctacggactcgatatggttgccgagtgcatcgaagacgaaccgaacaacaccacgcgcttcttggtgatgggacatcacgaaaccggtgcaagcggcagcgacaagacttcgctggccgtttccgcgcccaaccgggcaggcgcggttgcctcgctgctgcaaccgctgaccgaatcgggtatttccatgaccaagtttgagagccgtccgagcaaatccgttttgtgggaatacctgttcttcatcgacatcgaaggacaccgccgggacgcgcagattcagacggcattggaacgcttgggcgaacgcgcttcgttcgtcaaagtcatcggttcgtacccgaccgccgttttgtagcggcggcagcgttcagacggcatttccccaacgattatgtccgaataccgagtcaaccatgaacccgtttttatgctggcatcttcgccctggcgcgaaagcagcctgtgggttgaagcattcagccgccgttacgggcgtgtggctttgctggcgcgcagcgcgcgcaaaaggcagagcgagctgcgcggcgtattggtgccgttcgtgcccgtcagcgtgtcgtggtacggcagtcaggaactcaaaaccctacaccgcgccgaatgggtcggcggttggcggcagcctcagggcagggcgttgttcggcggattgtatgtgaacgagttggtgttgaaactgaccgcccgcgaagacccggtgcccgagttatacgacgcgttggcggaagtgatggaggcggtgtgctgcaaagccgcttatatcgacgacttgcgccgtttcgagtggcggctgctgaacctgttgggcgttgcccccgatttgaaccgcgacggggacggcgggacgattgcggcaggcggcacataccttgtccgcccggaaacagccgtcttccccgtcggaaaaggatttgccgtaccgccgcacgccgccggcgttgtcgcccccgggcagagcctgatcgatttgcgcgaaggcagtttccgcactgccgaaagcctgcaacaggcattgaaaatcacacggctttttatccgccacctgttgcccgaggggctgaaatcgcggcaggtgttggaacagatacggcagtttgaccgcaaagaaaccgcccgggaaaccgtcccgacttcggacggcacggcttcaaatgccgtctgaaggcagaaataaaaggaaagattatgcttttaggtgtcaacatcgaccacatcgccaccgtccgcaatgcgcgcggtacgacttatcccagccccgtggaggcggcactggttgccgaaacgcacggtgcggatttgattaccatgcacctgcgcgaagaccgccgccacatcaaagacgcggacgtgtttgccgtcaaaaacgccatccgcacgcgcctgaaccttgaaatggcgttgacggaagaaatgttggaaaacgctttgaaagtgatgccggaagacgtgtgcatcgtgcctgaaaaacgtcaggaaatcacgaccgaaggcggtttggacgtattggcgcaacaggaaaaaatcgccgggttcaccaaaatcctgaccgacgcaggcatacgcgtgtctttgtttatcgatgccgacgacaggcaaatccaagccgcccgtgatgtcggcgcgcccgttgtcgagctgcacacaggcgcgtatgccgacgcgcgcagccacgccgaacaaatcaggcagttcgagcgcatccaaaacggcgcgcatttcgccggcgatttgggcttggtcgtcaacgccggacacggactgaccatacacaacgttacccccatcgcccaaatcctcgccatccgcgaactgaacatcgggcattcgctgattgcccaagccctcttcctcggactgcccgaagccgtgcgccaaatgaaggaggcgatgttcagggcaaggctgctgccgtaagggcaggcaaaccctttcagacagcatttcacgacagggatatgttatagtggattaaatttaaatcaggacaaggcggcgaagccgcagacagtacaaatagtacggcaaggcaagccaacgccgtactggtttaaatttaattcactatatgaatcaaaagtatattttatctgcaaacaataatagtttgatagaagaaattcacaatacagtacagagtattgggtattgtattgttcgaggtcttaatctaaaccatcttgatggcagccggagaaacaagaaattatttgactttctatctcaattaggaatgctgacaaaccacaaaggcgatggttttaaatctatattttgggatattaaatattgaggcgatgattatgtaatatagtggattaacaaaaatcaggacaaggcgacgaagctgcagacagtacagatagtacggaaccgattcacttggtgcttcagcaccttagagaatcgttctctttgagctaaggcgaggcaacgccgtactggtttttgttaatccactataaataatgatataactttctcggaagatgttggagaatgtccacttcatagtgattcatcttttagtgaaaacccggaaagttatttggttatgtatgtagtaaaatcagccaatgatggaggtaattccctatttttaagttcatcagatattgtcaatcagttatctaaaacagaaaccggtaaaaaacacttaaaaacattaacgggcaatttatatccatttaaaacaccagcatcatttgataaaaaacaaggtgtgagatggggtaatatcttatcggtcaatactcaaatgattagatttagaagtgattgtatctataaaggtattgaagaaaatagaaataaagtatcaaaggaaatggtacttgcacttgattatcttataaatgttataaaaaatgcgagtgatattcaagaattttctgcacaagatgatggtttgattattattgacaatgtcaatggcttgcatgccagaactgattatacggataaaaacaggcattatattagagcaagaattactgtataaaggacggttatgcaagaaataatgcaatctatcgtttttgttgctgccgcaatactgcacggaattacaggcatgggatttccgatgctcggtacaaccgcattggcttttatcatgccattgtctaaggttgttgccttggtggcattaccaagcctgttaatgagcttgttggttctatgcagcaataacaaaaagggtttttggcaagagattgtttattatttaaaaacctataaattgcttgctatcggcagcgtcgttggcagcattttgggggtgaagttgcttttgatacttccagtgtcttggctgcttttactgatggcaatcattacattgtattattctgtcaatggtattttaaatgtatgtgcaaaagcaaaaaatattcaagtagttgccaataataagaatatggttctttttgggtttttggcaggcatcatcggcggttcaaccaatgccatgtctcccatattgttaatatttttgcttagcgaaacagaaaataaaaatcgtatcgtaaaatcaagcaatctatgctatcttttggcgaaaattgttcaaatatatatgctaagagaccagtattggttattaaataagagtgaatacggtttaatatttttactgtccgtattgtctgttattggattgtatgttggaattcggttaaggactaagattagcccaaatttttttaaaatgttaatttttattgttttattggtattggctctgaaaatcgggcattcgggtttaatcaaactttaattcattattaaatgccttaactccttattaaataattggcacgatgttttagaatttcaaatgcaaaaggttacagtgaaaattgttaccgacaaaaccccaaaagtggatattcacgccattttaacgccccaagaaattgacggcattcatcatcacattcatcactacccgcaaccaagggcgaaggagcgcaaatatgatttacggcatcggcacagacattgtttccctcaagcgcatcatccgcttaaacaaaaaattcggacaggcgtttgccgggcgcatcctcactccggaagagctgcttgaatttccgcaagcgggcaaacccgtcaactacctcgccaaacgctttgccgccaaagaagcctttgccaaagccgtcggcacgggcatacgcggcgcggtttccttccgcaacatcggcatcgggcatgacgcattgggcaagcccgaatttttctacggccccgccctgtccaaatggctggaggaacaaggcatcagccgcgtcagcctcagcatgagcgacgaagaagacaccgtattggcgtttgtcgttgccgaaaaataatgccgtctgaaatgcggcaaacccgttgacggcattgcccgtccctcatttgcactccgaccgaccaaccgcgtacccgccatgattcaagacacccgaccccttatccgcgtcgttgccggcatcctgctcgattcagacggcaactacctgctcagctcgcgccccgaaggcaaaccctatgccggatattgggaatttgccggcggcaaggtcgaagcgggcgaaaccgacttccaagccctgcaacgcgagtttgaagaagaactcggcatccgcatcctcgccgccacgccttggttgaccaaaatccattcctacgaacacgcccgcgtctgcctgaaattcctatgggtcaaccccgaccaatggacgggcaaaccgcaatcccgcgaagggcaggaatggtcttggcagaaggcgggtgattttaccgttgcccccatgctgcccgccaacggcgcgcttttgcgttcgctgtccgtcccgcgccgtttgtacggcagcctgaaaacgggtttgcacggagaaaacagtatgggcgcgtaccgcgtcctgcctttgggttcggcagagggaagcggtgcgaacgttttgatggaggcggcgcaatggcaggacagacccgaacacgccgacagcgtgtggatggtggtgcagacccgcgaacaatggcggcgggcgcaggaaaagggcgcggatgcggtcgtttggcgcgtgtgcgatgatgttcaggcacaagaggcggcagaagccctgcggcagggcgtatccgtgccgctcgtacttgcagcaaacggacagacggttgcacgttatggaaaactatggctcggattgggggcgcacgtggtggtaagggatgaaacaatagggaagaatcatgaataaaaaccgtaaattactgcttgccgcactgctgctgattgcctttgccgccgtcaagctcgttttgttgcaatggtggcaggcgcagcagccgcaagctgtggcggcgcaatgcgatttgaccgagggttgcacgctgccggacggaagccgcgtccgcgccgccgccgtttcaaccaaaaaaccgtttgatatttatatcgaacacgcgcccgccggcacggaacaggtcagcatcagcttcagtatgaaaaatatggatatgggtttcaaccgctatatgttcgagcggcaaccgtcggggacttggcaggcagtacgcatccgcctgcccatctgtgtcgaaggcaggcgcgattttacggcggacattacaatcggcagtcggacatttcagacggcatttaccgccgaataaacctttcaatccgccattgccggaacatccgtccggaaaggacacgttatgaatactttatatacacttttcgccacctgcccgcgcggcttggagaccgttttatctcaagaactcgaaagcctcggctgtaccgatgtacaagtgtttgacggcggcgtttcctgccggggcggattggaacaggtttacgccgccaacctgcattcgcgtactgccagccgtatcctgctgcgcctgaccaaagggacataccgcaatgagcgcgacatctacaaactcgccaaaaatatcaactggtttaattggtttactttacagcagacgttcaaagtcaaagtcgaggcaaagcgtgccaacgttaagagcatccaatttgtcggactgaccgtcaaagatgccgtctgcgacgctttccgcgacatttacgacgcacgtccgagcgtggacaaagccgcgcccgatgtccgcatccacgcctttttgaacgaacgcaatgtcgaaatctttattgacacttcgggcgaagccctgttcaaacgcggctaccgcctggataccggcgaagccccgctgcgcgaaaaccttgccgccggactgctgctctcggcaggctacgacggcacgcagccgtttcaagacccgttttgcggcagcggcacgattgctatcgaagccgcttggattgccgcccgccgcgcgccgggtatgatgcgccgtttcggttttgaaaaactgcaaaatttcgataaaacgctgtggtcggatttgcggcgccgcgccgaagcgcaaacccgccccgtccgcgccccgattgcaggcagcgacaacgaccgccgcatcgttcagacggcattggacaacgcacgccgcgccggggtggacgacatcgtttccttcagcgttgccgacgcgcagtccgtccgaccgaacggcgaaaacggcattatggtgtccaatccgccctacggcgtgcgccttgaggaagtccgcgccttgcaggcactgtatccgcagttggggacgtggttgaaaaaacattacgcaggctggttggcggcaatgtttaccggcgatagggaaatgcccaaattcatgtgcctgtcgcccaagcggaaaatcccgctttataacggcaacatcgactgccgcctgttcctgattgatatggtggaaggatcgaaccgttgaggaaagtgtacaaaaatgccgtctgaaaaatgttcagacggcatttatttttcggaatcaaccccgcttcaatacggatgtattgatgtagcgttggacacccgaggcaatggattgggcgcactgccggcggaaggattcgctgcccagcagcttctcttcggcaggattggacaggaaggcggtttcgaccaggatagacggcatatcgggtgcgcgcaaaacggcgaaattggcttcgtccaccctgcctttgtgcagatggttgagcctgcccaattcttcaagcaccagtttgccgagtttgcggctgtcgcgcagcgtggcggtttgggtcatgtcgagcagggcggtatcgacattgcggttgccgctggtcggtacgccgccgaccgcgtcggcattgttttgcgtctgttccaagaatttggcggcagagctggttgcgcctttggtgtttaacatataaacccccgtgccgcgcgcggaggggctggtgaaggcatcggcgtggatggagacaaatacgtccgcccgccgtgctcgccctttggcgacacgcacgcccaatgggatgaacacgtcttcgttgcgcgtcataaatacattgtaacctaatgcttccaactgatttttggtttccctggcaatggataggacgacatgtttttcctgtagaccgcccgggctgatggcgccggggtcttcaccgccgtgtcccggatcgagcatgatgacgggtctgcgcccgtttctgccgcgcccgggttggggcgtggtgttttgggcgaggtcggcttcgggagagccgcgcagggttttattcaggctaccgttgagcagtgccatcatcggatcgtcggcatccatcccgtgcggatagaggtcgacgacgaggcggttcttaaagccgccgacgggcggaagcgcgaagacttgtgcgtgggtgggctgtttcaaatcgatgacgaggcggacggtggtcggcgtgttctgacccgcgcgtatgctgcggataaaggggtcgtctgccatgactttctgagacagtccgtgcaatacggtattgatgttcgcgttttgtatgtcgacgaccagcctgcccgggttgtcgagcgtgaagtgctggtatttgagcgcggcggtgctttccagcgtcaggcgggtgtaggtgtgcgacggccatatccgtgcggcggtgaattgcggggcgcgtaccgttttggcaacggcggatgcgatggggcttagggcgaacagtgtgccggcggtgcggcggatgatttgtcttcgtgtcagtttgatcatagcggcaggctttcgcgtcctcgttcggtatgggcggtcagcaggcattttctgccgtcgccgtcgtgtgtcaatgttgcggtgatgtcggcgggcggcgtaaattccccgccctgttgcggccattcgatcaggcagacgctgtttgcggcaaacagttcgtcaagccccgcgtcttcccattcttcggggaacgagaagcggtagaggtcgaaatggtgcagggtgaagcgttccagcggataagattcgacgatggcgtaggtcggacttttgactgcgccctgatgacccaatccgcgcaggatgccgcgtgtcagcgtggttttgcccgcacccaaatccccttcgagataaatgaccagcggtgcgtttaaacgggaagaccacgccgcgcccaaatcgagtgtggcggcttcgtcggcaaggaatcgggagatagagggtaaatcagacatggaaacggtttgttgtaaggtctagggtattatgggcagttttgcaggttttgcaaactttgcacccgaggggcggatgcttcttgtccgagcattataacagccaaatccgcgttctgctttcagacggcaacggctgtcaagaaaaagcggcgcgtgtacaatacgcggattgtatgtttaggacggattggaaaaagaatggaaaatatcggcaggcagcgacccatcggcgtttttgactcgggaatcggcggtttgaccaatgtgcgagcgctgatggaacggctgccgatggagaacatcatttatttcggcgacacggcgcgcgtgccttacgggacgaaatctaaggcgaccatcgaaaatttctcgatgcagattgtcgattttttattggaacacgatgtcaaggcgatggttatcgcgtgcaatacgattgcggcggtggcggggcagaaaatccgtcaaaaaaccggcaatatgcccgttttggacgtgatttccgccggcgcgaaagccgcgctggcaacgacgcgcaacaataaaatcggcattatcgccaccaatacgacagtcaacagcaatgcttatgcgcgcgccatccataggaacaaccccgacacgctcgtccgcacgcaggccgcgccgctgctcgtccctttggtggaagagggctggctggaacacgaagttacccgcctgaccgtatgcgaatacctcaaaccattgcttgcagacggcatcgatacgctggtgttgggctgcacgcactttcccttgctcaagcccttaatcggcagggaggcgggcaatgtcgcgttggttgattctgcaattacaacggccgaagaaaccgcacgcgtccttgctcaggaaggattgctcaataccgacaacaacaatcccgactaccgtttttacgtcagcgatattcctttgaaattcagaaccatcggcgagcgttttctgggcaggacgatggagcagattgaaatggtgtctttgggttaaaacgatgacggaaagctgcccgagattacagaaacctaaaatcccgtcattcccacgaaagtgggaatctagacctgtcggtgcggaaacttatcggataaaacggtttctttagattttacgttctagattcccactttcgtgggaatgacgggattagagtttcaaaatttattctaaatagctgaagctcaacgcactggattcccgcctgcgcgggaatgacgaatttcaggtttctgtttttggttttctgtttttgtgaaaataacgggatttcagcttgtgggtatttaccggaaaaaacagaaaccgctccgccgtcattcccgcgcaggcgggaatctagacattcaatgctaaggcaatttatcgggaatgactgaaactcaaaaaactagattcccactttcgtgggaatgacggaatgtaggttcgtgggaatgacgggatgcaggtttccgtatggatggattcgtcattcccgagcagacgggatctagacattcaatgctaaggcaatttatcgggaatgactgaaactcaaaaaactagattcccactttcgtgggaatgacgggatataggtttccatgcggacgcgttcggattcacgactgcgcggaaatgacgggattttggtgtattccctaaaaaaataaaaaaacatttgcaactttgttaaaaataaaggctgtgttttaacgatgtgttgatatttaattttagaaaggtagctatttaatagttaccttttcttatttaaaaatagctttctcaaattccatgaacgcctcaatacgatatgcagatgctctatcgaaattaagtttcaacattttgtttattaaacattttattttagccatttttcaatatacccccaaatatacccccaatttgcacaagtcaaaattttaggcaggggttttgttgctcccatgatacgcgggcggatgccggcttttcgcgggggaaatacaaggggtctcggttcgggtgtcaaaatccctgtttcgtgttagtcatgtgggggggaagagggggttagaatgaagtaaagctgttgccctctccccgcaatagttccattaggcgcggatgaatgaatagtttgtccctgccgatgacgatttcttgcagcacacctatgtctgaaagctctttcaggtacttagaggccgtctgccgtttggctatccctgccgcttctaggttggcaatgcgtgtatatggctgctcaaacagaagatttaccagttcgtgcgtgtagattccttgtgcgtgtgtccgtatgtgttgccgtgtctgctcgaacaggcggcgtatcgcatctattttcgataccgtccaatcggcggtgtcagctacgccgtctaagatgtagattatccagctttcccagtcctgccgttcggttacgcctaaaagcaggcggtaatagtccgccctgttttcgatgatgtagcggctcaaatacaaaataggcaaatccaaaagccctttttcaatcaatagcaggctgttcaatatgcgccccgtccgcccgttgccgtccgtaaacggatggatggcttcaaattggtaatgtgccgccgccatgatgataagcgggtctaaatcgccgctttcgtgaataaaccgctcccaatttgccagcttgccgcgtatggtttcttctccttcgggcggggtatagacaacatttccgctgttgcctccttttagggctgtgccgcctgttttgcggatggccatttcgtaggggtgcttgatggcgttgcagaccatgatggcggtttgtgtgcataaagggcggctcgtcagtgattcatagcctgcaaacagggcggtgcggtattgcagggcttctttcgtggcagggtcttgccgttccgtatccatttgcagggattgaaacagcttgtccgtggtggttacgatgttttcaatttccgaacttgcacgggcttccataacaggaagggtgttaatcagcatggcttgattcggtatcaattctgccgcctgctttaaacgggcaagggatgcacgggcggctatacaacgtttcaggatggttttgctttcaatatcctgttttggcggcaggggtggtaaatcgttatagggaatattgggtttccagttgctcatatttaaaatttcggaaaatttaaagatgtttccagtatatgtttacgccgtgtatatatcaaggatatatgtttaaaaatttggcttttgtaagtatatgggaggtaaaaccgcccgcaaaagtcaatttgcatggggttaattcaaaatccgcccgcccttcatctgcccgcttccctaaaaaaaccgtatatatataactgtccgcattctatcgctccggcgacgatacccatatttccaagtttgtgtatcaaaattgtatatcgggcatagactatttcggcgaggacgaagatatagatttccacgattgaatacatggaagccaagtacgtctatcaacactatattaaaacacagcctttttttttgaggtttcgggtaacttttaaaccgtcattcctacgaaaacagaaaatcaaaaacagaaatctcaaatcccgtcattcccgcgcaggcgggaatctagacattcaatgctaaggcaatttctcggaaatgactgaaactcaaaaaactggattcccactttcgtgggaatgacggaatgtaggttcgtgggaatgacgtggtgcaggtttccgtatggatggattcgtcattcccgcgcaggcgggaatctagacattcaatgctaaggcaatttatcgggaatgactgaaactcaaaaaactggattcccactttcgtgggaatgacgcgattagagtttcaaaatttattctaaatagctgaaactcaacgcactggattcccgcctgcgcgggaatgacgaagtggaagttacccgaaacttaaaacaagcgaaaccgaacgaactggattcccactttcgtgggaatgacggaatgcaggttcgtgggaatgacggaatgcaggttcgtgggaatgacgtagtgcaggtttccgtatggatggattcgtcattcccgcgcaggcgggaatctagacatgcaatgctaaggcaatttatcgggaatgactgaaactcaaaaaactggattcccgcctgcgcgggaatgacgaagtggaagttacccgaaacttaaaacaagcgaaaccgaacgaactggattcccactttcgtgagaatgacgggatgcaggttcgtgggaatgacgtggtgcaggtttccgtatggatggattcgtcattcccgcgcaggcgggaatctaggtctgtcggtgcggaaacttatcgggtaaaacggtttcttgagattttgcgtcttggattcccactttcgtgggaatgacgcgattagagtttcaaaatttattctaaatagctgaaactcaacgcactggattccgcctgcgcgggaatgacgaagtggaagttacccgaaacttaaaacaagcgaaaccgaacgaaccggattcccactttcgtgggaatgacgaatttcaggttactgtttttggttttctgtttttgtgaaaataatgggatttcagcttgtgggtatttaccggaaaaaacagaaaccgctccgccgtcattcccgcgcaggcgggaatctaggtctgtcggtgcggaaacttatcggataaaacggtttcttgagatttttcgtcctggattcccactttcgtgggaatgacgcgaacagaaaccgctccgccgtcattcccgcgcaggcgggaatctagacattcaatgctaaggcaatttatcgggaatgactgaaactcaaaaaactggattcccactttcgtgggaatgacgtggtgcaggtttccgtatggatggattcgtcattcccgcgcaggcgggaatctagaccttcaatactaaggcaatttatcggaaatgactgaaactcgaaaaactggattcccacttttgtgggaatgacgcgattagagtttcaaaatttattctaaatagctgaaactcaacacactggattcccgcctgcgcgggaatgacgaagtggaagttacccgaaacttaaaacaagcgaaaccgaacgaactggattcccactttcgtgggaatgacggaatgtaggttcgtgggaatgacggcggagcggtttctgctttttccaataaatgaccccaacttaaaatcccgtcattcccgcgcaggcgggaatctaggtctgtcggtgcggaaacttatcgggtaaaacggtttcttgagattttgcgtcctggattcccactttcgtgggaatgacggaatgtaggttcgtgggaatgacgggatataggtttccgtgcggacgcgttcggattcatgactgcgcgggaatgacgggattttggtgtattccctaaaaaaataaaaaagtatttgcaaatttgttaaaaataaataaaataataatccttatcattctttaattgaattggatttattatgaacaatccattggtgaatcaggctgctatggtgctgcctgtgtttttgttgagtgcttgtttgggcggaggcggcagtttcgatcttgattctgtcgataccgaagccccgcgtcccgcgccaaaatatcaagatgttttttccgaaaaaccgcaagcccaaaaagaccaaggcggatacggttttgcaatgaggttgaaacggaggaattggtatccgcaggcaaaagaagacgaggttaaactggacgagagtgattgggaggcgacaggattgccggacgaacctaaggaactccctaaacggcaaaaatcggttatcgaaaaagtagaaacagacagcgacaacaatatttattcttccccctatctcaaaccatcaaaccatcaaaacggcaacactggcaacggtataaaccaacctaaaaatcaggcaaaagattacgaaaattttaaatatgtttattccggctggttttacaaacacgccaaacgagagtttaacttaaaggtggaacctaaaagtgcaaaaaacggcgacgacggttatatcttctatcacggtaaagaaccttcccgacaacttcccgcttctggaaaaattacctataaaggtgtgtggcattttgcgaccgatacaaaaaagggtcaaaaatttcgtgaaattatccaaccttcaaaaagtcaaggcgacaggtatagcggattttcgggcgatgacggcgaagaatattccaacaaaaacaaatccacgctgacagatggtcaagagggttatggttttacctcaaatttagaagtggatttccataataaaaaattgacgggcaaactgatacgcaacaatgcgaataccgataacaaccaagccaccaccacgcaatactacagccttgaggctcaagtaacaggcaaccgcttcaacggcaaggcaacggcaaccgacaaaccccaacaaaacagcgaaaccaaggaacatccctttgtttccgattcgtcttctttgagcggcggctttttcggcccgcagggtgaggaattgggtttccgctttttgagcgacgatcaaaaagttgccgttgtcggcagcgcgaaaaccaaagacaaacccgcaaatggcaatactgcggcggcttcaggcggcacagatgcggcagcatcaaacggtgcggcaggcacgtcgtctgaaaacggtaagctgaccacggttttggatgcggtcgagctgaaattgggcgataaggaagtccaaaagctcgacaacttcagcaacgccgcccaactggttgtcgacggcattatgattccgctcttgcccgaggcttccgaaagtgggaacaatcaagccaatcaaggtacaaatggcggaacagcctttacccgcaaatttgaccacacgccggaaagtgataaaaaagacgcccaagcaggtacgcagacgaatggggcgcaaaccgcttcaaatacggcaggtgataccaatggcaaaacaaaaacctatgaagtcgaagtctgctgttccaacctcaattatctgaaatacggaatgttgacgcgcaaaaacagcaagtccgcgatgcaggcaggagaaagcagtagtcaagctgatgctaaaacggaacaagttgaacaaagtatgttcctccaaggcgagcgcaccgatgaaaaagagattccaagcgagcaaaacatcgtttatcgggggtcttggtacggatatattgccaacgacaaaagcacaagctggagcggcaatgcttccaatgcaacgagtggcaacagggcggaatttactgtgaattttgccgataaaaaaattactggtacgttaaccgctgacaacaggcaggaggcaacctttaccattgatggtaatattaaggacaacggctttgaaggtacggcgaaaactgctgagtcaggttttgatctcgatcaaagcaataccacccgcacgcctaaggcatatatcacagatgccaaggtgcagggcggtttttacgggcccaaagccgaagagttgggcggatggtttgcctatccgggcgataaacaaacgaaaaatgcaacaaatgcatccggcaatagcagtgcaactgtcgtattcggtgcgaaacgccaacagcctgtgcgataagcacggctgccgaacaatcaagaataaggcctcagacggcaccgctccttccgatgccgtctgaaagcgaagattagggaaacactatgcaacagcaacatttgttccgattcaatattttatgcctgtctttaatgactgcgctgcccgcttatgcagaaaatgtgcaagccggacaagcacaggaaaaacagttggataccatacaggtaaaagccaaaaaacagaaaacccgccgcgataacgaagtaaccgggctgggcaagttggtcaagtcttccgatacgctaagtaaagaacaggttttgaatatccgagacctgacccgttatgatccgggtattgccgtggtcgaacagggtcggggcgcaagttccggctattcaatacgcggcatggataaaaaccgcgtttccttaacggtggacggcgtttcgcaaatacagtcctacaccgcgcaggcggcattgggcgggacgaggacggcgggcagcagcggcgcaatcaatgaaatcgagtatgaaaacgtcaaagctgtcgaaatcagcaaaggctcaaactcggtcgaacaaggcagcggcgcattggcgggctcggtcgcatttcaaaccaaaaccgccgacgatgttatcggggaaggcaggcagtggggcattcagagtaaaaccgcctattccggcaaaaaccgggggcttacccaatccatcgcgctggcggggcgcatcggcggtgcggaggctttgctgatccacaccgggcggcgcgcgggggaaatccgcgcccacgaagatgcaggacgcggcgttcagagctttaacaggctggtgccggttgaagacagcagcaattacgcctatttcatcgttaaagaagaatgcaaaaacgggagttatgaaacgtgtaaagcgaatccgaaaaaagatgttgtcggcaaagacgaacgtcaaacggtttccacccgagactacacgggtcccaaccgcttcctcgccgatccgctttcatacgaaagccggtcgtggctgttccgcccgggttttcgttttgagaataagcggcactacatcggcggcatactcgaacacacgcaacaaactttcgacacgcgcgatatgacggttccggcattcctgaccaaggcggtttttgatgcaaataaaaaacaggcgggttctttgcccggtaacggcaaatacgcgggcaaccacaaatacggcggactgtttaccaacggcgaaaacggtgcgctggtgggcgcggaatacggtacgggcgtgttttacgacgagacgcacaccaaaagccgctacggtttggaatatgtctataccaatgccgataaagacacttgggcggattatgcccgcctctcttacgaccggcagggcatcggtttggataatcattttcagcagacgcactgttctgccgacggttcggacaaatattgccgcccgagtgccgacaagccgttttcctattacaaatccgatcgcgtgatttacggggaaagccacaggctcttgcaggcggcattcaaaaaatccttcgataccgccaaaatccgccacaacctgagcgtgaatctcgggtttgaccgctttggctctaatctccgccatcaggattattattatcaacatgccaaccgcgcctattcgtcgaacacgccccctcaaaacaacggcaaaaaaatcagccccaacggcagtgaaaccagcccctattgggtcaccataggcaggggaaatgtcgttacggggcaaatctgccgcttgggcaacaatacttatacggactgcacgccgcgcagcatcaacggtaaaagctattacgcggcagttcgggacaatgtccgtttgggcaggtgggcggatgtcggcgcgggcttgcgctacgactaccgcagcacgcattcggacgacggcagcgtttccaccggcacgcaccgcaccttgtcctggaacgccggcatcgtcctcaaacctaccgactggctggatttgacttaccgcacctcaaccggcttccgcctgccctcgtttgcggaaatgtacggctggcgggcgggtgttcaaagcaaggcggtcaaaatcgatccggaaaaatcgttcaacaaagaagccggcatcgtgtttaaaggcgatttcggcaacttggaggcaagttggttcaacaatgcctaccgcgatttgattgtccggggttatgaagcgcaaattaaagacggcaaagaagaagccaaaggcgacccggcttacctcaatgcccaaagcgcgcggattaccggcatcaatattttgggcaaaatcgattggaacggcgtatgggataaattgcccgaaggttggtattctacatttgcctataatcgtgtccgtgtccgcgacatcaaaaaacgcgcagaccgcaccgatattcaatcacatctgtttgatgccatccaaccctcgcgctatgtcgtcggcttgggctatgaccaaccggaaggcaaatggggtgtgaacggtatgctgacttattccaaagccaaggaaatcacagagttgttgggcagccgggctttgctcaacggcaacagccgcaatacaaaagccaccgcgcgccgtacccgcccttggtatattgtggacgtgtccggttattacacggttaaaaaacactttaccctccgtgcgggcgtgtacaacctcctcaactaccgctatgttacttgggaaaatgtgcggcaaactgccggcggcgcagtcaaccaacacaaaaatgtcggcgtttacaaccgatatgccgcccccggtcgcaactacacatttagcttggaaatgaagttctaaacgtccaaacgccgcaaatgccgtctgaaaggcttcagacggcattttttacacaatccccgccattttccatcatccccgatacaccgtaatctcgaaacccgtcattcccgcgcaggcgggaatccagtccgttcggtttcggtttttttgaggtttcgggtaacttctaaaccgttattcccgcgaaaacagaaaatcaaaaacagaaacctcaaatcccgttattcccgagcagacgggatctagggcgtaaaatctaaagaaaccgttttatccgataagtttccgcaccgacagactagattcccgcctgcgcgggaatgacgttatatttttcgcatttgataaaaaagaccgtttgaaattttttcagcggacgcaaagtattgcgtaaaatgctgcttataagaaacgcaaggcgggcgtaggatgtgcagcgtggacatagggctggctgtagggtgggcttcagcccaccaatcccaccgtttccacctattcccccaactccgtcaatgttatccattccgcccattcccaccgaaaaccgaaaccgccgtattcccaaaaacctttgatgcggtgaaattggtgggctgaagcccaccctacagcccaccctacggctcgccgaaatttcgtcattcccgcgcaggcgggaatccaggtctgtcggtgcggaaacttatcggataaaacggtttcttgagattttacgtcctagattcccacttccgtgggaatgacgggatgcaggttttcgtgcggacgcgttcggattcacgactgcgcgggaatgacgggatttcagtttgcggattgatttgaagttgcaaaatcccaacggatcggattaccgctttcgcgtttcaaagttacggcgttatcggaaaaacagaaaatcaaagctgcaagaatttatttaaaacaaccgaatttcaacggatcggattctcgcctgtagggaatgacggcggaaggttttttgtcttttctgacagatgtccgcaatctgaaatcctgaccgtgggaacgacggtatagtggattaacaaaaaccagtacggcgttggctcgccttagctcaaagagaacgattctctaaggtgctgaagcaccaagtgaatcggttccgtactatttgtactgtctgcggctttgtcgccttgtcctgatttttgttaatccactatataaatatttctatttcaatccaatataaaatgccgtccgaacatcgttcggacggcatttttaatgcttcaaatcagttggtgccgactttgattttctgccacaggctgacagacagttttttcgcatccgtgctcatttgcggcatcacgaaaccgtctttcatatcctgctcgttcgggaagatggaacgggtgttcaccagctcggcaggcattttttcgcgcgccggtttgctggcgggggcaaaggttacggcgatgccgtttttcgccgcgatttcggggtcgagcgtgtagttgatgtatttgtgggcattggcgacgtttttcgcatcggcgggaatcagccaagactcaatccagaagcccatacctttcggtgtcagcacttcgatgccgacgttgtttttcacttcctcggaacgtgctttcgccaagttcaaatcgccgccgttgcctgccgccaggcagatgtcgccgcgtgccagctcgtcgatgatggacgggctgaaacgtttgacatccggacggatagacttcaacacttccgccgccgccttcaagtcttcaggattcgagcctttggggtctttgcccaagtagttcagcaaaatcgggaacatttcactcggggtgtcccacagggcgatgccgcaggatttcagcttgtgggtgtattcgggtttgaacagcaaatcccagccgttttcgggcagcttgccgcccaaaagctctttgcccttcgccgtaatcgcaatcgtgttcacgccggagaaataggggacggcatactggttgcccgggtcggcggtttccagcattttcaagagttcgggatcgatgtttttatagttgggaatcaggtctttgttgactttttgatacgcgcccgcctcgatttggcgcggcaggaaggcgatgcccggcacgaccaaatcgtaaccggatttgccggtcagcattttggcttccagcgtttcattgttttcgtacaagtcgtaagtcagcttcagattgttggcttttttaaagtcttcgaccgtactctcatcaacatagttcgaccagttgtagatgttcagagtatcggtggcagcggcttcggcattggcagcagacgcagcgtctgcttgaggttgcacggcgtttttttcgctgccgccgcaggctgccagagacagcgcggccaaaacggctaatacggattttttcatacgggcagattcctgatgaaagaggttggaaaaaaagaaatccccgcgccccatcgttaccccggcgcaaggtttgggcattgtaaagtaaatttgtgcaaactcaaagcgatattggactgattttcctaaaaaattatcctgtttccaaaaggggagaaaaacgtccgcccgattttgccgtttttttgcgctgtcagggtgtccgacgggcggatagagagaaaaggcttgcatataatgtaaaccccctttaaaattgcgcgtttacagaatttatttttcttccaggagattccaatatggcaaacagcgcacaagcacgcaaacgtgcccgccagtccgtcaaacaacgcgcccacaatgctagcctgcgtaccgcattccgcaccgcagtgaaaaaagtattgaaagcagtcgaagcaggcgataaagctgccgcacaagcggtttaccaagagtccgtcaaagtcatcgaccgcatcgccgacaagggcgtgttccacaaaaacaaagcggcacgccacaaaagccgtctgtctgcaaaagtaaaagccttggcttgatttttgcaaaaccgccaaggcggttgatacgcgataagcggaaaaccctgaagcccgacggtttcggggttttctgtattgcgggggcaaaatcccgaaatggcggaaagggtgcgattttttatccgaatccgctataaaatgccgtttgaaaaccaatatgccgacaatgggggcggagatgaatacacggaatatgcgctatattcttttgacaggactgttgccgatggcatccgcttttggagagaccgcgctgcaatgcgccgctttgacggacaatgttacgcgtttggcgtgttacgacaggatttttgcggcacagcttccgtcttcggcagggcaggaagggcaggagtcgaaagccgtactcaatctgacggaaaccgtccgcagcagcctggataagggcgaggcggtcattgttgttgaaaaaggcggggatgcgcttcctgccgacagtgcgggcgaaaccgccgacatctatacgcctttgagcctgatgtacgacttggacaaaaacgatttgcgcgggctgttgggcgtacgcgaacacaatccgatgtaccttatgccgctctggtacaacaattcgcccaactatgccccgggttcgccgacgcgcggtacgactgtacaggaaaaattcggacagcagaaacgtgcggaaaccaaattgcaggtttcgttcaaaagcaaaattgccgaagatttgtttaaaacccgcgcggatctgtggttcggctacacccaaagatccgattggcagatttacaaccaaggcaggaaatccgcgccgttccgcaatacggattacaaacctgaaattttcctgacccagcctgtgaaggcggatttgccgttcggcggcaggctgcgtatgctcggtgcgggttttgtccaccagtccaacggacagagccgtcccgaatcgcgttcgtggaacaggatttacgccatggcaggcatggaatggggcaaattgacggtgattccgcgcgtgtgggtgcgtgcgttcgatcagagcggcgataaaaacgacaatcccgatattgccgactatatggggtatggcgacgtgaagctgcagtaccgcctgaacgacaggcagaatgtgtattccgtattgcgctacaaccccaaaacgggctacggcgcgattgaagccgcctacacgtttccgattaagggcaaactcaaaggcgtggtacgcggattccacggttacggcgagagcctgatcgactacaaccacaagcagaacggtatcggtatcgggttgatgttcaacgacttggacggcatctgaaccgcgtgttcagacggtatatcaagttgccgtgccgtctgaagccgccggcggtttggcggggcgggataaaaatttcgtttgaatccgggcaaacgcgtataatgtgcggtttgtacggactttgtcggaatcaagcaagatgacggaacctgcggccgaaggcggcaaagctgccaaggcgttaaaaaaatatctgattacgggcattttggtctggctgccgattgcggtaacggtttgggtggtttcctatatcgtttccgcgtccgatcagctcgtcaacctgctgccgaagcaatggcggccgcaatatgttttggggtttaatatcccggggctgggcgttatcgttgccattgccgtattgtttgtaaccggattgtttgccgccaacgtattgggtcggcagatcctcgccgcgtgggacagcctgttggggcggattccggttgtgaaatccatctattcgagtgtgaaaaaagtatccgaatcgctgctgtccgacagcagccgttcgtttaaaacgccggtactcgtgccgtttccccagcccggtatttggacgattgctttcgtgtcagggcaggtgtcgaatgcggttaaggccgcattgccgaaggacggcgattatctttccgtgtatgttccgaccacgccgaatccgaccggcggttactatattatggtaaagaaaagcgatgtgcgcgaactcgatatgagcgtggacgaagcattgaaatatgtgatttcgctgggtatggtcatccctgacgacctgcccgtcaaaacattggcaggacctatgccgtctgaaaaggcggatttgcccgaacaacaataaagccgccgttcagacggcattttctgttttcagtttaaatcaataaaaggtgattttatgcgtaccaactattgcggcctgatcagtgagcaatacttagaccaaaccgttaccgtcaaaggctgggtacaccgtcgacgcgaccacggcggtgtgatttttatcgacctgcgcgaccgcgaaggcatcgtccaagtcgtgatcgatcccgacacgcccgaagcgtttgccgctgccgattcctcccgcaacgaatacgttttgagcattaccggccgcgtacgcaaccgtcccgaaggcacgaccaacgataaaatgatttccggcaaaatcgaaatccttgccaaagaaatcgaagtcttgaacgccgccgccacgccgccgttccaaatcgacgatgaaaacatcagcgaaaacgttcgcctgaccaaccgcgttatcgacttgcgccgtccggtgatgcaacgcaacctgcgcctgcgttaccaagttgctatgggcgttcgccgctacttggacgcgcaaggtttcatcgacattgaaaccccgatgctgacccgctccacgcctgaaggcgcgcgcgactacctcgtgccgagccgcgttcatccgggcgagtttttcgcgctaccgcaatcgccgcaattattcaaacaactgttgatggtggcgggtttcgaccgttactaccaaatcaccaagtgcttccgcgacgaagacctgcgtgccgaccgccagcccgaatttacccaaatcgacttggaaacctcgttcttaaacgaggatgaaatcatggacatcactgaaggcatggccaaacaagtcttcaaagatgctttaaatgtagatttgggcgacttcccacgcatgccttactctgaagccatgttctactacggctctgacaaaccggatatgcgcatcaacttgaaatttaccgagttgaccgacctgatgaaaacggaagaattcaaagtcttccgtggcgcagccgacatgaaaggcggccgcgtggtcgctctgcgcgtgccgaacggcgcagaattcagccgcaaagaaatcgacgaatacaccaaatttgtcggcatctacggcgcgaaaggtctggcatacatcaaagtaaacgatgtcagcaacctttccaacggcgaagacagcggcctgcaatctccaatcgtgaaatacctgtccgaaaacgccctgaaagaaattatcgcgcgtaccggcgcgcaaaacggcgacatcatcttcttcggcgcagacaaagccaaagtcgtgaacgaagccatcggcgcactgcgtatcaaagtcggcttggagcacggcaaagacaacggctatttcacagacgaatggaaacctttgtgggtcgttgatttcccaatgttcgaatacgacgaagaagccgaccgctacgttgccgtacaccatccgtttaccgcgccaaaagaaggtcatgaagacctgatggtttccgacccggcaaattgtttggcacgcgcctacgatatggtattgaacggctgggaaatcggcggcggctctatccgtattcaccgcgcagacgtacaagagaaagtgtttgccgcgctgaaaatcagccctgaagagcaacaagagaaattcggcttcctcttggacaacctgaaattcggcgcacctcctcacggcggtcttgcattcggcctcgaccgtctggtaacgctgatgaccggtgccgaatccatccgcgacgtgattgccttcccgaaaacacaacgcgcccaatgcctgctgaccaacgcgcccaacagcgtggacgacaagcagttgcgtgaattaagtttgcgtttgcgccagaaggcaaccgaaactaaagaagtataaggaaaacggagccgtttgacggctctgtttttttcagacggcatttacgcttcttgacttccctctaattcaaacctaattttgctgtgttttaatggcggtattgaaaaacacatcttgttcaatcaaccgataaaaaaaggactgaaaatgaaaaaactgttattggctgccgttgtttctctgagtgccgctgccgcatttgccggcgactctgccgagcgtcagatttacggcgatccccattttgaacaaaaccgcacaaaagctgtgaaaatgttggagcagcgcggttatcaggtttacgatgtcgatgccgacgaccattggggtaagcctgtgctggaagtggaagcctataaagacggccgcgaatacgacatcgtgttgtcttaccccgacctgaaaatcatcaaagagcagctcgatcgctgactcctttgatggaaagatgaaccaaaatgccgtctgaagcgttcagacggcattttgcctgttcctcatcaggtatgaggcaggcttttcttattaaaaaaatgacatttcacgctgatttgttataatcattccttttcaacacgacagacggagcaggtttattatgcctatccttaccatccgtgaagtgtgcaacattaatcattggggcataggttattatgatgttgacgattccggcgaaatcatcgtccgccccaatccctcgcaacacaatcaaactgtttcactgcaaaaactgactgaagccgtgcaacaaaaacatcaggcgcgcctgcctgttttgttttgttttccgcaaatcctcgaacaccgcctccgcgacattaaccgcgcctttcagacggcacgggaagagtgcggctataagggcggttattgtttggtttaccctatcaaggtcaaccaacaccgccgcgtcatcgaatcgcttatgtcaagcggacaaccgcatggtttggaagctggttctaaagccgaactgatggcggttttggcacacgccggcaaccggcaaacattaatcgtctgcaacggctataaagaccgtgaatatatccgtttcgccttgatgggcgaaaaactggggcatcaggtttatttggtgattgagaagctgtccgaaatacaaatggtattggaagaggcggaaaaactcggcatcaagccccgtttgggtgtgcgcgccagactggcttcccaaggttcgggaaaatggcagtcttcgggtggggaaaaatcaaaattcggcttgtcggcttcccaagttttgcaactggtcgatattttgaaacaaaaaaacaggctggattgcctgcagcttttgcatttccatttgggctcgcagcttgggaacatccgtgatgttgccacaggtgtacacgaatcggctcggttttatgttgagttgcacaaactgggggtaaatatccgctgttttgatgtaggcggcgggcttggcgtggattacgaaggaaaccgcacacaatcggattgttccgttaattacagcctcaacgaatatgccgccacagtcgtatggggcatcagtcaggcttgtctcgaacacgggctgccgcatccgacaatcatcaccgagagcgggcgcggcattaccgcacatcacgccgttttggttgctaatgttataggcgttgaacgttacaaaccgcgccggctggatgcgccatcgcccgaagcaccgcgtgtgttgcacagtatgtgggaaacttggacggatatttccgcctcgcgggaaaaacgttccttacgcagctggatacacgaagggcagtttgatcttgctgatgtgcataatcagtataatgtcgggctgttgagtttggcgcaacgtgcgtgggcggagcaactgtatttaaatatctgtcatgaagtcggcgaattgtttaatgaaaaacaccggtctcaccgaaccattattgacgaattgcaagaacgttttgccgataagctgtatgtcaatttctcactcttccaatctttgcccgatgcttggggcatagatcaacttttccctgtttgtcccattaccggtttgaatgaaccgattgcgcgccgcgccgtgttgttggacattacctgcgattcagacggtacgattgaccactacatcgacggagacggcatcgccggtacgatgcctatgcctgattatcccgaagaagagccgccgcttttaggcttttttatggtgggagcatatcaggaaatactcggcaatatgcacaatcttttcggcgacactgccactgccgatgttgttgtaggggaagacggacaatttaccgtcatcgattacgatgaaggaaacaccgttgccgatatgctcgaatacgtttatcaagatccgaaagagctgatgaaacgctatcgcgaacaaatcgaacattcagaccttcctgcctcgcaggctatgtctttcttaaaagaactcgaagcggggcttaatggttatacctatttggaagacgaatagacgcatcaaggcatcggatatgtcgtctgaagcccgattttcttactcaaacaccaatcatcacgaccgattgaaaccaattacaaggaatcattacgatgcaatacagcacactggcaggacaaaccgacaactccctcgtttccaataatttcgggtttttgcgcctgccgcttaattttatgccgtatgaaagtcatgccgattgggttattaccggcgtgccttatgatatggcggtttcagggcgttccggcgcgcgtttcggtcctgaagccatccggcgcgcctccgtcaacctcgcttgggagcaccgcaggtttccatggacatttgatgtgcgcgaacgcctgaacattattgattgcggcgacttggttttttcttttggcgacagcagggattttgtcgaaaaaatggaagcgcacgccggcaaattactttcttccggcaaacgctgtttgagtttgggcggcgaccatttcattaccctaccgttgttgcgcgcccacgcccgctatttcggcaaactcgcactgattcattttgacgcgcacaccgacacctacgacaacggcagcgaatacgaccacggtacgatgttctataccgcccccaaggaaggcctcatcgacccgtcccgttccgtacaaatcggcatacgcaccgaacacagtaaaaaattgccttttactgtgttgtccgcccctaaagtcaatgaagacagtgttgaagagaccgtccgtaaaatcaaagaaaccgtcggcaatatgcccgtttacctgactttcgacatagactgcctggacccgtcgttcgcccctgggaccggtacgcccgtatgcggcggcttgagcagcgacagggcattaaaaatcctacgtgggctgacggatctcgacatcgtcggtatggatgttgtagaagttgccccctcttacgaccaatccgacattaccgctttggccggtgccacaattgccttggaaatgctttaccttcaaggtgcgaaaaaggactgaacgtccggcatcccccgggttttcgccgtgccgttcaaacggcgtattcagtctaatgaaaattcaaatactgaaacaaaagttgcccggagccgcatatcggaaagacggtgaaatatcagaatatatcttataaaacaattagttaaatattatttttccgatttttcgggacggtcttttttacggaggtcaatatgatgaaattgggtttcaaaccgatacccctcgccattgccgcagtattgtgcgccctggttttggcactgcccgtacccgacggggtcaagcctcaggcttggacgctgctggccatgtttgtcggtgtgattgccgccattatcggcaaggccatgccgttgggcgcgctgtcgattattgccgtcgggttggtcgcagtaaccggcgtaaccgccgacaaaccgggcgcggcgatgagcgatgcgttgagtgcgttcgccaatccgttgatttggctgattgccatcgcagttatgatttcgcgcggtttgctcaaaacagggctggggatgcgtatcggatatttgtttatcgccgtttttggaagaaaaacgctgggcatcggttacagtctcgctctttccgaactgctgctggctcccgttaccccttccaataccgcgcgcggcggcggcattatacatccgattatgcagtcgattgccggcagttacggctccaatcccgcaaaaggcacagaaggcaagatgggtaaatatttggctttggtcaactatcattccaatcccatttcgtcggctatgtttattactgcaactgcccccaaccctttaatcgtcaacttgattgccgaaaatttaggcagtagtttccgtctttcttggggggcgtgggcgtgggcaatggctgttcccggcgttatcgcctttttcgttatgcctttgattttatattttttgtatccgcctgaaattaaagaaacgcccaatgccgttcaatttgccaaagaccgtctgagggagatgggtaaaatgtcggcagacgaaatcattatggcggtcattttcggtatcttgctgctgttgtgggcagatgttcccgcccttattaccggcaatcacgcttttagtatcaacgccaccgccaccgcatttatcggattaagcctgcttttgctttccggtgtattgacttgggacgatgttttgaaagaaaaaagcgcgtgggatacgattatttggtttggcgcattgattatgatggccgcatttttaaataaactcggactgattaaatggttctccggagtgttggcggaaagtgtcggcggtttgggcgttagcggcacggctgcgggcgtaatcctcgtgcttgcttatatgtatgcgcattatatgtttgccagtactactgcacatattaccgctatgttcggcgcatttttcgctgctgccgtttcactgaatgccccggcgatgccgaccgcgctgatgatggcggccgcatccaacattatgatgaccctcactcattatgcgaccggtacttcgcctgtgattttcggttcgggctacaccacaatgggagaatggtggaaggcgggttttatcatgagcgtagtcaattttctgatttttttcgttatcggcagcatttggtggaaagttctggggtattggtaagggaaaaataaaataaatttccaatctgtgtttatttgattgggcgactattatcgtgaaatatgccgtctaaagccttcagatggcatatttgtgcgcttgaatgttgcagaaagcggcaggcggcggtgtaggaaaagccaaacaaaaaccaaaccgcctatcaacttctgataaacataagcattaaataatcagaaggttattcaattacctaaacgcaaatttccctgccgtatcacatctattgaaaataatacatcaaccggctcggaagcagcctgatcaggtgtttctacttgcggcgatgaatcggcagccggttcggtataggcagtcggcgtgccgtcggattgggtatttaaatgcggttgtgcctcgggcgtgtgtacatcaggcacttcgggcgtgcgtgtctcggatatttcggcagagttggtttcctcagtttgttcaatgacttcagcttggctgtatgaggaagaaccctgtatccacgccagcgatttgagcggcatcttcatcttgccgtttttgccgcaggtcaggcagacggccgatccggtgcggtctttgagtacagcatcgactttctcgggcgcgatggttttaccctgtgtttttgcccattgcgcaatactttttttcagagaggcgatgtcaaggttgttcttaccgtaagggtcgcggaaggcggcaagccacaggttgcgatccgcatcttcattgagacccgccatttgatagatgacggaggcgggcgagccgctggcgatggttttggcaaactcgagcgcgtcgggcgatttcatgcggacgcagccgtgactccgaaccccggggacgctggccggcgcattggtcccgtgtatgcccaaaccgagtttggggtcgcctaagcggacaaaaaccggccccaaagggttgtccgggccggcggctatggtttttacgccgtcgccgcgttctttctgtatggatttggggatgtaccaaacagggttataggctttcgcaccgattttatgttcgcctagattggtttgcgtcatcgcccgacctactgcaacgggataaaccttggtcagtttgccgtcggtgtagaggaacaggcgttgctgagggatgttaatgaagacatgttgaccttgtgcgacgggggagacatcgggaatgatggtgtttgcgtatgaaaaaccgcttatcaatagtgcagcagtgcggcagattgttttattcatatcaaaatatggtgtgtgtccgataggttttcggcaaatcatacctgaaaccgtaccaatttgtgcgaaaatatgcgcttcggtacagtgcggacggattgggtaatggcaacggaaacaaatgtcgcggaaatttccgccttggattatgaaggcaggggtgtggcaaaggtcggcggcaaaacggtttttattaaaagggcattacttgattgtttgatgctgggttggttcaggctttaactcaggaatatttacatcataatgaaggtttttaaacaacagcttgaacaactcggcgcgcaaaaccaatatcgttcgattccggatttgattcatcaagggcggtatattacgcgggaaaaccgcaaaatgctgaatatgtcgtctaatgattatttgggtttggcatcagatgaaaacttgcgccggtcttttttgcagcaatacggcggtaattttccctcttttaccagttcttcatcgcgtttattaacgggcaactttcctatttataccgatttggaagagcttgtcgcacaacgtttccaacgggaaagcgcgttattgttcaacagcggctatcacgccaatctcggtattttgcctgctttgacgacgacgaaaagtttgattttggcagataaatttgttcacgccagtatgattgacggcatccgtttgagccggtgtgcgtttttccgttatcgtcataatgattatgaacatttgaaaaatctgcttgaaaaaaacgtcggaaaatttgaccgcacttttatcgttaccgaatctgttttcagtatggacggcgatgtggcggatttgaaacagcttgtccaattaaaaaaacagtttcccaatacttatctttatgtggatgaagcccacgcaatcggtgtttatgggcaaaacggattggggattgccgaacgggataatttgattgccgagattgatttattggttggcactttcggtaaagccttagcctcggtgggggcgtatgccgtctgcaaccaagtattgaaagaatgtttgattaatcaaatgcgcccattgattttttcaaccgcattgccgccgtttaatgtggcttggacttattttatttttgaacgattgccgcaattctcaaaagaaagaagccatcttgagcagttaagcgcatttttacggcgggaagtggcgcatcggacgcaaataatgccgagccaaacctgtatcgtcccctatattttaggcgggaatgaagccacccttgccaaagcggaatacctgcaaaggcagggttattattgcctgcccatcagaccgtcgacagtacccaaaaacacatccagaatccgcctgtctttaacggcagatatgacaacggatgaagtgcggcagtttgcggcgtgcctgtaaggatatgatatggaaacaaaattttacaatcatcaaggcggacatttaatcctgtattttgcaggttggggaacgccgcccgatgctgtaaatcatttgattttgccggaaaatcacgatttattgatttgctatgattatcaagatttaaatttggattttgatttttccgcctatcggcacatccgtttggtggcgtggtcaatgggcgtttgggcggcagagagggcattgcaaggaataagattaaaatccgcaacggcagtgaatggcacaggtttgccttgcgatgataatttcggtatcccttgcaccgtttttaaaggcacattggagaacctcacggaaaacacccgtttaaaatttgaacgcagaatgtgtggcgataaagcatcttttgaagattaccaacaatttcccgcacgcccgtttggcgaaattcatcaagaacttatcgcactttttgcgatgatcgggcaagatagacgtacagatcttatccgctggacaaatgccttggtcggatcgggcgataaaatttttatgcctgccaatcagcaccgatattggacaccgcgttgcaccgttcgggaaattgacgtcggacattacctgttttcaagattcacccattggtcggcactatggaatcactgactgccataaataaatcgcgcattcggcaggctttccaaaaagcattaaacgattatgaccggcacgccttaatccaacaaaaaatgacgattaatttaatgacgcatttgcaagattatttgccggatatgccattggaaaacgtgttggaattgggctgcggctcaggaatgttgagtgccttgctgcaaaaacagatttcagcgaattattggttatttaatgatttgtgcaatgtgcagccccaactggctgaaaaactgccgcaatcctttgatttttattgcggcgatgcggaaaactttccttttcaacgacaatttgacttaatcgcaagcgcatctgccgtgcaatggtttcatcaacccgacgcttttatcacccattgcaaaacaggcttgaaaacaaacggattattggcggttgcaacctttggcaaagacaatttaaaagaagtccgccaaattacaaatataggcttaaattacccgactttatcccaatggcaggcttggttagccaaagattttgagcttttatggtgtgaggattttacggtaatactagactttgatacgccgtcagatgtactcaaacaccttaaatatacaggcgtaacagccacgaaccaaaaaaattggacaagaaaaaatctcaatggatttattggcgattacttgtcggcgttcggtatgccgtcgggcaaagtgcgcctgacttatcatccgttattttttatcgcgcgctactctgcggcgggcaggcaataaggcagcttatgggcaaagttatttttatatcgggtattgatactgatgtgggtaaaaggtaatatggcgaggcttgtgcagaaggcatattgttaaacgttaaattatggtatgatttaaaacttacaagtctatttcagtaaatcgttaataataaaagcggacaatggccgttgcaggcggtcagctatccgctcgttacggtatcgggagtatcctttggaaaactcattaattatcggtttggcactggcggtattgctgatgcttttggttatgcgtgcgaagcagggtaagaaaacaccgaagcgcaaatcccaaggtgtcggcaatacgcaggggcagacacccggaagcaatgattcggactgggtcgatcagattggacaatcggtttcagacggcacgcaacccgactggtcttggaacgaaagtgccgagaccgcatccgccgccgtatccgcgcaagaagtcgatccgcttacggagtatcaggtttataagcaattcggttatcagggcaaggctgccgaatctttggctgcctatctggacggcattccggatggtgaagcgaaacctgaaaaccttatccgcgagctgctcgatatcaatctcgaagtgggggatgtcgatgttttggcagacaatctgcaaaaatacggcaaactgattctttccgaacttttggcaaaatatatcgaacaggcattacagcgcgattcaaaccatttgcgtatccgcgtcttggcggaagaaggtttgggatggggtactcaggagattgaaaaacgtgcggaaggcggttctgcgacggcagcttccgcatcgcccccgccggatgccggcggtaaggcttatgaagccgaagaaatcaagcgcatcccgattgtgcggggcaaaaaagacgtgtccggaatcagtcaagaggaaatcggtgcgattgccggtttggtccgtgccgatcaaggtgcgaaaatccttaaagacaaagtcagctatgaaacggcatcgaaacaatacgaccgtgccatccaaacttccgaaaaacctgcaaacctgattatcgatgcgttgaaactcgattaccaacacgcggacatagaccgttttgccggacatttgtggaaactttaccaaacgttgggcaactacggcaggcaggttaaagagcggatgctggggtgggggtacagcttgggttaccatgaagttttcgatgatttggaaaaagggccgaacgaccggcaaatcaaagacatcggtatggggcacgggtatctgccgaaaaatatacagaaattcaaatcgcaacatcgggatttggtgcttcaagattcttcgttgattaacaccggttcgtctccggcagacgatgcggttaaggaagtagagtcgttgctgatgtatggtcagattgaagcggcaatggatgtgttggagcaggcggtattgaaatatcccgacgagtcccagctttatattacgttgatcgatatttatgaacgtactgaagattgggataggttggggcagtttttaagggtattgagggaacgtgcggacaggcttcctgaagaggtcgttatgctgatgagccggctgctgcagcgtatgaatcaaaatattaaaaaaataaaacggtacggaaaataaaaatggaagttcaactgccgaaaattaaaacagtacgcgtaatgttggcggggatgacggcgcagcaggaatccgttttcaaaatggcattcaaaatgcacaataccacccgttatgaaacagtatccccttcagacggcagtgccgtgcccgatttggttttggcggataccgatgccgagggcggttttgaactttggaaagagcttgccgagcgttataaggatatacccgtcgccgtctgttcggagaaagttcccgattctgaagttccctacctgcccaaaccgattcggtttgaaacattgtttcctatgctccgcaaattgttgcagggcgagaatgtttatgggaaatcgtttattgcacccgcagaccggtcggcgaaaaataacgggaatgtgcagcgtacggttacgatacgccagtttaacccgaataaaggattattgggggcgttgcggtttgcggaaaagaacaggcaggacatcgctatcttgcatggaaataagccggtccttattgttttcccctcgatacaacgggttttgctgacagaaagtgtgcaaaaactcgaagaattgtgcaaagacgaaaatttgcaggtcagctgcaagactgttcccgataacccgcaatggcgcgaaaaggctaaagtaggcattatgtcctgtatgtggcagttttccatttggacagcgcagggcaggttgatttatccgatttctcccgatactccgtttacgttgaaatcttggccaaacctgacccggttggcaaatgtgccggggtcgatacgcttgtcggcatttctgaccaaggcatccgtcaaccttaacgtgttgtataaagtgatgcctttaaacctcaatgatattctgaattatcttgcggcaacctatacaaccgggtttttgtcggtagatttaaaaacggtttcacaacaggcatactccgatatggcggataaaataaatatcggagccgattctgcctctgatagtgaaatgatgaaaaaagcggaaaaaatcacaacaccatcccaatcccagtcgcgcggccttctgcaaaggctgatgaaaaaactgttgggcagctaagaggcggagagatgagagaaaataaaattattttcacaggacctgtcggcgtagggaaaaccactgccattgcggctatttcggacgaagcactcgttcagaccgatgcttccgcatccgatatgactttggataggaaaaggaatacgacagtggcgatggactacggggccatcagcttggatgaggataccaaagtccatttatatggtacgcccggtcaggaacggttcaactttatgtgggaaatcttaagccaaggcagtatgggtttggtcttgcttttagataatgcccgaaccaatccgttgaaagatttggaattctttttacattcgtttcgagggctgctggagaaggcacccgtcgttgtcggtattaccaagatggatatacgctctcagcccggtatcgacgtgtatcacaaatatcttgcaaaacataatcttaatgttccggtttttgaaattgatgcccgtaaggaagatgacgtaaaacaattggttagcgcaatgttattttctattgatccgggactggaggtttaatatggaatcaacactttcactacaagcaaatttatatccccgcctgactcctgccggtgcattttatgccgtatccagcgatgcccccagtgccggtaaaactttgttgcacagcctgttgaaagcagatgcggacgaaatggtcagcagtgagaagctgcttacttgggcggacaccgccgacatcgataccgctttgaacctgttgtaccgtttgcaaaaactcgaattcctctatggcgatgaaaacggtcattcagacggcatcaatttgtcggacgagcaattgccgttgctgatggaacaattgtccggcagcggtaaggcgttattggtcgatcggaacggtctgtatcttgccaacgccaatttccatcatgaggcggcggaagagttggggttgttggcggcagaagtcgcacagatggaaaagaaataccggctgctgattaagaacaacctgtatatcaacaataacgcttggggcgtttgcgatccttccggtcagagcgaattgacatttttcccattgtatatcggttcaaccaaatttattttggttatcggcggcattcccgatttgggcaaagaggcatttgttactttggtaaggattttataccgccgttacagcaaccgcgtgtaaaacttgggagagaggaggggttatgcagcaattattgatttcaatccttgaagatttaaacaatacatctacggatattatcgcgtctgccgttatctcaaccgacggattgccgatggcgacaatgcttccttcacatttgaattcggacagggtaggggcgatttctgccactttgcttgctttggggagtcgctcggtgcaggaactcgcctgcggggaattggaacaagtgatgattaaaggaaaatcaggctatatccttttaagtcaggcgggtaaagatgccgtgttggtgctggtggcaaaagaaaccggcagacttggtttaatcctattggatgccaaacgtgcggcaaggcatattgcggaagccatataacatataaagattgcgggcttgcagataaagtgcaatcgattgtcaatttatattgacacgttcggtatttctgttttattattcgcgcttgttccccgatagctcagtcggtagagcgacggactgttaatccgcaggtccctggttcgagcccaggtcggggagccaaatttcaaaaccctctaagtattttcttagagggttttgttttaccggcggtcagaaacgcatttttgagatgattgttttgagatggaataaaatctttgcaaaattcctttcgtgatggttatgaaaaaataggggctgtcctggacagctaggataaactcgattttatagtggattaacaaaaaccagtacggcattggctcgccttagctcaaagagaacgattctctaaggtgctgaagcaccgagtgaatcggttccgtactatttgtactgtctgcggcttcgtcgccttgtcctgatttttgttaatccactatactaattgagacctttgcaaaattcctttccctcccgacagccgaaacccaaacacaggttttcgtctatttccgctaccaatcactccctaattctacccaaatacccccttaatcctccccggatacccgataatcaggcatccggggtaccttttaggcggcaacaggcgcacttagcctgagacctttgcaaatttgtcggtttcggggtcgtattggtagcctcgtgcctgtatgtcttctttgaaagtttcgtatacgtcgtgggctaaaagggctgttccgacatagggaaccgcccttgtgctgaatttcgcgcctaagcgggcaagtttgccgacccccgccaatacgccggcgcgggatacgctggcggttattttggcgttgattcgggcttttgcgcccgtagggatgtgtgttaaatctaccgtttttattaaatcagatgaataagttttactatttttaggtacaaacttatgaattttcgcaccttgtccggtatcaactgaaacagtttcagatatttttactgcatttgcattcgcttcaaacgaatacatcatcaaaattgcaattatcgacaatttcgcaaaattcaaatttgtatattttatgaccatctttcagggattctttaattaccatttctgaattatcagaaaatgagattagccaaatatcatgtttaattcttctattccagaaaaaagagaaacaatcaataacattttcagacttattaatcttcgcaaattcaacaaattcagattgcgctataaccgccatcgattgcccaaaatacttgctggacggctgatatttataaagtgccaactgcgcctgagtgataaacggcttgttcatggttctgcctttcaatgattgttttgaaagcctgattttgacaccataacttcatgcgctcaattcttaaacagaaccgccccgattaatacgggtacggaaacgccgagataaaaataaaaatccatcatttcaaaacctttttcagcagggaaacaaagtaaacggacgcgaggatgccgaatactatccagcctgtttcaagaccgctttgcaggttgtctttcggactgcattccgccaataaaagccttagcggctgaccgtccgacatcttccacaggctgccgttatattccggcctgacaatctgtccgttttctttgattcttggtactaccaagctgaaataaaggttttcagcctggtgcttctcaagacatttatttccgacttggtagtacatgccgtcttacttcatcactctcttaacgatggaaaatacaaaaagcgcggcgaaaatgcccactacaatccaaccggcttccataccgtccgcttttgcggcttccaaagcgttttttgccgtatcgggcaacgttgcatttgcatgtgcggccaaagccaggggagcagctgttacaacagccagttttgcgccgtatttacggcaggtgttaataaatttcatgatattttccttcaaaaagtgtttggcggtaatggatggagcgtttttcagacgaccgccgaacatccgaaaatcagtctttcaaaaatccgaatacgacaaattcgtattggttgccgatttcttccaaacctgcgttaatcgcttcttcgaagtcgtagaaataatcggcattggtgattaatttggtatgtccgatgtcgcccgtttcaggagagagatacagaaagtcccctgttgatacggactggacaacatagactttctgcattcaatcagcctttcttcacgagttgaaaaccgatgactttcagtttttgggttttgcccgtagtgacgatttctacgttcaggtttgcttcgatcggaaattgggcgtttcggaactgctcgaaattggcagagccgccgaaatcgtattcagtagtagagctgcccaatgcgttgccttgggagctgtctaagggtgtggcgacaatcaggcagcaatagtcgaagctcttgccttcgatttgtccgttgatttttttaacgccgacgatgtggccttgaagttggatgttcattttttggtttccttgtgtgattaaacgtctttcgggcagacactttaagcccatgaaatcggtagtcttgcgaatttgtcgtaaatgaagttgttatagctttcttcattgttgacgtgtttttgctgttcaagctgtttttcaagattctcgtaatattcgtacatatagtaagggtctttgtacggtttgaatgcgggctgttcatgaatggcttgagctttcaaaaaggcgcagtcgtaggcttcgggagccaaagacttgggcagcttgtgatgactcggctcaatcagttcaaacagtttggctttgtccaattcgggaaaaatgaatttcagaccgtttgccgcacgtccgaactgtttttttacccattcaaggtagcggtcggctgaaatgaccttatcttccttaaccgcgtgtatgcgcgttgccttttgggcgaatcgttcgcaaatcggatatgcgccgccgaaatattcgcccggattctgcaaaacttcgaaagggataacgatgtcttttgctttgaattcaatttcaaatcgcgtccatgtgcttgttttatcgcccaactgcttgcctttttcatagacgcggacatatttggacgattcacgggagccgataccataggtcttgcctttggtcattttggcttcatcgtcttcttcccaatctgaccccaaacattcgccttttggtttgacgtgatgacaggtaaacatacctttatttcggtcttcacgggcttggttcgggctgtattcgccgttgaaaaagtcttttgcgatgtcaacgcgtgtgatttttgggcggattgcattagtcaggaatgcgaaaagtcgtgattcccagccttcttttgcgacgccgcaaccggtgccggtcagttcgaaaagaatggtattttgttggccgccaaaatggacgcgaccgtatagggcgtcttccgaacccatcaaccaacagcgctcatagaaacgaccgcccgaacctttggattctttgtagataccgaaaccgaaaacttcttcggcgagcatggacgcggcgcgaataaaatcttcgtcttccaaaagacttacacgaacgccgtatttatcgaaaaaggttttttcatgaaatgaaaagctaatttgatcaatgaaagccgaatctgatacaccgcgccgaagaggaacgcctaacaggtttcctttaccgtccgttatgtacgtttcgtaacattcgaagacttcctgaaccctgcctgccgtttcggtttctgtccccccctgttagataaggggggaagatttgaagcggttgtcggcttcctgccgtccgctagcgcgtccgtcatcacgccggcaaccgcctttgtcatcccttgcttatcttccatggtgcgaatcctcaaaaacgggcaaaaaaaagccctgttacttgtagaaagtaaaggacgttaatttttgttaatcgtcccttcttagggacgcaatatataaggccgtctgaaacggtttttctgtttttagacggcctcttggcttagaccttgagaaccgcatgcgtgcttaatttattatctaatgaaaaaagtttccggctttcagacgaccttttgtaatattatcggcagcggctcaatgccaactttaaacctgctccgatttcttcagggctgttatccaatgataaaattacatcgtctgcatcaatggcatcccacgcttccagcttgacatggcggctcgggctgattttcaggcagccgttgtgcagccaaatatctacgctcatcatgtttttaaatagggcgcgtctggttttatagcccaagttcccgcatagcttggcaacccaatcctcatagcgttgccgaattttttcggtatcaaaaaaatcttggtcttctggactgtcataaacgaaagtcctgctgtttgccaatgcttgcaagaccgttgtgcctaaagtttcattgtcggtatccaatggcaggatatgggggggatataggtggtctggagcatatcgcccaaatcctgaccatgtttgaataatcaaggctctttcatttgccttatagccagcccaataatcttgttcttgattgaaagtcatttattcgatctccgtaattttgactgtaatgttttgacttttgccatactctaccacacgttgcaactgcaatctttgctccttattagtttgtgcgggtatggccagatggatttcgcgctgtttgatcatgtctgcccttaacggtacttctgataattcataacttttgaaatttgccgtcttatcgatgtaccctttcatggtactgtaaagctgttcgggtttggacaggcgtgccgtagtttgcgtatccagagttttggcactgattgccgtgcctgtaccacgatcaaaataatcaaatgttttaaaatttttaggtaaccttgcattggcagacaagcccttaccgacataatcctcccaaggcattccctgtccttcaatccccttgccccacttgataccgacttcggattgggacaggatatttcgctgtacgtcagcagttttcggagtcaaggaagttttcacacccgttgccaagtttcccaatttgcgcgtaatcagcgtttccaatccccatacggctagatttttcgcatcagatactaacggcgattcgtattctattggtgtacccaaagataggacaacttttttaccaaaatcggactggtaagtgccaaacaattgccggcttccttctgaggcctgtgtataaccaccggtcatacctgccgttgcaataagtccaccggccgcacagccaatcccggtactgcacagacctccgcctatagcacccgaaccgacaaaagtcgttgcacccaatcccatattgcccgcacccttaattttggtggcagcacggtcgtaactgctgcgtatatcattcaggctgttccatgttccatatttaaatgcatccgtccgcatcaatacgttttgttccgctacaaactgtttaccggcatcttggaggttttttagtcctttataaagagggtcgaagtcaggtacgccttccgcgcaccgggttaatgcacatgcagcggcttttaggcggtactgttcttcagccgatttgccttttgacagtttgttaaggatttgtgtttctttcggatgcagctgcctattgttccaatcgacattcgcccctactgccgccgtaccgacattcccgcccgccgcatagccgattgccgccccgccccgtgcagtatgctcctgcctatgccgccttctttccaggtgtcgtagcggctttggttttcggcaagataggcgtttacttggccgagggatgcgcggaaggcggctttttcggcttcgctgtccgtgttttgcagttcggcctccagcagggttcgggcttcctgataccgttcgtaactttgggtattgccgagtttgtcggcaacggccgctacggcttgggtggcgtttctgccgaactccttcgttacttccctttgcaggttgatctctttggcgaccgcgtctttgtcgaagctgtttttcagacggcctgagtgttgatccgcagtttcggtgtcgatgccggtgtagatacgcgcttcggtttcttttgcagtcctgcctgttcgggcaagttgtcccgcttcgtcggtgatgtgtatgttgcgggtgttgatgccgcttttcgtgatgctgctttgactgtcgctgtcgctgccgtagccggctgccaggcttatcctgtcggtaggtctgccttgtttgtcggtaaccgtgccgtcccagccgccgttcaggtcgaaactgccgcctatgccgaagcttttgccttcgtagcggctgtggttttgaatgtcgctatgggtgagggtggccgtctgaaaaaggtttttgcccttatcttctgcgctttggctagacgtgatgataccgcccttgaggtctgtgttgtctctgactttgatttgatagccgtcttctccggcataaataccgctttgctcggttaccgaagcatggtcggctcggattttgctttggctgtaatcgccactggcactgaagccataacctacggtcacttgtgcactggcgttttgttgtttgctttgataggtttcagtatcttgaacactttctatatgcaggttgcgcgtatctgcctgtatgcctttgccgatgagctgcgcacctttgagggtggtatccccgccgcttcgaatggtagttttaccggttgtgctgccgacatgggtgtggcggtgggttgcttttgtctgattgctgtggtggcttgttgaaagaaaggctgtctgaaacgtatttgttgtttcagacagcctcctggctcaaaccttgaaaactacatatgtgcgttccgcacatcctacgtattgagtttaggtttcacatgagctacggcttgctatgccgtcttttttccaggtgtggccgcggctttggttttcggcaaggtaggcgtttacttggtcagatggcggattttttgttcgtcgtagatgatggagacgctgataccggagtaagcgtagattgggtcttgacctcaaacctacacttgttttacataaaatttcgtgtctctatttgaaaaatctaaataacaacattctactttacctattgaattgattatagttgaaacaggaatattaagaagcctaatacccaaatcatcaatttcaaaatcattaattccactcttataaagatagcttattatttcatcattaatttttccaagccaattaaaagaaatatcttctaaaaaaaacttatttggttcaaatatctctatcgcttcaagctgatttttatcatcataaaaacaatggatattcaattcgggaaaaacatccataggaacccgagagtatgatgacttataaatttcttgtacatcagaactaaatattgcacgaacttgttttcgattcagatttgatgagataatatttctttctattttttttgaactaaaataaaaaattgccataatttttttgcctaaacaatattaccattttcgtaagatgcatagaacaaaccatgtcttatccattttgttccatcggcagacagataacgactatatctaaattttatttttcactctcataaaaaattttctgcaatattcaatatatttactttcttaaccatagcgtaaattcctcaggcttatatatttcagtataagtatgacttaaaggatatgacgccgcgtgttacgagttgcttcttttgatttcagggtttatataagttatggcttgcctgggctcgaagtgataaagagagtatttacttttcaactataaaaatatgagatagttccatgggaaaaccgtaatttaagttttaataaagcaccttctaggcgatataaaaattttctataattttcatttggtttatatttatatataagctgtatttcaatagtctcatagctactttctccaaaatcttcaaaaatttgacctgattcaatatattgaatatatgaatttattttttcttgcaacaaaaacaaatgctcgttatcccattttaagtgatcagaaatagttaatatgagtattccgttttcaatagaggctgaatcaattacattctcttccaaaatagacattatcttttcctttcaattataactttagtaggttcaattttggtcccctttggatagcccggttttcccttaccgaccactgttgctcccgttctttcaatttcaggaaaagcttttttctgatttttagtaagtggcgcagttattgaagccttacactctgtacaaacatcaagaccaccttctttcgaaataatatcaagcctagtttttacaccactttttgttttaactgtaatctgtctttgcggtttaaagccttgtttaactttcttctgataaatttccatctcaaaatcctcaccagattttttatttttttccagttgatctttacgatttttatgtttgattcccttgctagccaatgccgtatccggaatcctgtcccccttcgcaacattgccgtttgcagggatacggatattccccgcacccgccaataagggatcgctgccggtaactgtcggcttgatgtttttcaggttgcggatgcctgcaagaatcgggacttttatcctcggattggggttgacaaggctcgtcagtccttcggcaacgttcagtgcaaactcttcgtttttccgctctccctgcctgattttggtgtctttcgtcccgctgtgcagccaggtcaggttgcggtattcgggtttgtcctgtcggcggtattcctcaaacagcttcggatcgttgtaggtttgcggatttcttgcgccgtagtcgcggtagtcccaagtataacccaaggctttgtcttcgcctttcattccgataagggatatgacgctttggtcggtatagccgtcttgggaacctttgtccacccaacgcagtatctgcctgcggattctcattgccgcttcttggctgctgatttttctgccttcgcgtttttcaacttcgcgcttgagggcttcggcatatttgtcggccaacgccatttctttcggatgcagctgcctattgttccaatctacattcgcacccaccacagcaccaccactaccaccagttgcatagccgatggccgcaccgcccagtgcgttgaccgccgctttgcccgccggaccgaggttttccgccgctttgtccaaatacggtgcggcaagggaagtgccgccgccggccagtatgccgccgaggctgccggtcgtcagtccgcctgccgccccgtgcagtatgctcctgcctatgccgccttctttccaggtgtcgtagcggctttggttttcggcaagataggcgtttacttggccgagggatgcgcggaaggcggctttttcggcttcgctgtccgtgttttgcagttcggcctccagcagggttcgggcttcctgataccgttcgtaactttgggtattgccgagtttgtcggcaacggccgctacggcttgggcggcgtttctgccgaactccttcgttacttccctttgcaggttgatctctttggcgaccgcgtctttgtcgaagctgtttttcagatggcctgagtgttgatccgcagtttcggtgtcgatgccggtgtagatacgcgcttcggtttcttttgcagtcctgcctgttcgggcaagttgtcccgcttcgtcggtgatgtgtatgttgtgggtgttgacgccgctgcgggtggtgctgtttttgctgtctccgtcgctgccgtagccggctgccgggcttatcctgtcggtaggcctgccttgtttgtcggtaaccgtgccgtcccagccgccgttcaggtcgaaactgccgcctatgccgaagcttctgccttcgtagcggctgtggttttgaatgtcgctggcagtaagggtggccgtctgaaaaaggtttttgcccttatcttctgcgctttggctagacgtgatgataccgcccttgaggtctgtgttgtctctgactttgatttgatagccgtcttctccggcataaataccgctttgcccggttacggaggcatggtctgctttgactttgctttggcggtaactgccgcttgcactgaatccgtaaccgacagtaacttggacattgccgttttgctgtttgctctgataggtttcagtatcttgaacactttctatatgcaggttgcgcgtatctgcctgtatgcctttgccgatgagctgcacacctttgagggtggtatccccgccgcttcggatggtagttttgccggttgtgctgccgacatgggtgtggcggtgggtagtacttcccccttgctctttacctttaccgatatttcctccggcggtaattccaaacctgatgccgttgcctattttgacggctacgcctgcattccaaccactgcttttgtttttgctttgctcgctgccgtcctgtttggcagattggagtctgatatggttgtcggcaatgagggcagtacctgcatggccgatgacatcggaacctgtaatattgatattggactgctccccacttcctgttgccgcaagtgtggtttgccctttgccgataatttgacttgctgccgcttcggtgtaatgtcttttttgctcgttacgacttttctgttcgccgtaggtaatggacacactgatactggggctttgattgttgttttgaccttgtcccgcactgctgcttggagcaaattgttgcatttgttgggttgcttgataactctgccatgcagcattggctgcagccatggcattaacgcgtttatttttacttttgcccacattttgggctgcttgtatgaagttttgtgcagcttggacaaccgggacattgagggcgacggtaaggcctttttgttcctgggtatgggcgtagtcagtggcataccggttgtttgcgaactctacatctatgcttttggctgtgacggtattgcgcccctcggggctggagacggtactgccggtttgtcggtagcggtttcctgcaactgtaacggtgtctccattcaggctgcctataatgctgcctgtatggacaatattggtacgatcagtgtcatcggtagttttccggttaccgatagtaaagcccaatccgccagtacccatgacgcctgattttttgctctcgtggtattcattgccggtatagcgattatgggcagtagaaatatcgatgtcgtgtcctgcttttaaaacaatgcccttatcagaaataaggttgctgccgcgtacattgatatcctgcccggctgcaacaatcattttgccgccgccgatgttgctgccgactgcttcatcatgactgaagcggtagcggtcgtgtgttttggtactggaaaggatgcctttgctttttccgcttaccgaggtatccagttcggttatttggcgtccttcgctgatagtgacatcacgtcctgcggcaaggacggttttgccttcttcggcctccagttcgccttggcggatttttaagtcgttaccggctctaagcagtgcgccgttttgcgtgcggatactgctgccgacttcggtactttggcggacatggcgatggttctcgtcatctaatgtaccataggcttcgcgatgttcggtacggatggtgccgaggttgagattattgccggcggtaatttgggtagtgccgtctttaacttggttagagacggtggccgcattgaggttgatatcgttgctggcatgcagggataggatgccgtctgaagttctgttatctacttgttcagtatggcttccgaccacgttaatgccggccatacgatcgatggcggtattgccgttacgttcattaccggaagtttgggttgtaccgttaaggttgatattttgcgcttgggcagtcagcagtctgcctgcttgtacctgcccgccgtcgatattgatacttttttcagcttttaagccgatttggtcggcttgaatgttaccgttgctgttaatattccgtgcctggatgagtacggcctgtcgccccgcaatggtaccgctgttagtcaggttgccgttttgcagtttaagtaagacttgttcggcactaatcaggccaccggaggtattgagatcacctttgcgcgccagggcatagactttaggaaccagtacggtttgagtcgaaccgtcagacagggtgacggtttgattttccatccaaacgatatctgaagttaagcgggcaacttgctctgcactcaaggcgatacctggggtgagaccgaatgttttggcagcagtaaggccgttgtccatcagagctttgaattgttcttcatcactcctgtagccgtcgagtcggcggtagcctgttaactgatggatttgttcattaacaagtttttgttcgtagtagccgtcgccaagccgtttgtgtagatgattggtgtccaattgcagttgttgcaacatgtagtcgctgcccaaccagcggcggtagtctgcaaattgaggatcggtttcaaccaaccagcctttattgtcaggatgggtggtatagaggctgctgttaggcagagtaacagtagcgttatttaacgagaccacattaccggtatggatgcgctgaccattgacggctgccgtggatactccgtcaatcagtttgattgcagatgcggcgggttgaaaggaaggggaggcggcattctgttggatgacggatacaggcgtgtcgaagtcgtgggtaaatagttgggtatcatggtaaggagtatggtttctttcagtacggcgttgtctttttctaccgctgtaccatcctttttttgtaactgaatcccactgtgtgccgacagcatctgtgcgacctttgcctgttgtactttgattggtaatttctttctggtttaaatcatcagtgataatacgcccgcctactacaatccggctgtctttgttcagccaattttgacctgaggcagtcaaatcaccgcccacagtaatgtgtgccggccggttttcgatgatgcgttctttataagtctcgatgtggtagtctcggacatgccattggttggcctcaatacgagaaccattttttaaatggaacgtagcagtagtttggtctttttgtccttgcgagttgtcgaataaaccgtcttttcccgcctgatagtaggtattttgccccagtacggtgtagtcgcggacttgcttttccgctttggctaagtatgtctctgttttaaagtgattattgatattctgcatattccgaacggacatcaatgcatcaccttgtacttccaaaccggcactgccattaacaaaggtatcggccatgcctgccgcatgatgttgttcatccagtcgattacctacggcaaaaataccttcgctggatagtagggcaccttcttggttatgaatctctttcgctccaatatccaaacgtttccttgcagctattgcccccgctttggtactgccttccgtcgtttcttcccggttaagcagtatttgcgcgtccagggcaatatggttgccatagattttgcctgtcccggtgttggtcagggtttgacctgcaccgatgtgggtcaaaccgtcgctgttgatcaagcccctgttgtcaacatgctgttcggatgtgatgtccgtttgttctccaccaataattttgcctgtaacttggttatctatattgccggcattgagtttgagcgtatggcctgcttgtagggtatgggtatttttcagacggccttttatgcttagatttaattgtttgcctgcagtgaggtcgcgctctacgacgaaatcgtccgtcaaagcaatatccagtttgttaccggctgttaatgtgccattgttggcgagtgatttggcttgtagcgatacattaccggcagattgaatcgtgccatccgcattgtttaacgccaaagtgttttgatttttatcgtgaatagacaactgccggttggtggcaatttcaccatgttggttgtataggccgtctgaaacagctaattgtgcttggtttgcagataggagtttgccgttttggttgtctacatttcgactattgatagtcagttgttcggtagcagtaatatggccgctttggttagtcagttgctgactttggatgttaaccgtttcagcctctatacgtccgcgcgtattatctagagtctgaccttcggtattcagtcgtgcaacagaaacttttcctgtattgcgaagattattcttggtggtaacggttccactatcggcaagaatgttacctgcattatgtaaaccggcggtatcaagctgtaaatgtgcagctcgaatattgccttttttatcattgctcaagcggcccgaatgaatgagtgtcagattgttggcggcaatttctccggcattatgcagttcacggttatcaatcttgccggtttgagttaataagtgaccgctgtttttagcagtttgagtgttaacagccagatcgtgtgcctggagtttgccttttaccgtattgttaaatgaatcgcctgatactcgtagtttagccgcattcagactacccgaatttcccaaaccgttttgggcggcaatgtcaatttgcccacccgcattaattgatcctgcattgtcaaatgctcctgttgtttgaatgcgtcctacggcgtagttttttgcaggtgctgtaggtgaaacgggattgtttgaaccaggcttagataccgagacagtgctgctgcctgaacctgttgcagtactcggaatctgtggtatgactgatggattgggattcaaaccggtctgtggaacgtcacttacaccaatcttgccactgttatcgaatttgccggcagataccaaatccaatgcttgtgaacctgtttgagtaatattacctgtgttatccaaaccacctgttgacatatctaagcgggcagcctggatcgtaccgttgttttggtttttcagacggcctaaattacgaacagtcaatcgacctgaggataagaccgtacctgaattgtccagcgtctggctgtgaatattggcatcatcctgtgaggcaaccgtaccgctattatgaacattgcgggcatgaagtgaaaccgcatgattttctcccgtcgctgcaatcatgcccgtgttgaccagtttaccctcagcattcactgccacattgccggctgaggcaaaccattgcccttgattacgaatgcctgcttgctcgaccgtactgatcaaggtgattttgttggcatacatacctcctaatttgcctgtatcaatcgcaaataaagggatatgtgtgccgttgttggctgtattgtttgacgtattggcagcagcattattgagaataggcgaatgtgcatcacctgttgcggccacatcgttttgtcccgcgacgacacgaacatcttgtccccatacgggtgcatcaattttggaatgataactgagaatacgtgtgtaatcggtatcacgtgcatccaaaccgtgtccggcgattacaacattgccttgccttatcttaaagccgctaaggtctcctgcttgatattgcggttgggctgtcgtcaaagtggcacgggaagcattgataaaaccaccaccattgactgcaatccctgccggattggcaataacgacttctgcacgtcgtccgcccacttcaatatagccattcagttgtgaagaatggctgctgttgatttggtttacaaccacacgtgcttcgccccttgccaaccaaggattgccttgaatccaaccgcctagctgtgtttgggtgttgctgcgactgttgtttaaaatcgccccgcgattacccacatcaaactgggcgtattgattaacagaaacccctgccgaagtaggggtttgaatattgacttgcggtatgccgttacctgtttgcaggatggtaggctgttgctgtgcaggtgcggatttgtcggcaacgataccttgggcagtagcagaagaagaagtcaggataagggcagaaccgagcagtaatgaaagggagaatgagataacagagatagaatggataaaacccgcaaagcccgcaatatcatttggcaaaatacctacagcttgggtgtcggctgtgtttttgccctcgcgtttggcattttcagcaacggctatcatgcagtttcgatgtttgttaaatacaactttgtacagggtgcggttcatagtaagggctttcttaataatatttttataatcgtaaattagattaatttttaggggctgacgtagattaacagttatgccaggctacgaaaataaagataaccaattgtaaattaaacaatagagttcaaaagaaactgcttgaatttttcgtactccaagctaccgcccgttccgctgccgatattttgggtatggcgctgcgggcaatttccgttcccacttcggcgagttggcgcataatggaacgctcgcgcacgatttcggcatggcgccggatgttggcggcagacggagtattttgcgccagcgtaatcagatattcgaatccccccgccgcttccagctcttcgttccgctgcaaatcttcctgaaccgtgatgacatcggcaggacggctctcattgatcagtttggcaatggatcggaaaatcaggcggtgttcgtggcggtagaaatcctctcccgaaaccacatcggcaatcctgtcccaagccggattttccagcatcaacccgcccaaaacggattgttccgcctccattgagtgcggcggaagcgataatgagccgattcctccgtcttcagacggcatggctgtgtaatcgttcatggtacatccgacaaaattgcaatcttctattgtagcgtaaagcaggttcaattggtttccgtaccgcaaaacaggtagaatacgcgagttgccgggttaaataccttcctcaaccatcacagttaacataggaaataatttggcaatctgagaatcggctatccacctgtttgtcccttcagtcctaagcatacctgaatctttaacccaaattgttccatccttgtccttaaaacgtgtgccattagaaatcttttcccattcgtttaaaacgacttttgcatttttgttttcaggatttttggccccattatctttagccacatcttcaaatccccaacgttcctctacggcttttttcagaatattcagcctatgggctttagtcacgttctgaccttttgcaatgagcgaagcgatatatgcttccgccctgacccgtatcgttccggcttccaaatcagtcattccggcaaaaagttccgattgattttcaagagggatgtctttcgaccctattttatgtaggattgagaatgtaaaacctacaatttttcgtccttctttatgctgctcgtaggtaatggaaatatccgttttatcattgatctgcttgacggcgaaatccaaaaccttacgtttgaatagctccattttttgatactcgtcaggcatcatacccaaacgttcgcgcaactccattgtactgaacatcggtgtcttaccggctgcacgccatgaaataataatttcgtagagccgcaccgcgtatttactgctcaacgatgagacctgatcaagctcgtagcttgtgaagtttttttctagcatcgtaatcaaaggggcaacatttggtgcaaaaactaactctaccgttgcctgttgttcaatataggcgacttgagatacccaccttgtccgtactaccttttccccttttggtgttttttcgataaaactgaattggcgttcaaaaaggttgttacaggcatctttcaaagccttatacgccgtattacggttggtatggaaattattaacgatgcagaacttatccgttccatgcagcgtcagcagcacatagatgctgaattgttaactgatgcaaatgtccgtttcgagcaaccattggagaagaacaattatgtcctgagtgaagatgaaacaccgtgtactcgggtaaattacattagtttagatgataagacggtgcgcaaattttcttttcttccttctgtgctcatgaaagaaacagcttttaaaactgggatgtgtttaggttccaataatttgagcaggctacaaaaagccgcgcaacagatactgatcgtgcgtggctacctcacttcccaagctattatccaaccacagaatatggattcgggaattctgaaattacgggtatcagcaggcgaaataggggatatccgctatgaagaaaaacgggatgggaagtctgccgagggcagtattagtgcattcaataacaaatttcccttatataggaacaaaattctcaatcttcgcgatgtagagcagggcttggaaaacctgcgtcgtttgccgagtgttaaaacagatattcagattataccgtccgaagaagaaggcaaaagcgatttacagatcaaatggcagcagaataaacccatacggttcagtatcggtatagatgatgcgggcggcaaaacgaccggcaaatatcaaggaaatgtcgctttatcgttcgataaccctttgggcttaagcgatttgttttatgtttcatatggacgcggtttggcgcacaaaacggacttgactgatgccaccggtacggaaactgaaagcggatccagaagttacagcgtgcattattcggtgcccgtaaaaaaatggctgttttcttttaatcacaatggacatcgttaccacgaagcaaccgaaggctattccgtcaattacgattacaacggcaaacaatatcagagcagcctggccgccgagcgcatgctttggcgtaacagacttcataaaacttcagtcggaatgaaattatggacacgccaaacctataaatacatcgacgatgccgaaatcgaagtacaacgccgccgctctgcaggctgggaagccgaattgcgccaccgtgcttacctcaaccgttggcagcttgacggcaagttgtcttacaaacgcgggaccggcatgcgccaaagtatgcctgcaccggaagaaaacggcggcgatattcttccaggtacatctcgtatgaaaatcattactgccagtttggacgcagccgccccatttattttaggcaaacagcagtttttctacgcaaccgccattcaagctcaatggaacaaaacgccgttggttgcccaagataaattgtcaatcggcagccgctacaccgttcgcggatttgatggggagcagagtcttttcggagagcgaggtttctactggcagaatactttaacttggtattttcatccgaaccatcagttctatctcggtgcggactatggccgcgtatctggcgaaagtgcacaatatgtatcgggcaagcagctgatgggtgcagtggtcggcttcagaggagggcataaagtaggcggtatgtttgcttatgatctgtttgccggcaagccgcttcataaacccaaaggctttcagacgaccaacaccgtttacggcttcaacttgaattacagtttctaacctctgaattttttactgatatttagacggtctttccttatcctcagaccgtcaaactttacctacgtacttggcgcgcagtacgttcatcttcaaaatggaatagacatgaataaaggtttacatcgcattatctttagtaaaaagcacagcaccatggttgcagtagccgaaactgccaacagccagggcaaaggtaaacaggcaggcagttcggtttctgtttcactgaaaacttcaggcgacctttgcggcaaactcaaaaccacccttaaaactttggtctgctctttggtttccctgagtatggtattgcctgcccatgcccaaattaccaccgacaaatcagcacctaaaaaccagcaggtcgttatccttaaaaccaacactggtgcccccttggtgaatatccaaactccgaatggacgcggattgagccacaaccgctatacgcagtttgatgttgacaacaaaggggcagtgttaaacaacgaccgtaacaataatccgtttgtggtcaaaggcagtgcgcaattgattttgaacgaggtacgcggtacggctagcaaactcaacggcatcgttaccgtaggcggtcaaaaggccgacgtgattattgccaaccccaacggcattaccgttaatggcggcggctttaaaaatgtcggtcggggcatcttaactaccggtgcgccccaaatcggcaaagacggtgcactgacaggatttgatgtgcgtcaaggcacattgaccgtaggagcagcaggttggaatgataaaggcggagccgactacaccggggtacttgctcgtgcagttgctttgcaggggaaattacagggtaaaaacctggcggtttctaccggtcctcagaaagtagattacgccagcggcgaaatcagtgcaggtacggcagcgggtcgcactgggcggtatgtacgccgacagcatcacactgattgccaatgaaaaaggcgtaggcgtcaaaaatgccggcacactcgaagcggccaagcaattgattgtgacttcgtcaggccgcattgaaaacagcggccgcatcgccaccactgccgacggcaccgaagcttcaccgacttatctctccatcgaaaccaccgaaaaaggagcggcaggcacatttatctccaatggtggtcggatcgagagcaaaggcttattggttattgagacgggagaagatatcagcttgcgtaacggagccgtggtgcagaataacggcagtcgcccagctaccacggtattaaatgctggtcataatttggtgattgagagcaaaactaatgtgaacaatgccaaaggcccggctactctgtcggccgacggccgtaccgtcatcaaggaggccagtattcagactggcactaccgtatacagttccagcaaaggcaacgccgaattaggcaataacacacgcattaccggggcagatgttaccgtattatccaacggcaccatcagcagttccgccgtaatagatgccaaagacaccgcacacatcgaagcaggcaaaccgctttctttggaagcttcaacagttacctccgatatccgcttaaacggaggcagtatcaagggcggcaagcagcttgctttactggcagacgataacattactgccaaaactaccaatctgaatactcccggcaatctgtatgttcatacaggtaaagatctgaatttgaatgttgataaagatttgtctgccgccagcatccatttgaaatcggataacgctgcccatattaccggcaccagtaaaaccctcactgcctcaaaagacatgggtgtggaggcaggctcgctgaatgttaccaataccaatctgcgtaccaactcgggtaatctgcacattcaggcagccaaaggcaatattcagcttcgcaataccaagctgaacgcagccaaggctctcgaaaccaccgcattgcagggcaatatcgtttcagacggccttcatgctgtttctgcagacggtcatgtatccttattggccaacggtaatgccgactttaccggtcacaataccctgacagccaaggccgatgtcaatgcaggatcggttggtaaaggccgtctgaaagcagacaataccaatatcacttcatcttcaggagatattacgttggttgccggcaacggtattcagcttggtgacggaaaacaacgcaattcaatcaacggaaaacacatcagcatcaaaaacaacggtggtaatgccgacttaaaaaaccttaacgtccatgccaaaagcggggcattgaacattcattccgaccgggcattgagcatagaaaataccaagctggagtctacccataatacgcatcttaatgcacaacacgagcgggtaacgctcaaccaagtagatgcctacgcacaccgtcatctaagcattaccggcagccagatttggcaaaacgacaaactgccttctgccaacaagctggtggctaacggtgtattggcactcaatgcgcgctattcccaaattgccgacaacaccacgctgagagcgggtgcaatcaaccttactgccggtaccgccctagtcaagcgcggcaacatcaattggagtaccgtttcgaccaaaactttggaagataatgccgaattaaaaccattggccggacggctgaatattgaagcaggtagcggcacattaaccatcgaacctgccaaccgcatcagtgcgcataccgacctgagcatcaaaacaggcggaaaattgctgttgtctgcaaaaggaggaaatgcaggtgcgcctagtgctcaagtttcctcattggaagcaaaaggcaatatccgtctggttacaggagaaacagatttaagaggttctaaaattacagccggtaaaaacttggttgtcgccaccaccaaaggcaagttgaatatcgaagccgtaaacaactcattcagcaattattttcctacacaaaaagcggctgaactcaaccaaaaatccaaagaattggaacagcagattgcgcagttgaaaaaaagctcgcctaaaagcaagctgattccaaccctgcaagaagaacgcgaccgtctcgctttctatattcaagccatcaacaaggaagttaaaggtaaaaaacccaaaggcaaagaatacctgcaagccaagctttctgcacaaaatattgacttgatttccgcacaaggcatcgaaatcagcggttccgatattaccgcttccaaaaaactgaaccttcacgccgcaggcgtattgccaaaggcagcagattcagaggcggctgctattctgattgacggcataaccgaccaatatgaaattggcaagcccacctacaagagtcactacgacaaagctgctctgaacaagccttcacgtttgaccggacgtacaggggtaagtattcatgcagctgcggcactcgatgatgcacgtattattatcggtgcatccgaaatcaaagctccctcaggcagcatagacatcaaagcccatagtgatattgtactggaggctggacaaaacgatgcctataccttcttaaaaaccaaaggtaaaagcggcaaaatcatcagaaaaaccaagtttaccagcacccgcgaccacctgattatgccagcccccgtcgagctgaccgccaacggcataacgcttcaggcaggcggcaacatcgaagctaataccacccgcttcaatgcccctgcaggtaaagttaccctggttgcgggtgaagagctgcaactgctggcagaagaaggcatccacaagcacgagttggatgtccaaaaaagccgccgctttatcggcatcaaggtaggcaagagcaattacagtaaaaacgaactgaacgaaaccaaattgcctgtccgcgtcgtcgcccaaactgcagccacccgttcaggctgggataccgtgctcgaaggtaccgaattcaaaaccacgctggccggtgcggacattcaggcaggtgtaggcgaaaaagcccgtgccgatgcgaaaattatcctcaaaggcattgtgaaccgtatccagtcggaagaaaaattagaaaccaactcaaccgtatggcagaaacaggccggacgcggcagcactatcgaaacgctgaaactgcccagcttcgaaagccctactccgcccaaactgaccgcccccggtggctatatcgtcgacattccgaaaggcaatttgaaaaccgaaatcgaaaagctggccaaacagcccgagtatgcctatctgaaacagctccaagtagcgaaaaacgtcaactggaaccaggtgcaactggcttacgataaatgggactataagcaggaaggcttaaccagagccggtgcagcgattgttaccataatcgtaaccgcactgacttatggatacggcgcaaccgcagcgggcggtgtagccgcttcaggaagtagtacagccgcagctgccggaacagccgccacaacgacagcagcagctactaccgtttctacagcgactgccatgcaaaccgctgctttagcctccttgtatagccaagcagctgtatccatcatcaataataaaggtgatgtcggcaaagcgttgaaagatctcggcaccagtgatacggtcaagcagattgtcacttctgccctgacggcgggtgcattaaatcagatgggcgcagatattgcccaattgaacagcaaggtaagaaccgaactgttcagcagtacgggcaatcaaactattgccaaccttggaggcagactggctaccaatctcagtaatgcaggtatctcagctggtatcaataccgccgtcaacggcggcagcctgaaagacaacttaggcaatgccgcattaggagcattggttaatagcttccaaggagaagccgccagcaaaatcaaaacaaccttcagcgacgattatgttgccaaacagttcgcccacgctttggctgggtgtgttagcggattggtacaaggaaaatgtaaagacggggcaattggcgcagcagttggggaaatcgtagccgactccatgcttggcggcagaaaccctgctacactcagcgatgcggaaaagcataaggttatcagttactcgaagattattgccggcagcgtggcggcactcaacggcggcgatgtgaatactgcggcgaatgcggctgaggtggcggtagtgaataatgctttgaattttgacagtacccctaccaatgcgaaaaagcatcaaccgcagaagcccgacaaaaccgcactggaaaaaattatccaaggtattatgcctgcacatgcagcaggtgcgatgactaatccgcaggataaggatgctgccatttggataagcaatatccgtaatggcatcacaggcccgattgtgattaccagctatggggtttatgctgcaggttggacagctccgctgatcggtacagcgggtaaattagctatcagcacctgcatggctaatccttctggttgtactgtcatggtcactcaggctgccgaagcgggcgcgggaatcgccacgggtgcggtaacggtaggcaacgcttgggaagcgcctgtgggggcgttgtcgaaagcgaaggcggccaagcaggctataccaacccagacagttaaagaacttgatggcttactacaagaatcaaaaaatataggtgctgtaaatacacgaattaatatagcgaatagtactactcgatatacaccaatgagacaaacgggacaaccggtatctgctggctttgagcatgttcttgaggggcacttccataggcctattgcgaataaccgttcagtttttaccatctccccaaatgaattgaaggttatacttcaaagtaataaagtagtttcttctcccgtatcgatgactcctgatggccaatatatgcggactgtcgatgtaggaaaagttattggtactacttctattaaagaaggtggacaacccacaactacaattaaagtatttacagataagtcaggaaatttgattactacatacccagtaaaaggaaactaactaaatatgagtaactttgaaaaaaaatatattttagaattaaatgatgctttaagccatttaaatcataactctacctcatttgatttattgaaagttttgatttcatggttatcaaacgatattgtcattgataaatttaaaattttaggttatgactttagtaaatatatcgaaatgaatcccgatgactatccggttgaaaaatctatattgaatagagaggaaattatttatctcaaaaacaatatttatcgtaaaatatcatcaggaaattttaaatttcaatactttgtacaatatattagagatattttagaatatttatttattgaacatattgaaagagtctgtccttactgcgaatggggtgaaatgcaaaaattagaagaacaaaatacgcatgaaacggtgtatctctgtactcaatgtggatgtgctttttataacgataattcacaatttttattaaaaacccctttaaccattccaatgaaacgtgatgaatttaaataaacaagccgtagcctgcatgaaccctaaaatccacgtgtagcgtgtgtgcgccagcacgcatgcgttccatgatttacggctcaatgccgtctgaaaagctcacaatttttcagacggcatttgttatgcaagtaaatattcagattccctgtatgctgtacagacgcgggagtgttaagccccccttgtttgaagctccgcggctcctgccgagcttcaccgaccccgttgtgcccaagctctctgctcccggcggctacattgtcgacatccccaaaggcaatctgaaaaccgaaatcgaaaagctggccaaacagcccgagtatgcctatctgaaacagctccaagtagcgaaaaacgtcaactggaaccaggtgcaactggcttacgataaatgggactataagcaggaaggcttaaccagagccggtgcagcgattatcgcgctggctgttaccgtggttactgcgggcgcgggagtcggagccgcactaggcttaaacggcgcagccgcagcagcggccgatgccgcctttgcctcactcgcttctcaggcttccgtatcgctcatcaacaataaaggcgatgtcggcaaaaccctgaaggaactgggcagaagccgcacggtaaaaaatctggttgtagcggcggcaacggcaggcgtatccaacaaactcggtgcctcttcccttgccacttggagcgaaaccccttgggtaaacaacctcaacgttaacctggccaatgcgggcagtgccgcgctgatcaacaccgctgttaacggcggcagcctgaaagacaatctggaggcaaatatcctggcggcattggtgaataccgcgcatggggaggcggcgagtaagatcaaaggactggatcagcactatgtcgcccacaaaatcgctcatgccgtagcgggctgtgcggctgcagcggcgaataagggcaaatgtcaggacggcgcgatcggtgcggctgtgggtgagattgtcggggaggctttggttaaaaataccgattttagcgatatgaccccggaacaattagatctggaagttaagaaaattaccgcctatgccaaacttgcggcaggtacagttgcaggcgtaacgggaggagatgtcaatactgctgcacaaaccgcacaaaacgcggtagaaaataatgcggttaaagctgttgtaactgctgcaaaagtggtttataaggtagccagaaaaggattaaaaaacgggaaaatcaacgttagagatttaaaacagacgttgaaagacgaaggttataatttagccgacaacctgaccaccttattcgacgaaacattggattggaacgatgccaaagccgttattgatattgtcgtcggaacagagctgaatcgcgctaataaaggggaagcggcacaaaaggtcaaggaagttttagaaaaaaatcgtccttatatccctaataaaggtgctgtaccgaatatgagtacatacatgaaaaataatccttttggaaaacagctggctcaaatttcagaaaagacaacgcttccgacgcagcaagggcagtctgtcttcttggtaaaaagaaaccaagggttattaaaaaccggtgataggttttatttagatggccaacataaaaatcatttagaggtttttgataaaaatgggaactttaagtttgttctaaatatggatggttcgcttaaccaaatgaaaactggggcagcaaaaggtcgtaaattaaacttaaaataggaaattttatggaaacattgaatgatataaaaaaaatcttgattaatgtggggctttatcaagggtttgatttgacagatccaaaagtatcagaagaagttaatcatgaaacagctaatatgaaatggattaaagattatacttcagacgggaattgggataatgaatttaaggaggatttaaaaaactttttagattatatggaagtatgccaattagccctaaacgataaaaatttcaaaattgccagtaattctttatttatggctatgatttacgcaggtaatctatctcttatatttgattcaataaaaactgatatatcaacattattgagtgctgagtataaaaagaatagtttttcatggccatctcttgatgaatagaaagcaagttgtagcctgcatgaaatctaaaacccatgcataaggtgtgggcttcagtatacgcgttccatgatttacggccatatgccgtctgaaaagctcaattttttcagacggcatttgttatgaaagtaaatatttagattccctgtatactgtttagactcgtgtgtgctgagtaagctgtagtctgcatgaaacctaaaactcgctcaaaattaagctaagacattagcagggcaagggcgaaaattgaatcttaaataaggtgattcagatgaaaaattttaatgtagtaaaagaaagtttaagagagttaggaattaaacaaggatttgatctttatgagaaagccacaactgaaaaattgaatagtgaagatcctcttgacttacaatggctttctaactattcatctgattggaatgatgaattagaagaagactttgattctttttttcagcatatgaaggaatatcaatatgctattgacaatgaagacattaaatctgcatgtagttcactatgtgaagctatgctctatgttggtaatattaaaaatttttttgagtttctcaaaagcgatatgattagactgttgagaggtgaaagtaaaacaacagactttcaatggccgcaatttgatgaatagcagcaagctgtagcctgcatgaaacctaaaatccatgcgtaaggtgtgtgcttcagcacgcacgcgttccatgatttacggctcaatgccgtctgaaaagctcacaatttttcagacggcatttgttatgcaagtaaatattcagattccctatatactgcccagatgcgtgcgtgctgaagacaccccctacgcttgctatttgaaacagctccaagtcaccaaagacgtcaactggaaccaggtacaactggcgtacgacaaatgggactataaacaggaaggcttaaccggagccggagcagcgattattgcgctggctgttaccgtggttactgcgggcgcgggagccggagccgcactgggcttaaacggcgcggccgcagcggcaaccgatgccgcattcgcctcgctggccagccaggcttccgtatcgctcatcaacaacaaaggcaatatcggtaacaccctgaaagagctgggcagaagcagcacggtgaaaaatctgatggttgccgtcgctaccgcaggcgtagccgacaaaatcggtgcttcggcactgaacaatgtcagcgataagcagtggatcaacaacctgaccgtcaacctggccaatgcgggcagtgccgcactgattaataccgctgtcaacggcggcagcctgaaagacaatctggaagcgaatatccttgcggctttggtgaatactgcgcatggagaagcagccagtaaaatcaaacagttggatcagcactacattacccacaagattgcccatgccatagcgggctgtgcggctgcggcggcgaataagggcaagtgtcaggatggtgcgataggtgcggctgtgggcgagatagtcggggaggctttgacaaacggcaaaaatcctgacactttgacagctaaagaacgcgaacagattttggcatacagcaaactggttgccggtacggtaagcggtgtggtcggcggcgatgtaaatgcggcggcgaatgcggctgaggtagcggtgaaaaataatcagcttagcgacaaagagggtagagaatttgataacgaaatgactgcatgcgccaaacagaataatcctcaactgtgcagaaaaaatactgtaaaaaagtatcaaaatgttgctgataaaagacttgctgcttcgattgcaatatgtacggatatatcccgtagtactgaatgtagaacaatcagaaaacaacatttgatcgatagtagaagccttcattcatcttgggaagcaggtctaattggtaaagatgatgaatggtataaattattcagcaaatcttacacccaagcagatttggctttacagtcttatcatttgaatactgctgctaaatcttggcttcaatcgggcaatacaaagcctttatccgaatggatgtccgaccaaggttatacacttatttcaggagttaatcctagattcattccaataccaagagggtttgtaaaacaaaatacacctattactaatgtcaaatacccggaaggcatcagtttcgatacaaacctaaaaagacatctggcaaatgctgatggttttagtcaaaaacagggcattaaaggagcccataaccgcaccaattttatggcagaactaaattcacgaggaggacgcgtaaaatctgaaacccaaactgatattgaaggcattacccgaattaaatatgagattcctacactagacaggacaggtaaacctgatggtggatttaaggaaatttcaagtataaaaactgtttataatcctaaaaaattttctgatgataaaatacttcaaatggctcaaaatgctgcttcacaaggatattcaaaagcctctaaaattgctcaaaatgaaagaactaaatcaatatcggaaagaaaaaatgtcattcaattctcagaaacctttgacggaatcaaatttagatcatattttgatgtaaatacaggaagaattacaaacattcacccagaataatttaaaggaaaaattatgaaaaataatatttttctaaacttaaataaaaaatctataaataacaaccattttgttatttcgattttttttgaaacaatttaccaatttgaaactaaagatacgcttttagagtgttttaaaaatattacaactaccggacattttggagtaataggtgctcaatatgaaaaaatagatgctaccagatggattggagattatgaagaggtaaatggatttgagtatattgataaagctccttctatttatttttcagttggagatgatttcaatcctgaagaattaattatacctattaatttagcatatcattactttaatattgcaatatctgatttcttaatagctcaccctgaatatcaaaaaaagtgtaaagaaatacaaaaaacatattctcaaacaaactgtagcctgcatgaaacctaaaatccatgcgtaaggtgtgtgcttcagcacgcacgcgttccatgatttacggctcaatgccgtctgaaaagctcacaatttttcagacggcatttgttatgcaagtaaatattcagattccctatatactgcccagacgcgtgcgtgctgaagacaccccctacgcttgctgcagaactttcgggtaaaaccggtgtgagcattagcgcaccgtatgccaatgagaacagtcgcatcctgctcagcaccacggatatcagttcggaaaacggcaaaatcaaaattcaatcttacggtgaccaatattactatgcgagacagagcgaactctatacctttgaacgccgcagctacaaaactggcaaatggtacaaccgcaaacacattaccgaagtcaaagaacacaaaaacgccaagcccgacgcagtaaccctcagcgcatcccaaggcatcgacatcaaatctggtggcagcatcgacgcctacgccaccgcattcgatgcccccaaaggcagcattaacatcgaagccgggcggaaattgacactctatgccgtagaagagctcaactacgacaaacttgacagccaaaaaaggcgcagatttctcggcatcagctacagcaaagcacacgacaccaccacccaagtcatgaaaaccgcgctgccctcaagggtagttgcagaatctgccaatctgcaatcaggttgggataccaaactgcaaggcacacagtttgaaaccacactgggtggcgcaaccatacgcgcaggcgtaggcgagcaggcacgggccgatgccaagattatcctcgaagggatcaaaagcagcatccacacagaaaccgtgagcagcagcaaatctactctatggcaaaaacaggcaggacggggcagtaacatcgaaaccttgcaattgccgagtttcaccggtcccgttgcgcccgtactgtccgcacccggcggttacattgtcgatattccgaaaggcaatctgaaaacccaaatcgaaaccctcaccaagcagcccgagtatgcttatttgaaacaacttcaagttgcgaaaaacatcaactggaatcaggtgcagcttgcttacgataaatgggactacaaacaggagggcatgacacccgcagcagcagctgtcgtcgttatcgtcgtaaccgtattgacctacggcgcactgtccgccccggcagccgccggaacggcgggcgcggcaggcgcaggagcgggaggagccgcagcaggaacggcagccggaactggagtagcagcaggaacggcagccacaaccggagtagcagcaggcacatcagctgcagctatcaccacagccgcaggcaaagccgcactggccagtctcgccagccaagccgcagtttccctcatcaacaacaaaggagacataaaccataccctgaaagaactgggcaaaagcagcaccgtcagacaggccgccaccgccgccgtaaccgcaggcgtactgcagggcataagcgggctgaacacccaagcagccgaagccgtcagcaaacattttcacagtcccgcagcaggcaaactgaccgctaacctgatcaacagcaccgctgccgcaagtgtccataccgccatcaacggcggcagcctgaaagacaacttgggcgatgccgcactgggtgcgatagtcagtaccgtacacggagaagtagcgagcaaaatcaaatttaatctcagcgaagactacattgcccacaagatagcccatgccgtagcaggctgtgcatcggcggtagcaaataaaggcaaatgtcgggacggcgcaatcggcgcggcagtcggcgagatggtgggagaaaccctgttggacggacgcgatgtaggcaaactgtcaccccaagaacgccaaaaagtcatagcctactcgcagattatcgcaggcagcgcagtggcattggttaaaggggatgtgaatacggcggcgaatgcggctactgtggcagtggagaataatagtcttttagctcgcaggagggtaaatatacgttggacttcgcgacaagaattggaacatgaatatgccattcttgaaatccaggccattaccaatcaaatccgaaggctggatccgaaatttaacgggattgctattatgaggaatcctagagagccgtggacaagacatgatgtacaaacatacaggcaatattataatcaattaagggaatccagaggctttgctgttgacccaatttatagaatcaggataaacaacggcaatgaatttaaccgtatcatgtcatcaaaatacccttataatgagctttatgtagccaatcctaaatcggcgacggggtattttagggtagattcgtataatcctgcgacagaggaaattatttcaagaaaatttacccaattttctcaaatccaagaaagtacggggattggttatatcaaggaggctgttagaaaatatagccctggtgctgtcatttccaatgttccaagtacacctactacgataagaggaagaaagcttgaaggaaaacttattttagaagttcctgctcaggtcaatccaattccacaatctgtattaagggcggcacaagaagaaaatgttatcattagagatacaacaggaaggatttacaaatgaagaaagatattttttattgtgagcagtggtcttatggttataagaaacttcataagcctttttctgagaaacaagctgaggaaaaacatcttaaaggggagttatatactgccgtaataggttcggcgacacaacctgaatatgtaattaccttgcgagaggaagtaggttttttttcggtacattttttcgataaatttggaagggattatttaacccatcaatttcaaaaatattccaattcgaattattattttctttctatggctgtatggagagattatataactttggaatctcatgacttagcagaaggatatacttatttcttcaatgaaaatacggatgattgctatgttttgaaagaggattttattaataatgagcgatatgaaaaaacagaattatattcccaaaaagataaggtaattctatttccaaagtttggcgaatatgatttggtgttaaatccggacattatttaattgagttttaaggccgtctgaaaaaatttcagacggcttttattattgggtttggaatctgaggataaagctgataaaaaccaggaaattatcaggttgctatatacgtattgttgtacagactaaaggcagcaatcaaatcactactgcttacccacaaaaataaatcgattatatggagtaatcatgaataagagaatgaaaatgtgtcctgcttgtcaacaaggctatctctaccattcgaaacctaaatatcttcatgatgaaattattctgtgtgatgaatgcgatgcagtatggctcaaaggtatgaatatattttatggagaatatgaaaaagatttttattcttatgttcctttcatggaatcccaaggtataacgagtgaatgtatttgggaaggagatttgtttgatcatccatattatgaagatgaaaactcaaatgatatggattgatggaaattttaagcctgcgtaggtacgattagccatcaaacggcgtaatcatacgcaagattatcaacagagagggctggcagcgatataccacccacaagattgcccatgccatagcgggctgtgcggcagcggcggcgaataagggcaagtgtcaggacggcgcgattggtgcggtcgtgggggagattgtcggggaggctttggttaagaataccgatttcagcggtatgactgcttctgaaattgaaaaagctaaagcgaatattactgcgtatgcaaaattggtagccggagcgactgtaggtgttacaggaggcaatgttgatgtggcggcaaatgcttccgaaacagctgttaaaaataatgcattagatattatttgggatattggcaacctcgtatgggacggcggtaaatggatttacgccaaatctattggcgataagcagatggctcgagaagcggcgattgattttggtgtggatgccgccgcagctgccgttccctttgttccggcaggtgcgactaaaatcagccgaggcggggcttatgttctgaaggcgggagacgaagcagttgatacggctaaagccatacaggaaattcagaagcagaccggaatcaagcttacttatgataaggttaataaggtttggacaacaccggcggggttagattatgggttagatgctaagcatggtaataggattaaacatgttttagcccatacaattccaaatccaaacaaacctgttcattctgtttttaatgtgtcccgtaaagaagttttgcctttggttgatgaagcttggagaatgaaaggaaatcctttgccaaatgattcatccgtatatcttgtagatatgaagaaacctattggaacaaaaggagaaacaaaagtgcggattgttgtgcaaaaaggaacaaataaaatcatttctgcatatcctcagaaataattaagaaaggaatctcttatggataaagaaattaaaatttgcccaagatgtgagcaaggctacctttatcatgcaaagcctaaatatttctctggggaggtcattttatgcgatgaatgttatgctatgtggcttggggatatgaaaattttttacggacaatatggaaaagatttttatgattatcatgagtttatgaaagataaaggcatagaagaaataaatatgtgggaaggagagctttttgatcacccatattatgaggatgaaaaatttaaataattgattttctgttccccgaatttgggaaatacgatgatattttaaacccaaatattatttaaagtagcaataggccgtctgaatatccgtttttcagacggcctcaatgcaactgctggcagccgaaggcattcaccaacaccaattgaatgttcagaaaagtacccgtttcatcggcatcaaagtgggtaaaagcaattacagcaaaaacgagctgaacgaaaccaaactgcccgtacgcgttatcgcccaaacagccaaaacccgttccggctgggataccgtactcgaaggcaccgaattcaaaaccaccctttccggagccgacatacaggcaggggtgggtgaaaaagcccgagccgatgcgaaaattatcctaaaaggcatcgttaaccgcatccaaaccgaagaaaagctggaatccaactcgaccgtatggcaaaagcaggccggaagcggcagcacggttgaaacgctgaagctaccgagctttgaagggccggcactgcctaagctgaccgctcccggcggctatatcgccgacatccccaaaggcaacctcaaaaccgaaatcgaaaagctggccaaacagcccgaatatgcctatctgaaacagcttcagacggtcaaggacgtgaactggaaccaagtacagctcgcttacgacaaatgggactataaacaggaaggcctaaccggagccggagccgcaattatcgcactggccgttaccgtggtcacctcaggcgcaggaaccggagccgtattgggattaaacggtgcggccgccgccgcaaccgatgcagcatttgcctctttggccagccaggcttccgtatcgttcatcaacaacaaaggcaatatcggtaacaccctgaaagagctgggcagaagcagcacggtgaaaaatctgatggttgccgtcgctaccgcaggcgtagccgacaaaatcggtgcttcggcactgaacaatgtcagcgataagcagtggatcaacaacctgaccgtcaacctggccaatgcgggcagtgccgcactgattaataccgctgtcaacggcggcagcctgaaagacaatctggaagcgaatatccttgcggctttggtgaatactgcgcatggagaggcagcaagtaaaatcaaacagttggatcagcactacattgcccataagattgcccatgccatagcgggctgtgcggcagcggcggcgaataagggcaagtgtcaagatggtgcgatcggtgcggcggtcggtgaaatccttggcgaaaccctactggacggcagagaccctggcagcctgaatgtgaaggacagggcaaaaatcattgctaaggcgaagctggcagcaggggcggttgcggcgttgagtaagggggatgtgagtacggcggcgaatgcggctgctgtggcggtagagaataattctttaaatgatatacaggatcgtttgttgagtggaaattatgctttatgtatgagtgcaggaggagcagaaagcttttgtgagtcttatcgaccactgggcttgccacactttgtaagtgtttcaggagaaatgaaattacctaataaattcgggaatcgtatggttaatggaaaattaattattaacactagaaatggcaatgtatatttctctgtaggtaaaatatggagtactgtaaaatcaacaaaatcaaatataagtggggtatctgtcggttgggttttaaatgtttcccctaatgattatttaaaagaagcatctatgaatgatttcagaaatagtaatcaaaataaagcctatgcagaaatgatttcccagactttggtaggtgagagtgttggtggtagtctttgtctgacaagagcctgcttttcggtaagttcaacaatatctaaatctaaatctccttttaaagattcaaaaattattggggaaatcggtttgggaagtggtgttgctgcaggagtagaaaaaacaatatacataggtaacataaaagatattgataaatttattagtgcaaacataaaaaaataggagttagtatgaaatatatgattagttttctaaaaaaaacatttgaattaatgagttgggtgttagtcatactaataattgggacattttatgactattatcaaataaggcaatatgctgaattagaaaagaaatctatatcaaatatcttgctatatgcccaaaaagaaaaatttcgcttagagagtaaagataaatacatgcgaggaggatatacaaaatataaatttattttttcagaatatagtaatactacttttttaaatttcataaatgacctgaaaaaagataattatttaccacttgacggctatggacatggttttctatgtagaaaaggagagtctatatcaatcaatatataccctgaaattaataaatttattttagtatggggataccctgaaaatctttgcgctgattctaattaagtaagcaagaataggttatagggaaataaaattcaaatgagaaaattgaataatcacgatgttcataaacggtatcaagatcgtttagaagaggatgtagagttcactatcaactatgagcttcctttgagttgtttgtggtcaaccatcaaagacttttccagcgattttgaggaaaaaactgaagcgttctttattcttttcaaagagctgctgcgcagaggtcatctgaaactgcaacgcgacgggcaaattatcgggcatacgcccgaagaatgggaacaaatatttagggaagtatggcctgaatatgaaatcgaacccaatccacttcccggctatgccccatttgatattggaatgtggcttacggtcgaggctcctgcctacgccgtatggatagatcccgaagacggtagcgaatactgggcgggataaaataccaatgtttggaataaatcccgtctgaaaaacagctttttcagacaggatttattccaattatcggtgatatacagagttttgtacaagcacagaccgctgccgatcacctgtttgctttgctgggtgtggttccgggtatcggtgaatcgatacaggcctataaagtagcgaaagcggcaaaaaatttacaaggcatgaaaaaagccttggacaaggcagcaaccgttgccactgcacagggctatgtcagtaaaaccaaaatcaaaatcggtcaaactgaattaagggttactgcagcaactgacaaacaattgctgaaagctattggcgaaggaaggacacgacaggtaaaatgaccgagcagttatttgactctttagctaaacaaaatggcttcagagtgctttcgggcggcaaatacggcggaaataacggttttgatcatgtatggcaggctgccgatggtagtgttgttttgattgtagaaagtaagcagattaggaacggtacggtacagctgaatccgaatggtgcgggtggatatacgcagatgagtcgtgaatggattaaacaagttgtaaaaagtttacctgatggtagtcctgctaaggcagttgtcttaaaagcaaatcagaacggcaaattaaaaacggcaatagcaggcgttgatcgtcaaacaggtaaggccgttattctttctgtcaaagttccttctaaaaccaatataaggagataacaatggggcacaatatgatgaccacccaaaaatggtatgaacatattactaatgtaatcataggcaatactgctaatttcaatagcggttgccccgaatctatagattatgtagatgaaaaaaaaggcgtgccgcttgcagcgatgaaatacattttaatgtacactgaagctgcggcttcccatgcctatctatttgaacatgatcttaagaaattcaagcaatatgcttatgttgcaggaaagttgggtattttgcagagtgtagatgatgaagaccccgaacccttcttctttccctgcgacatgctcaacattcaagatccgatgtttctgatgctgatgagcgacagcccgcagctgcgcgagtttttggtgcgcaatatcgacaacatcgccaacgatacagaagccttcgtaaaccgatacgacctcaaccgtcatatgatttacaatactctgctgatggtggagggtaagcagcttgatcggttgaaacaacgtagcgagaaagtcttggcgcatcccacccctagcaaatggctgcaaaagcggttgtacgattaccgcttcttcctcgctttcgccgaacaggatgccgaggcgatgaaggccgccttagagccgctttttgataaaaaaaccgcgcgtatggctgccaaagaaacattgtcctatttcgatttctacctgcagccgcaaatcgttacctacgccaaaatcgcatccatgcacggtttcgatttgggcatagaccacgaaatcgcgccgagggatttgactgtttacgatccgctgccggcagacgaatatcaagacatcttcgattttatgaaacagtatgacttgtcttatccgtatgaatatctgcaggattggatagattactatacgttcaaaaccgataagctggtatttggtaacgcgaagcgagagtgagccgtaaaactctgagctcctgttttatagattacaactttaggccgtcttaaagctgaaagattttcgaaagctataaattgaagcccttccatagtacatagatctgtgttgtggcgaggctttaccacgctgattgccggagaagaactcaacctgctggcaaaacaaggcatgagatctttgcaataacatgagttgagacctttgcaaaaaagcccttccccgacatccgaaacccaaacacaggatttcggctgttttcgtaccaaatacctcctaattttacccaaatatccccttaatcctccccggatacccgataatcaggcatccgggctgccttttaggcggcgcgggcgcacttagcctgttggcggccttcaacaggttgagacctttgcaataacataggttactaaaattttatgctcaatctcattttcaaaatgcaaaacttttctgatttttcctactttttgctcaatattaggaaggttttaggcaattgaaaattttttggcgcatttttatgcgtcaaatttcgttaacagactatttttgcaaaggtctcaggttcaaacacatcgccttcaggtggtttgcgtactcactttgtcatttccaatgttccaagtacacctgctccgctaagaggaagaaaacttacaggaaaacttattttagaagttcctgctcaggtcaatccaattccacaatctgtattaagggcggcacgagaagaaaatgttatcattagagatacaacaggaaggatttacaataggtggtggtttagtattaggtggttgtgcaggtgcacatcttgcaagaaaagaaccattgatactaacagggaaaacaggggcaggtgcgtcagcaattgcaaatgcaagcattggatatcaatggactgtcaatttgtcaaagccaaaagaaggagctaaataataatgcattcccactatatatttggtattttgatgatttcatatgttttcgcaatgttatttaattttataatatcatataaaatatttaaagaagaaaaattaattaatggtttttttgattttctaattaaatcaagctaccttaactttaaatatttcaatatattatttggaaaataaaaaatctcaaatattttttatttgaaattattaagaattaatctggcgttgggggtttttatcttatccttaataattataaatattttttgtttttagtaaaaatatggtacagatatgtacagctagctttgtttcagtaaggtataactgtatataatactcagatttttcacgttgggctatacatggaaatatatctgtgattaaagatgttaatggtaagtatcgattagcacctgaaaagcatgattttaaaatgcattcctttggggggagaaaaaagtaatgtaaaaacaatatttagaaatatggaaactataattggtagcccagggtaaggggtacctttcaggattgaatttaaaggagaggtaaatattgttaactaagttgaaaattttgctatttttgttcttatttgtttttgtattggctattaatttgcttttcttcttttttagttcggatatcgagagtttcgggaactatcagtttgaatatgtttacgataaaggttggcctgctaattatattttagtcatgaaagatggaaatgaagggaattttgataaaataatatccggattggttttagaatattataaggaggatgataacatttatttttcttatattgacgggcaaggatttgcttcagactcttgctattacaaaccggaaattttatatggaaaaattattttaaataaaaatcatatcattaatattaatagcatggaaaaaaataattttctttcagaagataaaataatgaagggaacaagaaattggctagcagaccctaaaaataaatgtaatatacagactctagactaaacgcgtcttgcgaaaatacaacggaatcgatcgtaaatctttcccgctgttcttgaaagaatgcgaatttcgatttaacttcggcacaccgtctcaacagcttaaaatcctgcgggattggtgtgggatttagggctaatctagtacagccccttgttttttcgatacggaaccggatagaggaaaaatcgaacattgcgcctgccttgctatgattcacgaagaaatctccgccatgcctatgggctatgaaaccttgatcggcgatatgggcagcgcactgtcaggcggacaaaaacaacgcatcgtattggcgcgggccttaatattgcgaaccgaaaatcctatttttagatgcagcgaccagccatttggatattgccaatgaaaaagcagtcaatgcaaacttgaatggcttgtctatcataaaaattatggcggcacacagaaaggaaacggtggaatcagcagataggaaaatgtctttaggataaaaatacagtttcaaaaatactcaagactactgccgttttttcgcctgagcgtcaaactctgccagcgtcatgttcaaagtctgcaaacacggtgtcattaccgcatcgacagcttggttcacatgatccctttccacaggcaacggacggtaaacgaagagcttgaagagttcgttcaactcaatcgaatccgcccccgttttcaacacccaaccctgtctgccggaatagatgtagccgtgccgcgccagcttttccaaaagctcgcccaactcgtcgtagcccatattgatatgccgtctgaactcctgaacaggcaaggctttgccttctttttgcgccgcatccagaagcagcaggattttcaacacgtcgtcaaaccgtccgcgcgagtcgaagcccctgcggaacgcttctccctgccagtaggagagtgaagaagtcagcaccgcgccgcccaagaccagcgtccacaacaggttcagccacaacagaaaaaacggcacggcggcaaacgcgccgtaaatcgagcggtagccgtcgaaattgcccatataccaagtgaagagggagcgcgcggtttccagacaaaacgctgttgccaaagccccgacaaacgcctgccgcgcgggaacgaagcggtttggcacgaagcggtacagcccccacagcaaaagcgtcatgaaggtcagcgtcgccgccgttcgcaacgcgcccgaccactgcggcgcacctgaggcaagcgcggcatcctgtaccgagccgaccataaaggaaatgcccacgcccaaagacagcggcccgaacgtcagtaaagcccaatagacgagaaactgcatcatccacggacgctgggaattgacccgccagatgcggttgaacgtattgtctatcgtccgaatcagcatcagcgaggtaacgaccagcatcacgctgccgattgccgtcagccggttcgcctgctcgcggaacgcattgatatagtcgaacaccatgtccgcgccctgcggcacaatggtttggttgacgaaggagacgaacgaatccgaccagcggtcgaacacggggaaaatcgaagcgaccgccaccatcacggtcagcacggggacgagtgccagcagcgtcgtaaacgtcatgcttgccgccgcctgcggtacgcgttcttcatcaaagcggcggacgacgaaccatgcaaacgcacagattttattgtctgccaaaccttgcaaacgttgtaaaaaggtcataatttcttgcccggtcagtaagttgggcattgatgcccgatgttatagccaattttgccgtcaggaacaaatgcctgaactgcggctgtttcagacggcatcggaacaactgttatgccgtctgaagaccgaaccattttaacggaatccgcccatgaacccaaatccccctcaaaatcctcgtcctctactatttccaaaacggcagcacccgcaatcccgcactccgaatcgctcgcggcatcgacagcgttgaaggttgcgaagccgtattgcgcaccgtccccaaagtctccgccgtctgcgaagccgtcaaaaaagatattcccgacagcggctcccgtcctgaccgccgaagaaaacaatatcgccttcgcacaaagcaaacgcttggcggaactcgccgtcaagtcggcataagccgcgtgttcagacggcatggcgttcagatgccgtctgaacacgtttgcctgtataatccgcatctttactgtccaacttcgcggttcgcaaacctcccgcgttaccaaaactaggattcgatatgtcaaaccaacaagccttggtcatcttttcgggcggtcaggattcgaccacctgcctgattcaggcaatccaaacctacgggcgcgaaaacgtccaagccattactttccaatacgggcaacgccatgccgtcgagctggaacgtgcccgctggattgcgcaggatttgggcgtcaaacaaaccgtactcgacttgagcctgatgcggcagattacgcacaatgccctgatggacgacaccgccgccatcgaaactgccgaaaacggcgttccgaatacctttgtagacggccgcaacgcgcttttcctgctctatgccgcgatttacgccaaagggcaggggatacggcacatcatcgcgggcgtgtgcgaaaccgacttctccggctatcccgactgccgcgacgtgtttgtcaaatcgatgaacgttacccttaatttggcgatggactatgattttcaaatccacacgccgctgatgtatctgaccaaggcgcaaacgtgggcgttggcggacgaaatgggcgtgctggactatatccgcgagcaaacccacacctgctataacggcatcgtcggcggctgccgcgaatgcccgagctgtatcttgcgcgaacgcgggctggcggaatatctggaaagtaaaaaggccgtctgaacacgcgcaaaccataaggaatacgatatgcccaagctccatatgttttacctcggcggcaatgccggcaggtcgaatatcgaagtgcacgacatccaatttgccgtgtgcgacaactaccgcgaggccgtccccgcgctcaaagccgcgtggttcggcgatgcggacaaaatccacatcgacggctggcagattgtcgaatgggcggacggttacgacatcgccgtatccgaaacgcccaaaacgaaaatgccgtctgaacacgccccgcgcctgtatttcgccaatgtcggcggttatcgcgcgggtcagcttgccgaggcacacgctttcgggctgttcgccgccgccacgcctgccgaagccaaacaaaaagccctgcaaaccctgttgaccgacagctatgttcagcagcataaagacaacttaaaagacgtggacaacctgcttgcgctcgaccgcatcggcaatttccatatccgcctgaccccgaatccgcacggcaaacccgccgaaatcggctttcaaggctatttgcccatttgagaacccatgaaaatcaccaaaatcttcaccttcgactcctcgcatatgctcgacgggcatgacggcaaatgccaaaacctgcacggacatacctacaaactcgaaatcaccgtttcagacggcattatcaaaggcggcgcgaaagacggtatggtgatggactttaccgacttgaaagccattgtcaaacaacacattaccgaccccttcgaccacgccttcatctaccacggcggcaacagccgcgaatgccaaatcgccgcgcttttggagggctggaacatgaaaaccctgcgcctgccctgccgcaccactgccgaaaatatggcggtcgaaatgtacggccgtctgaaaaacgcggggctgaacgtgtgccgcgtgaaattgtgggaaacgccgacatcgtgtgcggagtatgaaggggagtagggaatatcttgaacgtatcgatatagtaaattccaataagacatgcccaaccgcgtcattcccgcgcaggcgggaatccagaccttgatttatcaggaatatttaaaaattgcagcaattccaactctctggattcccgcctgcgcggaaaggacggtttagagcgtccttatttgaatttaccgtaaaacggttttttctcctgtacggattccccgttttttcagacgaccttccatatcaaatacacccattaaaaggaatacccatgaaactcctcttcatcctcctagtcctcttcgtcgccgtcgaacatttctacatcgcctggcttgaaatgacacagattcccagcgaaaaagcggcggaaatattcaagctgccttatgaatttatggaacaaaagcaagtgcagaccttgttcagtaatcaagggctgtataacggctttctcggcatcgggctggtgtggtcgcggtttgccgcgccggacaacgccgtttacggcgcgacgactctgtttctcggtttcgtattgattgccgccgcgtggggcgcgttttcgtccggcaacaaaggcatactcgtcaaacaaggactgcccgcgatgctggcggcggcagcggtgttggcggtatgaaaaaaatcaatgttgcccccgaaaatccgcaataccgtatcgtcgaaattttcgagagcctgcaaggcgaaggctggaacacgggcatgcccgccgttttcgtccgcttgggcaaatgcaatctggcgtgcggctggtgtgataccgattatttgacattcggtatgatgggcttgtccgatatcttaggccgtctgaaaacctacgccgcccgcaacatcatcatcaccggcggcgagccgaccatacagccgcatctcgatatgctgctggacacgctcaaggcggaaggctatttcctctgtctcgaaaccaacggactcaatcccgcgccgccgcaaatcgactacgtcgccaccagccccaaagcctgctacgccgccaaatatgaaaatagctgtatcgaaacagccgacgaagtgcggattgttgccgatggtgatgtccttgcgttctgcgaaaacatggaacgcaaaatccgcgcacatcattactacctttcgccctgtgagcaagacggtgcgatgaacatctacgacaccatccgccaaatcggtattttaaacagtcgccccgacgcatccgtgcattggcagttgagcgtgcagacgcacaaatgggcgggaatagagtagtttaagcagtgtaactcaaagggacggcgtacggttttaccgatgtttgacatacggggaaagtgtgccgcttctgcgtggaaatgccggcatttccaccgcccaatcaggacggagccttactgaataagatgctgccgttgggtacaagctcggcttcctaaattccgatggtcttttgaaccttgccgatactctgtgccagtgcgcgcaaatggcagggttagggaaaacgaaatgccgtctgaaacagcattctgtttcagacggcatttttctgttgccgccaaaaggaaaaaccgcctcggcaatggatgccgaggcggtttgaatatggtcggaatgagaggattcgaacctccgcccccttcgtcccgaacgaagtgcgctaccgggctgcgctacattccgaattaagtaaggcgtgattatagcgcaaaaagtgcggcgtgcctataccgttttgcctttttgccgcgtgtcgggcggatttaaaacgttgtgtttgaatacagtgttgataatcatcattatctttaagtaattcaataagataactttctacctgaccgaaaaaatcattgcctttccctgacaaacggttgatgaaatcggcagattgttgaaacgcagccggtttaaaaggcttcgccgactttcacgccgcccgccgtgtcctgcggcgaggcaaggccggcaacaaaggcttgcgccgcttggaaatccgccgtctgcatcacggcttgcgcggcggcactgccgagcgtgttggccatatattgccaacgttgcgccaaagtgggattgtcaggaatgcggaaatcttcgcgcagttcatccacaaggtcgggacggttgcagacgaggacgatgtcgcaacctgcctcaaaggaaatgcgggcgcgttctttgatgccgcctgccccgcacgcgccctccatagtcaaatcgtccgagaaaatcacgcctttgaacccgatgtcgcggcgcaaaatttgtttgagccagatttcggaaaaccctgcgggctttgtgtccacttgtggataaacgacgtgggcgggcataaccgccgccataccttcgcggctcataatgcggaagggggcgaggtcggcggtttcgagttcggacaggctgcgccagtcttccggcaagaccagatggctgtctccttcgacaaatccgtgtccgggaaaatgtttgccgcaggatttcataccgccttttgtcaaacctttttgaagggcgagggcgaggcgggcgaccgcttcgggattgcggtggaaactgcggttgccgatgacggggcagtttccccagtccaaatctaagacgggcgtgaaggacaaatcgatgccgcaggcggaaagctcggttgccaaaacccggccgacttgtccggcggcggtttcggcggcggacgcgccgtctttgtcccaaatctcgccgagcgtactcattgcgggcaggcgggtgaagccttcgatgaaacgttgcaccctgccgccttcgtgatcgacggcgataatgagttcgggtgtgcgcagggctttgatttcggcggtgagtgttttgagttgttcgatgttttggaagttgcggcggaagaggatgatgccgcctacggcgggatcgagcaggcgttgcttttcctcttcggtcaggcggaaggcggcaatgtctgccatgacggggccgcgcggaatatgggggacggtcattgcggtttgctccaaaaagcttcagacggcatatgccgtctgaacagggaaaggggtcaggcgttggcgcgttttttatctttcaacagaaaaatcagcaccgccaatacaatgcctgtcgtgccaaagcccaacagcgcggattttgtcagacccaatgcgaggtagcccgatgcggcggcggcggcaacggttaaggcgtaaggcagttgcgaggtaacgtggtcgatgtggttgcagcgcgcgccggtggacgacaggatggtcgtgtcggaaatgggcgagcagtggtcgccgcataccgcccccgccattactgcggacatacacgggataatcagcgcgggttcgactttgaccgccatggcggcggcaatcggcagcataatgccgaacgtcccccagcttgtgcctgtggcaaacgccatcacgctggcgagcaggaagaggatgacgggcaggaagccgggatggatgttgcccgcaaccagtgtggagaggtaatcgccggtgtgcatttcgccgacaaccgtactgatgagccaagcgaggattaaaatggcgattgcgccgaacatagatttcgcaccctgccaaacggctttgggatagtcggcggttttaatcgtgccgagcgtgcagagaacgacggcaaggacgccgcaagtgccgccgaataccagcgaagtgtttacgtccgtgttttcaaatgcccccaaaatgctgaaggtttcgcttgcctgcgcgccggtgtagatcatggcggaaaccgttgaggcgattaaggccaaaacgggaataatcagtgcgtaaacacgacctttggtagcgtctgaaacggcagtttcatcgtgggcttcgttcaacgcggcttgttcgaaacgtgccatcgagccgatgtcgaaggaaaaccatgcgacgacgaacaccataatcagggcaaacagtgcgtaatagttcatcaggctcatggcgacaaacgtccccatcggcgtgtattcggtgattttgtaggtaacgagcagtccggcaagcgtggcgataatcgacgcgccccagcttgaaacgggcatcagcacgcacataggagcggcagtggagtcgaggatgtaggcgagtttggtgcgggaaactttaaacttgtcggtaacggggcgggcaatcgcaccgacggcgagactgtggaaatagtcgtcgataaaggttacgaacacgaggcaggcggtcagcattttcgcgccgcgccggtttttaatgtgccgttttgcccagtcggcaaacgcctgattgctgccggagtaggtcagcagggaagtaaaaatacccaaaagtatcaggaaaaccaagatttttggtttgcccagcgaccaatcgccgtctgaccaagccaagccgacgaccatgtctttcaggtgtgtcagaccgtcgacggggttgccgccgaccaaaaaggcaacgccgaccagaataccgatgcctaaagacagcagtacgcggcgggtaatgacggcaagtgccagtgccaaaaagggtggcacaaccgagaaaaatgaatgtgaatagtcgatcagctgcatggttatgggggtgttaagcgtccggatgggagcgtatctgtccgcctccggtttgggttttgttggcaaaatgggcggaaatattttttgtcgtaaaaaatatttgtttaaaatcaaccaactgatttttgtaaaatgcccgttaatcggtattgacgggcattttatcatttaaaaaatattttggttaaattatgtgtgttattgcaggtttaatgcgataaacagcgtgttgccacggcgcatgatcagcagggggacgtttttgcctgccttgtccatagctttgcggaaaccggcttcgtcattgacggggacttgcccgacggcaagaatttcgtcgccgcgcctcaagcctgcgcgttctgccgcgtcggaaacccgtacgacgacgaggtgtccgccgctgctgtcggtatgtgtctgaagggtaatgcctgcggattcgaccgagaacgtaccggattgctgttcggtgtagggggcttcatctgttttggatgatgcgccgatatgctcggcggcgttgcccagcttgactttgattgtgatttcttcgcctttgcgccatacgccgaggctgacttcttttcccggcgtaatggcgccgaccataacgggaaggtcgccggaagaacgtatttctccgccgtcgaggctgaggacgatgtcgcccgcctgcaggccggcacgttctgcggggctgccgggcaggattttggcaatcagtgcgccgccggctttgtccaaaccgaacgattgtgccaaaccgtaggatacttcttgaataatcacgcccagttgtccgcgttggactttgccggtgtttttcagctgttcggcgacattcatggcaacgtcaatcgggatggcgaaggaaatgcccatgaatccgccgctgcggctgtatatttgcgagttgatgccgacgacctgtccttttaagttgaacagcgggccgccggagttgcccggattgatggcaacgtcggtttggatgaagggtgtgtagctttcgttgggcaggcttctgcctttggcggacacgatgccggcggtcacgctgttgtcgaagccgaagggcgcgccgatggcggcgacccattcgcccggtttcaaatctttgggattgccgattttgacgacgggcagctcttccgttgcgtcgattttcagaagggcgacatcggattggacatccgaaccgatgagtttggcggtatattcgcgcttgtcgttgagcaggactttgatactgcccatgccggtaacgacgtgggtattggtcaggatgtagccgtctttgctgatgatgaagcccgaaccgaagttcaatccgccgtcatctgcttcttcttgggggatttcgggcatattcgggacgaggcgtttgaaaaattcgtagaacgggtcgttgtcggcaatcgggtcggaatcgttttcggcattgccgctgccgttttgggtgcgcggggcgggggctgcctgaatattgacgactgccggaccttcactttgaaccagttgggcaaagtcgggcagcagcatactgacgctgccgtcgtctttggtgtgttcgatgcgttctacgaaggatgcttcttttttgtccgcaccgaaaaagctgcctgccttgtcgcagcctgccagcgaggcggcacacagtgctgccaaagcgaggtattggtattttttgaacacgttttgtcctttgtcggatgccggtaccggctttaatgccgtctgaagcgcattttgtcggcttcagacggcataggttgaaattctacaacgtccgtccgaattttcaagcgtttcattttgaagggcggcggcggtcaggctttggcgggatattcgcacaaatcgttgatgatgcaggtttggcattgcggtttgagtgccttgcaggtgtagcgtccgtgcaaaatcagccagtggtgcgcgtccatcagaaattctttaggaatgaagcgcatcagtttgtcttcgacttcgcgcacatctttcccgggggcgattttggttcggttggatacgcggaaaatatgcgtatcgaccgccatgacgggatggccgaacgccgtgttcaatacgacgtttgccgttttgcgccccacacccggcaatgattccaaagcctcgcggtcttccggcacttcgccgttgtatttttccagcaggatgcggcaggtttgcataatgtgtttggatttggttttatacagcccgatggttttcgtgtattccatcacgccgtccaaacccaaatccagcatcgcctgcggcgtatcggcaacgggaaacagcttcgccgtcgccttgtttacgccgacatcggtcgcctgcgctgaaagcagaacggcaattaaaagctcgaaaggggagttgaaattcagctcggtggtcggatgggggttggcggcgcggaagcgttcgaagatttcttggcggatgtgtctgttcatttttttatacggtgggtttgtgtgttcggcattataacgtatggttcaggcggcgtaatattgcattccccacagaatgaaggcgtaacgcgccgttttgccgataaccagcatcagcccgcttgtccacggattcaaccgcagccagccggcggcaagcggcagtgcgtcgccgacgacgggcagccaggtaaacgcaagcagccaaataccgaaacgccgcatcagattcagtgttttttcagacggcatttttcgggagggcagcaaacgccccatccaataggaaaccatactgcccaatccgttggcaaggccggcgcacagcaacgcgccgtatgcgtgttcgggaaagcggtggacgaacagggcaaaggcggcttcggatgtgccgggcaggagggtggcggaagtgaatgcggaaaaggcgagggcggcgtaggtgtaggagggtatcattgcaaacagtctcaaacaggtaacaatcggcgacggattgtacggtatagtggattaacaaaaaccagtacggcgttgcctcgccttagctcaaagagaacgattctctaaggtgctgaagcaccgagtgaatcggttccgtactatttgtactgtctgcggcttcgtcgccttgtcctgatttttgttaatccactctattttcacgcccccgccgaagggcggaggacggtgcaaaaaatacggcacagccgtatgccccttttttgtcgggcatacgacattctttccgctccggttttgatgccacgatgcggcatttccgaattttccggatacggcggcggattttcattttattgggaacggtttttgcaagtccgccggaattttttaaaatctattaaaatctatgcaagcaactgtaaaatattaatttctgctgcttgaatttcagatcggcgcattgcctgcatccgataaagtttgcaaaatgttcaaatatcagtatgatttgcattgccgttaagaaatgtcaatttctattttcttgaaacgggtaatattccgacaccacgaaaggcaaatcatgtctgcgcaatcacaaaacaatcatacgtccccattggtcgtcttgaccacgctgttcttcatgatgggttttattacctgcatgaacgacatccttatccctcatttgaaagaaattttcgacctgtcttacgttcaggcgatgctgatccaattctgtttctttaccgcctatgcggtgatgtccatcccgatgggggcttttgtcggcaaagtcggctacaaaaacggcgttatcggcggctttctgctgacggcggtcggatgcctgctgttttatcctgctgcgggcagccattcttacgcggtatttttgggcgcgttgtttattttggcttccggcgtaacgctgcttcaggtcgccggtaatccttatgttaccctgctggcgaaacccggcaaggaatcggcaacactgacgctggttcaggcgtttaacgctttgggtacgaccattgcgccgcaaatcggcgcgttcctgattctggcggacgcaacccaaaccgtcagcaaggcggaacagatttcttccgtacagattccctatttgggactggcggggctgctgattatccttgccgttttcgtgaaaatgatccggctgcccgacgcgcgcaaaattgccgccgaggaaagcgcgcacaaccacgacggcaaaaccagcgtatggcaatacaaacatctcgtgttcggtacggcaggcattttctgctatgtcggcgcggaggtgtctatcggttcgttgatggtcaacgtattgggttatctgaaagggctggatcatgcttctgccgcgcattacctgtcgttctattggggcggcgcgatggtcggacgtttcctcggttcggcggtgatggcgaaattcgcgcccaaccgttatttggcgtttaacgcatcggctgcggtcgtactgcttgccgtcgcgatggcgacgggtagcggcaatgcggatgtggcgatgtggtcgctgcttgccatcggttttttcaactcgattatgtttccgacgattttctctttggcaaccaaaggattgggaaaatttaccaacgcggcttccggtgtactgtgtaccgcgattgtcggcggtgcggtcgttcctgtcgtgcagggctgggtggcagatacttacaccctgatgtcttcgtttgtcgtttccgtcatctgttatctgtatatcgtgttttttgcggtgtacggatatagggcggacaaataatctttttcttgagaaatgtcgtctgaacatctttcagacggcatttttgcgtaccggtgtttgcggcgtgtgtgccgaggttttaatacttcaatccataaaagtcttatatgtcaacaaacaaaaaaataaaaaattatatttcaaaaaaattaatttaaattgagaaaattgccgttttgtttctgtccggcttttgtaaaacgctaaaatgccgtctgaaaacgtcgggcggattcggtatggtgtgttagaatccgttaactttatatcaaatcgggcaaagaatcatgttcgctttcaaatccttactcgatatgccgcgcggtgaggcacttgccgtcgtcgtcgctctgattgccgcgatgggctataccatcatttcattggagtggttgccgcatatgtccattattgccgccatcgtcgtgctgattttgtacggcttggcgcgcggtttgaaatacaacgatatgcagcagggcatgataggcgcgttgaatcagggtatgggcgcgatttacctgtttttcttcatcgggctgatggtcagcgcgctgatgatgagcggcgcgattccgacgctgatgtattacggtttcggactgatttccccgacttatttttatttttcctccttcgcgctgtgttccgtcatcggcgtgtccatcggcagcagcctgaccacctgcgccactgtcggcgttgcctttatggggatggcggcggcgtttcaggccgatatggcgatgacggcgggcgcgattgtttcgggcgcattttttggcgacaaaatgtccccgctttcggatacgacgggtatttccgcgtccatcgtcggcatcgacttgtttgagcacatcaaaaatatgatgtacaccaccatccccgcgtggctcattagtgcggcactgatgctttggcttttgccgaatgtcgccgcgcaggatttgaacagcgtcgaatccttccgcagccagcttgaagccacgggattggtgcacggctattcgctgattccgtttgcgctgttggtcattttggcattgatgcgcatcaacgccgtcgtcgccatgctctttaccgtcatggttgccgttgctgtaacgtatctgcacagcacgcccgatctgcgtcagctcggtgcgtggttttacggcggctacaaactcgaaggcgaagcgtttaaagatgttgtcaaactgatttcgcgcggcggtttggaaagtatgtttttcacgcaaaccatcgtgattctcgggatgagtttgggcggactgttgtttgcgctcggtgtgattccttccctgttggaggccatccgtaccttcttgacgaatgccggacgcgcgacgttcagcgttgccatgacttcggtcggggttaatttcctgatcggcgagcaatatttgagtattttgttgtcgggtgaaacgttcaaacccgtttacgataagctcggtctgcattcgcgcaatctgtcgcggacgctggaagatgcggggacggtgattaacccgctcgtaccgtggagcgtatgcggcgtgttcatcagccacgcgctgggcgtgccggtttgggaatatctgccgtatgcctttttctgctatttgagtttggctttgaccctgttattcggttggacggggctgactttgagcaaaaaataagcggataagcgaaatgccgtctgaaacttgcaacggtttcagacggcatttttatgtttggcggatggggcggattgaaacagaaaacgcccgtaccgtcatcctaaactgtgcagaaacggcggtgcttacttcacgcgggtcgccatcagcgtatgcaggcggcggttgtcggcgcgtgcgacggtgaactgcaaaccgccgataaggactttttcgccgcgcacgggcagatgtcccaactcttgaatgaccaggccgccaatggtgtcggcttcttcgctgctgtattccgtgccgaagaaggtgttgatgtcttcgatttcggtagctgcatggatgcgccagcgttcggaagaaacggcatggatattgtcggcgctatcgtcttcgtcaaactcgtcttcgatttcgccgacgatttgctcgatgatgtcttcaaaggtgaccaagccggatgtgccgccgtattcgtcgatgacaatcgccatatggttgcgctgttcgcggaactcttttaaaagggcggtcagcgatttgccttcggggacgaagacggcggggcggagaatggatttgaggtggaactgctcggggttaaacatatatttgagcaggtctttggcgtgcaaaatgcccaaaacttcgtctttgtcttcgccgatgacggggaagcgcgaatgggcggtatcgataacgtaggcggtgatgcgctcgatgctgtcgttttcttttaaaacgttcatacggctgcgcgtaatcatcgcgtcgcgcacttccaaatcggaaaaatcgaggactttttccaatcttaaaagcgtatccgcatcaaaaacttcctgctcgtgcgcctgccgaagcaggtttaatacgtcttcggcggaatcgggttcgcgggcgagtcgggcaatcaggcgttcaaaaaaattcgttttcggttgtgcgccgtccattttaatgtcagtcctcttggtaggggttggggaagcctgccgcccgcatcaggcggatttcttcggcttccattatttcggcttcgtcgtcttcgatgtggtcgtagcccatcaggtgtaaagtaccgtgtatggtcaggtgggcaaaatgctgctcgggtgttttgccttgttcggcggcttctttcaaaaccacttgcgggcagataatcaaatcgccgtacagtttttccgaaacttggcagggcaggatttcgccttcgttgagcgcgaaactcaatacattggtggcgtaatctttgccgcggtagtcgcggttgtaggctcgggcttcttcttcgtccagaagaatcaggctgatgtcggcgcggcggtattcatttttcaaggcagaccacgcccagcggtagaaatcgcgttcggctgggatgccggcggcggaagaggcgttttcaaagttcaaatggaaacgttgccgctgcaacgttaagaaagggtattttttggtgcgtttcattgtggcgggtttcgtgttttgtgggtgtaaatataacatagacctgacggtgccgtctgaagaaacgttcaaaatatgatagacttcacgccgtttccattctttgaacgcattgaacatgaacccgaaaaaactcgtcatcgccagccgcgaaagcctgcttgctatgtggcaggcaaagcatatccaaggccgtctgaaggctctgtatcccgattgcgaagtcgagattttgggcatgaccacgcgcggcgatcagattttggacaaaactttgtcaaaagtcggcggtaaaggcttgtttgtcaaagagttggaacaggctttatatgacgggcgcgccgatttggcggtgcattcgattaaggacgtgccgatggatttgcctgaaggtttcgcgcttgccgccatcggcgaacgcgccaatccgtttgacgcgtttgtgtccaaccaatacacgcgtttggaagaaatgcccgaaggcgcggttgtcggcacatccagcctgcgccgcgaagcccagttgcgtgcgcgctatccgcatttgcttatcaaacctttgcgcggcaatgtgcaaacccgtttgtccaaactcgataacggcgaatacgacgcaattatcttggctgccgccggtttgcagcgtctgaaattggacggacgcatccgcatgattttgtcggaatccgacagcctgcctgccgccggacaaggcgcattgggtatcgaaattgccgcgcaccgcgaagatttgtatgaagttttgaaacccttgaaccacggtgttaccaatgcctgcgttaccgccgaacgcgccctcgcacgcgctttgggcggaagctgccaagtgcctttggccgcatattgcacggaagaaaacggcttgctgaccttgcgcggcttggtcggacaccccgacggttcggttgtgttgcgggcggacgcgcaagcccctgccgaatatgccgacgcgctcggacgcgctgtcgctaagaaattggcggacgacggtgcgcgggaattgattggagcagtattgaatacggaaaattgattttatcgaaaatttaaataaaataatataagttattgtttttaatcaatttgtttcatcagtttcactcgccttatttcgtcattcccgcgcaggcgggaatccagtttgctcggtttcagttgtttctaatcaattcttgcagcattggattcccggattcccgcctgcgcgggaatgacggcggaaaggtttttgtggcttcggataatactgtggcgttcaaattttgaatttgagaatgatgatattcgtattttttatttgagttcatcatatttggttgattttatagatgtttttagcttgtttgaaattgttatggtttattgttttttaacaaaaaacagatgccgtctgaactggttaaggttcggacggcattttcatatggctgtgctttttacagtactttcacgatgctttcgcacagataatcgatgttgttgtcggtaatgccggcgacgttgatgcggccggagcggacggcataaatggcaaactcgtttttcaggcggtcgacttgttcgggagtcaagccgctgaaagagaacataccgttttgtttgataatgaaatcaaagttttggcttgcacctttggctttgagcaacccgacaaatttttggcgcatggctttgatgcggccgcgcatttcatcgagttcggcaatccattgtgctttcaaatcatcatttttcaacaccagcgcaatggtgttcgcaccgtgtgaagccgggttggaatacaaggtacggatgatggttttgacttggctgtgggcgcgggctgctgtttcttcatcttcggccaccaaagtgaacgcgccgacgcgctcgttgtacataccgaagtttttggaataagagctggcaatcagcaattctgtattgtgtttcaagaacacgcgcaagccgtaggcatcttcttccaaaccattgccgaagccttggtaggcaaagtcaaacagcggcaaccagcctttttcggcagaaagttttgccaaagtttcccattgttcgggcgtagggtcgatgccggtaggattgtggcagcagccgtgcagcaggacgatgtcgcctttttgcgcttggctcaagtcctcaatcatgccgtcccaatccaaaccgtgtttggcggcatcatagtaacgataaggtttgtcttggataccgaccgctttggcgatggcgttgtggttgggccaagtcggattggaaatccagatggtttgcgcgttcaactggcgtttggcaaactcggccgcaatacgcaatgcgcccgtaccgccgaggctttgcgctgttttggcgcgacggctggcgatgatttcgtggtctttgccgaacagcaggatttgggtttgcgcgttgtagtcggcaacgccgtcgatggtgaggtagtttttggtggtttcgctttccaacaggcgtttttcggcttctttgacggctttgacgaggggtgtcgcgccggatgcgtctttataaacgccgatgccgaggttgactttttcggggcgggtttcggctttgaacgcttcgcccaaaccgagaatcggatcggcgggggcggcttcgatgtgcttgaagaacatagcttgctccttgatggggacggaaggtcattcgggtttgccgattttacgctgttttacacgggctggaaacagacgcaatcacgcctgcccgatatgggcgaaggtttcccagtttgactgtatgtgttctgcaagcaggggcaggtcttgttcggcggcttcgtagtatgcgccgtcccattcttcaaattcggggaactgtttgcgcagggaagggatgtctgcgcctccgtcggcgagcgtttcgatggttttgccgtgttgttcgtagagggctttggctttgtccaagactttcggcacggctttgattttccagcggcgcaggctgtcggcaagcgggttgcggaaaatatattcgccgtaaccggatgcgatgagttgcacgaagccgccttcttcgacttggctgtcgaggtagcagaatgcggtcagcgtgtgctggtcgtcggacaggcaggagagggattcgtcgccggtttgggcggtgtgttcgaggtaggcggaaacgagggtatagagcagggcggatggctcttgttggcggatgtcttccggaagggtaagcgcagtcatggtatgccgtctgaaaagtggggattatagcggattgcggctttgcgccgaaaatatcctttagcctgccgatggcgtaaaataggcgcacgccaaccacgcaaaggaaaatcaaatggacaatctgaatccgcaggaaatttccgtgttgccggaaaatctgccgctgtattgctcgggacccggcaacgagcagtggaacgggcatccgagagtgtttttgcctttgtgcgaaggagaatcgggcagcgttgcctgcccgtattgcggcacgcgctaccgccttgacggcaagatgccgcatcatcattacgcctgaacgcaaacggcggaaaaatgccgtctgaagcctttttcggtttcagacggcatttgtttggcggggcgggcttgttccggcaccgggattctgcccgacgcgccgcccagacggtgaacggcggtttccgttccccgcgtgctgccgctatggatggtggcgtttcgcctagaggaagaaaatcattgccgcgacgacggcaatcacgccgtaaatcgccatcgggataacggttttcttgataatcgcaccttcggaatttttcacatccaatacggtacatacggcgatgatgttgttgaggcacaccatattgcccatcgcgccgccgacggactgcaacgccagaatcagggtaacggacaggccggtatccaaggcgatttgctgctgaatcgggccgaaggtcaggttggacacggtgttggaaccggagaagaacgcaccgatcgcgcccagatacggcgagaaataaacccagtgttcgcccgccattgcggcaaattccttaccgatgattttcaccatcgaattgtcgccgccgaccagcatcagctgaaccataatcagcgcgcccatcagggcaagcagcggttttttggtttgattgaaggttacggaataaatcgtccaggcatctttgaatttggttttatacagcaggatgcaaatccaaacggtcagcacaaacggaatccaagccgggacgtacagcgtttggtaagacgcgctgacatcttgtccgaaaatattgccgaaggtaatcgtcagggagtcgctgacggtgattttggacaaatcaaacggcagttggaagctgaaccattcttctttgctggtcaaaatgcctttgatgccgagctgtttgatgcgcgtaaccaccagcatgccgatcagcatacccaaaggggcgagtgctttggcgacttgggcgaacggcactttttcggcattcgggtctttggcgtggtctttgctcaagccccagccttggttggcggcgaatacggacaccatcaggccgatcgcgccggcgacgagcgacgggaattcttcgttgaccatcgccaatgcgacataaggaatggtgcaggagaagacggcaatggcgacgaagcccaagtttttgcggatttcagaccaaggtacgatgaagcccaagccgatgacggggatgacgaaacctgcgaagaagtgcattacgccggtctgcctgccgatggcgaggatgtcttcggcactcaggttcagcggtgcgaaaccgaaccaggtcggcgtaccgaccgcgccgaaagagacggggacggagttcatcaccaaagtgaaaatcgccactttcaacgggttgaagcccaagctcatcagaatcggcgcggcaatcgcggcaggcgtaccgaagccggatgcgccttcaatcataaaggcaaaagcccagccgataatcatcagttgcgctacggggttcgggctgatggtcgccagccatttgcggatgacatcgatgcagcccgtggtttccatcatacggttgaacataatcgcgccgaaaatcacggtaatcggcgtgagcgttttgacgaggccggaagcggcggtggcgttgagcagcatgcccgcatcgtcgaagtagaaaagtttgatggcgtaaatcagcactgcggtaatcggcagcgcgacgtaggagggcatactgttttttttcaccatcagccaaatcagcaggacgatggggaatatgctgaggaaaagtgccataacgaatcctttttaggcatttgcatcataaggcgcgtcgaggtttggaaagacgttcaaatcccgtacacccgatattttggttaaaagataaattggtaagaccaattgttatgcgtttgcacactttacgtaatcttatgtaatcggtcaagcattttatcgataatggctattaatgcgggttaaggatagtgatgatgcggcggagggagtgtgggaaaggggcgtgtaaaaaaagccgcccgaaaggcttcagacggcattttcagtatttttccagcggcacgaataccgcgccgtccccgtccacgcggaggattgaagcatagtcgttatgccagtcgcccaaaacgatgcgggtaaagccgttttcgtgatggatatgctcgcggtgggtgtgtccgtgtatcagcctttccgcaccgaaggcgcgtacctgccgcgcggtaaaggcggcattgacatccataatatcggcgggcttgacctgtttttccattttgctgacacgcctgattttggtggcaaggcgcgtgcgccacttcaggggcagcattaggaacagtttttgcagccgcttccgatgcacgattttgcggaaacgttggtatgccctgtcatctgtacacagagtgtcgccgtggcagatgagggttttgcagccgaacaagtccaaaaccgagtaatccggcagcagcgtcatgcccgcctgccggcaaaaatcctgaccgatcaggaagtcgcggttgcccctgacgaagaacacggcaacgcctttgtcggacaatttcctgatttcacgcgcaaccgaagtattcaactcggaaacttcgtcatcgcccacccaaaaatcaaacaaatcgcccaaaatgtaaatcgcccgcgcctgcccggcggcggaagaacgtaaaaaacgcagcagcagcgcggtcagttcgggctgcttttcgctcaaatgcaggtcggaaatgaaataggcgggtttcataggcaggtttccaatcgggcggatgtcggggcggattataacgcgcccggcggcggggcaatacggcaaatgccgcgccaagcatcgggcattggcggaaccggggttcgggcgcgttaaaaatgccgtctgaaggcttcagacggcatcgagggtgcgggatgcggtaaggttttgccggcaagatatggggtggtgcggcgggatttccgttaaaatacgcttcttttttattttttccgaccattatgcgcctgacccatatcaaactctccggcttcaaatcttttaccgacccgaccacgattcatgtgccggggcagcttgtcgcggttatcgggcccaacggctgcggcaagtcgaatgtgattgacgcggtgcgctgggtgttgggcgaggcttcggcgaagcagcttcgtggcgagagtatgcaggacgtgatttttaacggtgcggcgacgcgccgtcctgcgccgagggcttcggtggagctggtgtttgacaacagcgaccacagtttgcagggggcgtgggggcagtatgccgaggtgagcatcaagcggcagctgacgcggcagggcgaatcgacttatttcatcaacaatcagaccgtgcgccgccgcgacattaccgatttgtttctgggtacgggcgtgggcgcgcgcggttatgccgttatcgagcaggggatgatttcgcgcatcatcgaagcgcggccggaggagttgcgcgcctatatcgaggaggcggcgggcgtgtccaaatataaggaacgccgcaaggagacggaaggtcgtctgaaagacacgcgcgagcatttgcagcgtttgggcgatttgcagaacgagttggcgcgtcaggtggaaaagctggaaaaacaagcggaaaccgccgaacgctacaaatccctgaccgcgcagctgaatcagcaacaggatttgctcgattacgcccaatggcggcaatcgcttgccgccgccgataaggcgaccgcgcagcatcaatctttgcaggcgcagcaggacgaaaccgccgcgcaggttcaggcgttaaacgacgaagtacacgccttgcagactgccgaacagtcgcagcagcaggcagtgcatgaattgagcaacaagcgcggcgtgttgcgcgagcagattgcccgtttggaagaacaaatccgccatcagcaaaacctgcaccaacgcatcgaacgcgacaagcaggcagcgcaggcgcagttacaacgcattcatcaagagcagcagcaaatccgcgtgcagcttgaagaaaacgagttgcaggtcgaagaaaaacaaaccgagctggcggaatgggcgatgcaggttgccgaacacgaggagcgtctgcccgaattggaagaagcccaagccacgctcaacgccgccttccaaacccagcaggacgaggcaaaccgcatccgccgcgaactggcgttgaagcagcagcagcttgcccatgccgaacaaacgattgccaagcacgaagagcgcaaaggtcgtctgaaacaggaaaaccaagccttaaacctgcccgacgaagccgaaaccgccgccgcgcaggaagcagccgccttgttgcaaagtcagcaagagcattacgaagaacaaatcattgccgccgaagaagccttacacgccgcccgcgaggcgtttcagacggcctcaaaccgcttccaaagcctgaagcagcaacacatcaccttgcaggcgcagcagcaggcgttgtcgcaaatcctgtcgcaacagcaggaagccgccgatttctggcaggcaaccgaccacgccgccgcgccgcaactgtggcaacacatcaccgcgcccgccgagtggcagcacgccttgtccgtcattcttgccgaacgcctgcacgcccgcgccgtgccgcaaggtttcgtgccgcccgagcctttgccgcaggggcaggcggcatggctttcagacgacctctcaggcggcatcaaaaaatccctgcccgtacaggcattgctgaaccaaatccaagcgcagccgccgtttcagacggcattgcactactggctcgacggcgtattgtgcgcgcccgatttgagctatgccctcgcgcatcaaaacgatttgggcgcacaccaaatctggctcacgcccgaaggtcatcaggtcgataaagtcagcgtcctgctctatgccaaacccgcgcaggaaagcctgattgcccaaaaagcgcgcctcgacggcatcgcgtccgaactggaaaacctcgcccccgaactttccgccgccgaagccgcgttcaaacaggcggaagctgccgtgcgctcgtctgaagtgcaacataaaaacctgatgcagcagcaacagcagcacacgcgccaatacagtcaagcacagcaacgcgccgccgaactcttagcgcgtaccaaccaagggcaaatccgccgcgaacacatcgagcgcgaactggcgcagttggcggaagaacagaccgtgttgcaacacacgtccgacgggctttcagacgacatcgttaccttgcaggaagccgccgccgaactcgaacaccagcagcaaaccaccgcgcacagccgccaagagcagcaaggccgtctgaaacaggcgcagcttgccctgttggaagccaaccgccaatacgggcttgccgaagtcgccgtccacaaactcaaccagcaaaaacaaaactaccggcagcaaatcgcccagcttgaacagcaaaccctcgactggcaggaacgccagcaagagcttgccctcgcctatgaaaccgagttccaaaacgacgagcagcacatcaagcttgaagaattaagcgaagccgtacagaccttggacgaagaatatattgttgtgcaagagaaactcgcgcagattcaggaacagggcagggagcaatacgctaaagtgcaaaccctgcaaaccaagctgccgcagcttcaggccgccacccaaaccgccttgttgcagcagcaggaagccctgatcaacgccaaacgctaccatcaaaacctgaccgaacgcgccgccgatttggacgcgctcgaagcgttggcgaaagaatcgccgaaagtattgaacagcagcatcggcagcctttcgcaacaaatcgaagcactcggcgcggtcaacctcgccgccctgcaagaactcgaagaagcgcgcgaacgcgacggctactaccgcagccaaagcgaagacgtgcaggcagccatcacccttttggaagaagccatcgcccaaatcgacgacaaaaccaaagcgcgtttcaaagaaaccttcgatgccgtcaacagcaaagtccaaaccttcttcccgaccctgttcggcggcggcgaagccactctcaaaatgataggcgacgacctactgaccgccggtgtgtccattatggcgcgtccgcccggcaagaaaaacagcaccatccacctcctctccggcggcgaaaaagccctcaccgccatgagcctcgtgttcgctctgttcagcctcaaccccgctccgttctgccttttggacgaagtcgatgccccgctggacgacgccaacacctcgcgtttctgcaggctggtcaaagaaatgtcggcgcaaacccagttcctctacatctcccacaaccgcctgacgatggaaatggcggagcagctggtcggcgtaaccatgcaggaaaaaggtgtctcgcgcgtcgtcgccgtggacatcaaacaggcgttggaaatggcggaagccgtttgaacgggttgcagaacggctgaatcttgccgtttttaatgaagtgttgcgatatgggttttcagacggtatttcaaacagaacagattaaaatcaaatccaaatccataaaaaatgccgtctgaacagcgttcagacggcatttcgatgtgtactgccacgtcaaatcagtggtgatggccgcagccgcattcttttttcatatcgatcaccatacggccggtgattttgccttcgcgcatttcttggaaaatggcgggtgcttcatccaaagcacgcagttggactttcggcacaaccaaaccttccgcgccgaattggaaggcttcttccaaatctttgcgcgtgccgaccaaagagccgaccacttcgatgccgtccaaaaccaaacgcgggatggacaaatccatcgattccggcggcagcccgatggcaaccacacgtccgcccgcgcggacgcaattcacggcagagttgaatgcggcagcagatacggcggttacgaccgcagcgtgtgcgccgccggttttttcctgaatcactttggcagcgtcttctttggcggcgttgacaaccaaatccgcgccggtttctttggcaaacgccagtttgtcgtcgttgatgtcgatggcgacaacgtgcgcgccgaatacttttttcgcgtattggacccccaagttgcccaaaccgcccgcgccgtagatggcaatccactgtcccggacgaacgccggaaactttaatggctttataagtggttacaccggcacaagtaatgctggaagcttgcgcaggatccaaaccttcagggactttgaccgcgtaatcggcactcacgatacagtgggtcgccataccgccgtcggcggtgtagcccgcgttcaatacggaacggcacagggtttcgcggccggtattgcagtattcgcaagagccgcagctttggaacagccaagcgatgctgacgcggtcgccgactttcagatttttcacaccgtcggcaacttctttaaccaaaccgatgccttcgtgtcccaacacgcggcccggtttttcgccgtagtcgcctgccgcaacgtgcaggtcggtgtggcacacgccgcaatattcgacttcgaccaatgcctcgccgtattccaacgggcgaacctcgcgttcgattacttccacatcgcccgctacatttttattcacaacaactgcctgcattttcatgattgcgctccttagttacggcaaaaaaacctgtaaacggaatgttgtccgatataagggtaagcatacgcttccgcatctcacaggtcaagtggtatgttgttgaaaaatatagattatatgttatattataacatcttggaaaggcacggcatcggggcggttgccggatgaggggcggcaggtttcaagtttgaaaaaccggacggcaaacccgtaaagataccgtctgaagctgtgtccggacggcatctttacgggtttgcgggcttcggcggaggattagtcgaagccggggcaggattggtttgtaccggaagcggcaatggtaccgccgtcgttgagcgtaacgacgcaggtttcgccgtcgttggtggtgggattggggtcggcctgaagggtaaagtggtcggggctgacttcgcttaaagtgatatcgaaatattcgttttgtttcagtttgtttttgtcgtaggttttaaacgtccctttttggcggtagtaacgttccatggtctgcgcgttgtgcagcagggtcgtcctgacttccgacaggcggacgcgccggatgtaggttttataggaagggtaggtgatgagcgtcaggatgccgaggatggcgacggcaatcatcagctcgagcagcgtaaagcctttttgaacgtttttcatagcaatgtgtttccatttgtttgtcggtcgacggcattataacgccgtatcggaaatggcggaatatgtaaacggattgaaattttcgggaaagcagattgtataagccatttaaaacaaatggttatttttattgtcggcagtttgccgccttggatggggcagggacttgcggtagaatccgcttccgatttatgggattgacgcatacagagaattgaaaacatggcaaaaatgatgaaatgggcggctgttgcggcggtcgcggcggcagcggtttggggcggatggtcttatctgaagcccgagccgcaggctgcttatattacggaaacggtcaggcgcggcgacatcagccggacggtttctgcaacaggggagatttcgccgtccaacctggtatcggtcggcgcgcaggcatcggggcagattaagatactttatgtcaaactcgggcaacaggttaaaaagggcgatttgattgcggaaatcaattcgacctcgcagaccaatacgctcaatacggaaaaatccaagttggaaacgtatcaggcgaagctggtgtcggcacagattgcattgggcagcgcggagaagaaatataagcgtcaggcggcgttatggaaggaaaacgcgacttccaaagaggatttggaaagcgcgcaggatgcgtttgccgccgccaaagccaatgttgccgagctgaaggctttaatcagacagagcaaaatttccatcaataccgccgagtcggaattgggctacacgcgcattaccgcaacgatggacggcacggtggtggcgattctcgtggaagaggggcagactgtgaacgcggcgcagtctacgccgacgattgtccaattggcgaatctggatatgatgttgaacaaaatgcagattgccgagggcgatattaccaaggtgaaggcggggcaggatatttcgtttacgattttgtccgaaccggatacgccgattaaggcgaagctcgacagcgtcgaccccgggctgaccacgatgtcgtcgggcggttacaacagcagtacggatacggcttccaatgcggtctactattatgcccgttcgtttgtgccgaatccggacggcaaactcgccacggggatgacgacgcagaatacggttgaaatcgacggcgtgaaaaatgtgctgattattccgtcgctgaccgtgaaaaatcgcggcggcaaggcgtttgtgcgcgtgttgggtgcggacggcaaggcggcggaacgcgaaatccggaccggtatgagagacagtatgaataccgaagtaaaaagcgggttgaaagagggggacaaagtggtcatctccgaaataaccgccgccgagcaacaggaaagcggcgaacgcgccctaggcggcccgccgcgccgataaacgaatatgccgtctgaacacggaaacggtttcagacggcatttgttattgatttacggaatattatgagcttgatcgaatgtaaaaacatcaaccgctatttcggcagcggcgagaaccgcgtccatattttgaaagacatcagcctgtcgatagagaagggcgattttgtcgccatcatcgggcagtccggttcgggcaagtccacgctgatgaacatactcggctgtttggataccgccggttccggttcgtaccgaatcgacggcatcgaaactgccaaaatgcagcctgacgagctggcggcattgcgccgcgaacgcttcggtttcatcttccaacgctacaacctcttaagctcgctgaccgcaagggacaacgtcgcgctgccagccgtctatatgggcgcgggcggcaaagagcgttccgcgcgggcggacaaactcttgcaggatttgggtttggcaagcaaagagggcaacaagcccggcgaactctcgggcggacagcagcagcgcgtctccatcgcccgcgccctgatgaacggcggagaaatcatcttcgccgacgagccgaccggcgcgctcgataccgccagcggcaaaaacgtgatggaaatcatccgcaggctgcacgaagccgggcataccgtcattatggtcacgcacgaccccgacatcgccgccaatgccaaccgcgtcatcgaaatccgggacggcgaaatcatttccgacacctcgaaaaatcccgaaatccccgcaagcaatgtcgggaggattcgggaaaaagcttcgtggtcgttttattacgaccagtttgtcgaagccttcagaatgtcggtgcaagcagtattggcgcacaaaatgcgttcgcttctgacgatgctcggcatcatcatcggtatcgcgtcggtggtttccgtcgtcgcattgggcaatggttcgcagaaaaaaatccttgaagacatcagttcgatagggacgaacaccatcagcatcttcccggggcgcggcttcggcgacaggcgcagcggcaggattaaaaccctgaccatagacgacgcaaaaatcatcgccaaacaaagctacgttgcttccgccacgcccatgacttcgagcggcggcacgctgacttaccgcaacaccgacctgaccgcctcgctttacggcgtgggcgaacaatatttcgacgtgcgcggactgaagctggaaacggggcggctgtttgacgaaaacgatgtgaaagaagacgcgcaggtcgtcgtcatcgaccaaaatgtcaaagacaaactctttgcggactcggatccgttgggtaaaaccattttgttcaggaaacgccccttgaccgtcatcggcgtgatgaaaaaagacgaaaacgctttcggcaattccgacgtgctgatgctttggtcgccctatacgacggtgatgcaccaaatcacaggcgagagccacaccaactccatcaccgtcaaaatcaaagacaatgccaatacccaggttgccgaaaaagggctgaccgatctgctcaaagcgcggcacggcacggaagatttcttcatgaacaacagcgacagcatcaggcagatagtcgaaagcaccaccggtacgatgaagctgctgatttcctccatcgccctgatttcattggtagtcggcggcatcggcgtgatgaacatcatgctggtgtccgttaccgagcgcaccaaagaaatcggcatacggatggcaatcggcgcgcggcgcggcaatattttgcagcagtttttgattgaggcggtgttaatctgcgtcatcggcggtttggtcggcgtgggtttgtccgccgccgtcagcctcgtgttcaatcattttgtaaccgacttcccgatggacatttccgccatgtccgtcatcggcgcggtcgcctgttcgaccggaatcggcatcgcgttcggctttatgcctgccaataaagcagccaaactcaatccgatagacgcattggcacaggattgaggttggacaaagatgccgtctgaagctgcaggaccggtcattttggagcagaaacttattggataaaaacggtttcttagattctacgttccagattcccacttgcgtgggaatgacggcggcgggggttcgatgattgcacacaacgctcgagtcccgtcattcccgtaaagacgggaattcggttcgttcggctttgcttgtttcggataaatcacggtaactcaatattccagattcccgcccgcgtgggaacggcggcggggcttcgtattgttcaatttattattttcaatcattcaatgggttaggatgtgtttgttggcttgctaactttcagggcggattggttttcaggcggcatttcccgcaaaaaaggcttggaattttccaagccttttttgcggatggattattgatttttgcggatgatttcctccagttggggcatcgggctgtagccgctttggctgcgcccgttggggaagacgagggtcggcgtgccgttgaagccgaattgttcgcccaaggaagtggtttccgcgacgggattgtcgcagatgctgccgccgaccgggaatttgcctttacgcatccaatccgtccacgctttggcgcggtcgggctgacaccataagatttgcgccttgcgcgcggcatcggggtgcaggccggcaatgggcatcataaagctgtaaaccgtcacgtcggtcattttttcaaactcgtgttccaagcgtttgcagaacggacaatcggggtcggagaagacggcgactttcagcttgccgttgccgcgcacttctttgatggctttgtccaaaggcagggaggcgaagtcgattttgttcaaatcggcggcgcgttcttcggtcaggtttttgcgcgtgtcgatgttgatgagttcgccgacgaacatatagccgccttcggcatcggtgtagataatctgcctgccgctgacgacgacttcgtaaatgcctttgaccggtgtttcgctgacgctcaacactttcaaatcttgggcggaataggttttttccaaacgcgctttcaaagaggcggcaacggatttgccggcggactcggctttgacggcgggttcggcgttggcattggaaacgggcgtttgcccgcaagccagcagcgggaggacggtaaagggggtcaagattttgattaacttggttttcatataaagatgattgcgcgtgttggaaaagcggaattgtatcaaatctctgttgcgcctgcattgcgcctaggctcaatttatcgtctgaaaatagcttccggctgttaaaatacgcaaaaaatgatttgcttgtttgtatgatttaccaccgcatcgccgtaaacgtgccgctttcagacggccttttgacttattcccattccgatccgcttcctccgggaacgcgggtgcttgtgcctttccgcaataaaaccgtggtcgggatggtgtgggaaacggatattgcgcccgatatggatatggcgcggattttgagtgttcagacggcctttgtggaagaaaagccgttgcctgaaagctggcgtgatttgttggcatttacgtcgcgttattaccactatccgactgggcaggcggtgtttgccgcgctgccgcagggtttgaaggaaacgcgcgcggtggaaatgccgcagccgccgttgttttatgctttgaacgaagcgggcagggcgcaaacgccgccaccagctcggttcaacaaaaaagcggctttgtgggacgcactgctttcgggcggaatgacgatggcagcgttgaagcaggtaaacgcgcaggcggcgaaattgattgaagattgggcggagcagggttggattgaaacaacggaagcggcgaaacctgtattgaggtcgtaccacgggcaggcttcgcactctgaatttgtgttgaatgccgaccagcaacaggcttccgatgaaattcagacggccttcggcagcttccagccgtttttgctgtacggcatcaccggcagcggcaagaccgaggtgtatttcgatgcgatggcgaaagtgttggcgcaggggcggcaggtgttgtttctgttgcccgaaatcaacctcacgccgcagcttttgaagcgggtggaaaaccgttttgccgacgtgccgaccgccgtgttgcacagtcagatggcggcaggcaagcgcacgcaggattatttgcgcgcgatgttggggcaggcgaaattggtcatcggcacgcggctggcggtgttcacgccgatggatgatgtcgggctgattgtggtcgatgaggaacacgacggctcgttcaaacaggacaacgaattgcgctaccacgcccgcgatttggcggtgtggcgggcgaagcagggcggctgcccgatcatattgggcagtgccacccccagcttggagagctggcacaaggcgcaaagcggcgcgtaccgcctgctgcaactgaccgaacgcgcccataccgccgcgcaactgccgcaagtggacatcctcaacgtaggccgtctgaaacttgacaacggcttctcgccgcaagccttgcagcttttgaaacagaactttgaagcaggtggcatgtcgttggtgtacctcaaccgtcgcggcttcgcgcccgcgctgttttgcggcgactgcggttataccttcggctgcccgaactgctccgccaaaatggtgctgcaccaacgcgcccgccaactgcgctgccaccactgcgaccaccgcgaacccatcccgtacaaatgccccgactgcggcaaccaagacctgaccgccgtcggccacggcacgcagcgcgtcgaagaaaccctgcgcaccttcctgcccaaggcagccgtcgtccgtgttgacagggacagcaccgcgcacaaaaacgactgggcggatttgtaccgccgcatcgccgacaacaaaatcgacattttggtcggcacgcagatgctcgccaaagggcatgatttcgcgcggctcaacctcgttatcgtgttgaacgctgacggcagcctgtacagcgcggactttcgcgccccggaaaggctgttcgccgagctgatgcaggtgtccggcagggcggggcgcgccgacaaacccggcaaggtgttgatacagacccaactgcccgaacatcccgtcttcgccgccgtcaaagcgcaggactacgccgtgtttgccgaaaacgaattgaacgagcggcaaatgttcgccatgccgcccttcggtttccagaccgccgtccgcgccgacgcgccgcgcgttgccgatgcgatggagtttctcaatgccgccaaagaaaccctcgccccgcttttgcccgaaagcgtttcacagttcggcgccgccccgatgctgatggtgcgcctcgccgaacgcgaacgcgcgcaaatcttcctcgaatctccgtcccgacaggatttgcaccgtgccgtgagtttgtgggcgcaggtgttgcagcaaaaccgcgacggcaaaatcagatggtcggtggatgtcgatccgcaggaggcttgattattggcaatccgatgccgtctgaaaaccgtttcagacggcatttttattccggatcgtctgtaaacgcattcgcccgaaatatcggtataaacgtgaaaagatacagtacgaatacggcggcggtcagaatcgcaggaacggtaatgaaaaatatcgggttcacgttcatcaagaaagcgcgcgagacggcggcggcgaaaaggatggggacggcaatgcggcagagtttggggtagtcgagtttggtaaagccgctgtgccacagtccggcggtcagccacaccatcatcacgccgcccatcatgccgccgagggtaatcaggtgcaggggcgcggaggcgggcaggttttgtaatttcgccgcgcctgtccacaaatagcctgcggcggcaaagagttggagcaggtaataagtgcggacgtagtgtttacgtaagagttcgtgatggtgaagctcacgcagcttggcgagcaggatgaagccgacggcgagcgcggtaaaaccggcggtttgcgcgggcagccaaagttcggcggcggcgtgcaagagcaggaaagtaatggcgatgtttttataaacgatatttggaataaaaacagggtctttcagacggcattctttcagggcttccgcgcccaaaagaatactgacgcgcacggatacgaacatcaccgccgccatatttagatgcacttgcgcgcgcaacaggttcaaatcgccgctgacggcatatgccgtctgaaaaacagtgaacgcggcaagtaacattagcagggcgaagttgtcggtgtttcggtctagccaaatcagccgggcgcagaacagcagcaacaccagccaataggcggcgacgaaaaacgaggcagtttgcggcgaaaagggcagtatagcggatgcggcgagcaataatgccgccatcaaagtcgcgacaggtttcaggttacccgaaaaacccgtccagtccaacaaagccgcagtcaaaaaaccgccgtatgccgccggcagcataagttccaagaaaatttggcggtgcaggacgatggcaccggggttgatgaaaaacaccagcgcaccgagtatggcaagcaccgccgcgccgacgaaaaacggccgcatagcaactgtatttttcaccccgtcgggcaaaaataccaaaactcaaatcaagccgtccggataccgttttcggcggtatcgttttcggcaaaataatcacgcatccgggcattcgatatcgtcagcagtttgcgcatacatgccgtaacggcaaccttatacggcttacccttggacagcaggcgttggtagaaatcccgaataagcggttcaaaacgtgtcgctgccacggtagccatatacagtgccttacgcaccgcagaccttccgccaaagcagcggcttttgaatttggtttcctcgctctccctcgggtgcggggcaatgccggccaaactcgctatccgtttgtgcgacagccgccccaattcgggcagcatcgccatcagcgtagccgtcgttatcgaaccgatgcctttgatttgctccgccacttgggctttgccgtcaaaatgcgtgtgggtgtggtcgtcgatttgtttgtccaattcgtcaatcagccggtcaaaatgggcaatcagttgtttgacgcttccgacttgcgtttcatgaacctaatgcagacggtttttctcggcagtccgcatatccaccagttggttgcggcggttaaccaaggcttccaacacttcttccacttcggtgggcgggtggtagggcatggtttgcgaaccttctttctgcgtcatcatctgtgcgaagaaggcgagcattttggcatctttggcgtcggttttggtcagcggctgcgattgggcaaactgatgcgtctgacgcgggttggcgataatcacggctatgcctgctcggcggatggctttggcggcggggatttcgagaccgccggtactttccgtcacgacgagggcgaccttgtgttttttaaggtattcgatagtatgggcgatacctttggggttgttggtttcggttttggttttagacaaagacgaaacggcgatgacgaagtttcgtttggcgatgtcgatatagtgaattaacaaaaatcaggacaaggcggcgagccgcagacagtacggatagtacggaaccgactcacttggtgcttcagcaccttagagaatcgttctctttgagctaaggcgaggcaacgacgtactggtttttgttaatccactataacagcaaccctgtcgccgtcattcccgcaaaagcgggaatccagtccgttcagtttcggtcatttccgataaattcctgttgcttttcatttctagattcccactttcgtgggaatgacggcggaaggtttttgtttttttccgataaattcttgaggcattgaaattccagattcccgcctgcgcgggaatgacgattcataagtttcccgaaattccaacataaccgaaacctgacagtaaccgtagcaactgaaccgtcattcccacgaaagtgggaatctagaatctcagactttcagataatctttgaatattgccgctgccttaaggtctggattcccgcttgcgcgggaatgacgaatccatccgcacggaaacctgcaccacgtcattcctacgaacctacatcccgtcattcccacaaggacagaaaaccaaaatcagaaacctaaaatcccgtcattcccacgaaagtgggaatctagaaatgaaaagcaacaagcatttatcggaaataactgaaaccgaacagactagattcccgcctgcgcgggaatgacgaatccatccgcacggaaacctgcaccacgtcattcctacgaacctatatcccgtcattcccacaaggacagaaaaccaaaatcagaaacctaaaattcgtcattcccgcgaaagtgtgaatctagaaatgaaaagcaacaggcatttatcgaaaataactgaaaccgaacagactagattcccgcctgcgcgggaatgacggctgcagatgcccaacggtctttatagtggattaacaaaaatcaggacaaggcgacgaagccgcagacagtacagatagtacggaaccgattcacttggtgcttcagcaccttagagaatcgttctctttgagctaaggcgaggcaacgctgtactggtttaaatttaatccactatataaaaaatttccagagaaccgatacaacagttggaacttgggtttgggaatattacggtagatgaacttggaacctctgttatgctatggtcttttatctcaattgaaaaaagcgcgaatcaaacggttcgcgcttttttcagacggtattaattattttttgtcgtcttttacttcttcaaagtcggcatctacgacatcatcgtctttctttgcagaagcattggcttgttcgctttcgcctgcttgggcttcagcttgtgcttgagcgtaaaccatttcccccagtttttggctggctgcgcccagcgcctcggttttggcatcgatagcggctttgtcgtcgcctttaactgcttcttcggcttctttcagcgcggcttcgattttttctttctcggctgcgtcgagtttgtcgccgtagtcggccaaagattttttcacagagtgaatcagggcttcggcttggttgcgggaagcgaccaattcagtcagttttttatcttcctcggcattggcttcggcatctttcaccatgcgttcgatttcttcttcgctcaaacctgaagaaccttggatggtgatgttggctgctttaccggtgcctttgtctttggcggaaacgtgcaggatgccgttggcgtcgatgtcgaaggttacttcgatttgcggcataccgcgcggtgcaggtgcgatgtcgcccaagttgaactgacccaaagatttgttggcagaagcgcgttcgcgttcgccttgcagtacgtggatggttactgcgctttggttgtcttcggcggtagagaacacttgcgacgctttggtcgggatggtggtgttcttctgaatcagtttggtcatcacgccgcccatggtttcgatacccaaagacagaggagttacgtccagtagcaatacgtcgctgcggccgccgctcaatacttcgccttggatcgctgcgcctacggcaacggcttcgtcagggttcacgtctttgcgcggttctttgccgaagaaggctttaacggcttcttgtactttcggcatacgggactgcccgccgaccaagattacgtcgtcgatgtcgccggtgctcaagccggcatctttcaatgcaattttgcaaggttcgatagagcgggtaatcaggtcttcaaccaggctttcgaatttggcgcgggtaattttcatcgccaagtgtttcgggccggttgcgtccatggtgatgtacggcaggttaatttcggtttgctggccgctggacaattcgattttggctttttcggcagcttctttcaggcgttgtagagccatcacgtcttgtttcaaatcaatgccttgttcttttttgaactcggcgatgatgtggtcgatgaggcgttggtcgaagtcttcaccgcccaagaaggtatcgccgttggttgccaatacttcgaattgtttgtcgccgtcgaggttggcgatttcgatgatggaaatatcgaaagtaccgccgcccaagtcatatacggctactttgcggtctttgttgtcgcctttgtccataccgaatgccaaagcggctgcggtcggctcgttgatgatgcgtttcacgtccaaaccggcgatacggcctgcgtctttggtggcttgacgttggctgtcgttgaagtaggcagggacggtaatcacggcttcggttactttttcgcccaagtaagcttcggcggcttctttcattttacgcaggacttctgcggaaatttgaggaggagacagctctttgccttgtgcttttacccatgcgtcgccgttgttggctttgatgatttcgaaaggcatagattcgatgtcgcgttggacttctttgtcttcaaatttgtggccgatcaaacgtttggcggcgtaaatagtgtttttggcgttggttaccgcttggcgtttggcaggcgcaccgacgaggatttcgccgccgtccaaataagcgataacggacggcgtggtgcgtgcgccttctgcgttttcgatcactttggtttgaccgttttcggaaatggccaaacaagagttggttgtacctaagtcgataccgattacttttgccatgtggataatcctatttgattttgcttattttgagaaatatgttggaacattttgtcccgatgggctgtaaatagggcgggcggcgggctgtttcaagctacagcatggctataagtatataactttatgaatatattggttttatatttgatttaatacatttggctccaatgcattcaagcataatgtttcaaatggcaggcaggtttattcatagacgatgccggcgagcatttcctgttcgttcaagttgccgtactctttttcccagtcgtgtgaagactcgatgatgtcgcattctttggaaagggagacttgttctgcatccatatctttggcgttcagtatgttgaattgttcgcacagggatgcggataaagtgatgtcgggctgtttggcttcagaacggttttcttggaaggcaaagcagaatgcggtaaatgccgcagtatagataagatatttgccggttttcttcatttttctatcctttttctgtcaattcaggattaaacctatggaaaaatctgaaaaattatgtattaagtaagaaaaatcataatttaaatttagtttatcataattgttccgttttttggatagctaaggtaaaatatatttcatgtttactttagatgattgaatgaaggggagtggaaggatatttatggaaacctttaaagacagactggtttttttatggaaaagcgaagcgaggcaggcaaaaatcgcatccgatattgaaatgacgattgcgggcttcagcaggatatggaatgaaggcggtctgccaaagtctgaaacattgaaaaaaatcaagcagttgaaggggtgtagtatcgattggctgctgaccggggagggtaatccgtttccggatgaagccccaaaaaaatcccttgcttacgatactttgggcaatgaagtcgatacggacgagtttgtcttcgtgccgagatatgatattcgggcggctgcgggatacgggcagtttgtcgatcatgaggaaccggtatttacaatggcgttcagacggcattggattgagaattatgttacccgcgatacgaaaaacctgtctgtaatttccgtcaagggggattcgatggagggggttttgaatgacggcgattcgattttggtcaatcatggtgaaaatacgccgagggacggtctgtatgtgttgcggattaatgaaaatctgctggttaaacgtttacagattgtaccgggcgggattatcaatgtgatttctgcaaacgaggcttatcctgcttttgaaatcaatttgaacgatttgaccgatgatgtggagattatcgggcgtgtcgagtggttcggcaggacgatttgagtttggggcttgaaattgcaggcggtcaaacttatctattggaacaattcctttttcaaaggcgaagcctgcttgcctttgaagggggtttgagagagaatgcagaaaatattatattaaggaataacaccatgtcggatgaaagccctattatttttactgacagctgctgtgccaaagttgccgatttgattgccgaagaaaacaatcccgatttgaaattgcgggtttttgtcaatggcggcggctgttcgggtttccagtacggatttacttttgacgaaatcaaaaacgacgacgattttgaaattgagaaaaacggtttggtctttttggtcgatccgatgagctatcaatatctggtcggtgcggaaatcgactatacggaaagtttgcagggttcgcaattcgtcatccgcaatccgaatgcggaaacaacctgcggttgcggatcgtcgttttccgtatgaccgcttggtttgtgtgatgccgtctgaacgttcagacggcatttttacttttagaaaatatattatcgggatgaattcacatataatccgattgtttgaagatgaatcgggtttcccgaaaggaacgggcggaacggtatcaggcgtatttgttcccttatgattgagatgagtaaagattaccgaaacgatttgtacgatgtatatgtttcttacccgccccaagtggatcgcgggcttatccgggagtgccttaaggagaatctcggcgaggaaaaggcggaaggattgatcgaatcgctcgattccaaacctcaagtgctggttgaggaaaaatgcacttgggcgaaacgggaagagttgcatgattatttcagctatttgggtttggatattattacccggagatatatggagttggaaacggtcgtgccgccggaggaaggggagggcgaaggagaaggcgcggatggggaaatgcccgaatatcttgaacttcacggcgggcgggaagatgatatttccgcaccttcgcaacccgaaccgccgtcccgcaatatcaaactgctggttttcgggctgctgattgcctttttgggctatctgctcggtaagattttttgattgtccgataaatgctgtattcgggattttatatatgaaatggttgaaacgcctgacggttattgtcgggactttttaccgctatcggctggcaggtctgtgtgcttcgctgatgggtagcggttggatatgcgctctgctgaaaatgatgccgcagtcgtccaaattgaaaaacgaaccgcctgctgtccgtctgcgccttgccttggaaagcctggggccgattttcatcaagttcgggcaggttttgtccacacgccccgatttgattccgcacgattacgccgtcgaactggcaaagctgcaagacaaagtgccgccttttgacgcgcggctttcgcgtgaacaaatcgaaaaatcgttgggtcagtccatcgaaaagctgtatgcggaatttgaaaccgagcccatcgccagcgcgtccatcgcccaagtacacaaagcccgcctgcattcgggcgaacaagtggcggttaaagttttgcgccccaaccttttgcccgtgatcgaacaggatttgtcgctgatgcgctttggtgcaggctgggtcgagcgtctgtttgccgacggcaagcgtctgaagccgcgcgaagtggtggcggagttcgacaaatatctgcacgacgagttggacttgatgcgcgaagccgccaatgccagccagctcggacgcaatttccaaaacagcgatatgctgattgtgccgaaggtgttttacgactactgcaccagcgacgtgctgaccatcgaatggatggacggcacgccggtttccgacatcgccaaactcaaagcagacggcatcgatttgcacaaactcgccgattacggcgtggaaatcttcttcacgcaagtcttccgcgacggctttttccacgcggatatgcaccccggcaatattttggttgccgccgacaaccgctacatcgccctcgatttcggcatcgtcggcacgctgaccgattacgacaaacgttatctcgccatcaacttcctcgccttcttcaaccgcgattaccggcgcgtcgccaccgcccacatcgaatcgggctgggtgcccgccgacacgcgcgcggaagagttggaagcggctgtccgcgccgtgtgcgaaccagtgttcaacaaaccgatttcgcagatttccttcggcttggtgctgatgcgcctgtttgaagtcagccgccgcttcaatgtcgaaatccagccgcagctggtattgctgcaaaaaacgctgctcaacatcgaaggcttgggacggcagcttgatcccgatttggacttgtggaaaaccgccaaaccgtttttggtgaaatggatgaacgggcaggtcggccctaaagccctttggcgcaacctcaaaaacgaagcccccgactgggcgcaaatcatcccttcattgccgcgcaaaatcagtgcgttgattgatgaaaaccgccagcaggaaatgcgtgatgcctatatccatttggtcaaagtgcagcagcggcaaagcctgtggctggctgtgattgcggttgttttgctgctgattttgcttttgaaataggctttgtccgaatcatcgcccgactccgcccgtttataaggaaatcggttatagtggattaacaaaaaccagtacggcgttgtctcgccttagctcaaagagaacgattctctaaggtgctgaagcaccaagtgaatcgattccgtactatccgtactgtctgcggcttcgtcgccttgtcctgatttttgttaatccactatatttccggttgcgtgggaatcgggtgtattgaataaaaggcattttgtccgactggcaagtgccgacatcggcggcatatcaaggcgcaggcttgaagcgggcaatgtcgtctgaagcccgtttggcgtttcagacggcattggtgcggatattcaaatcataaagtcgatttcggtaaactggatattttgatccatatccgccgacggtgttttgagcgatcgcgccacgggtttggcgggtacgccgacaaccgtgatggacggcggcacgtctgaaaccacgacgctgcccgccccgattttggcattgctgccgatgcggatattgcccaatatcgaggcgtttgcgccgatcatcacgccgtcgccgattttagggtggcggtcgccgccttctttgcccgaaccgccgagcgttacgccgtgcaaaatcgaaatattgttgcccaacacggcggtttcgccggcaacaaagccggtggcgtggtcgagcatcagcccgtatccgaaacgggcggcgggatggatgtccacgccgaatacttcggacatacggttttgcaggaaatacgccagcgttttgcgcccgtcgagatacagccgatggttgatgcggtgtgcctgaatcgcgtggaagcctttgaaatataaaagcggcagcgaatattcgtcgcaggcgggatcgcgttcgtagatggcttttaagtctgcttcgacgcatttgccgatttgggtgtcgctgcccaacgcctgctggtagatttcaaacagcgcgcgcacgtccataatcgggctgccgagtttgctggaaaggtggtaggcaaggacggagccgagggactcgtggcgcaacacggtttggtgcaaaaaacttgccagcatcggttcggcggagaccgcggccgcggtttcttcgcggatggtgtgccagaggtcgaaaccggttgtgtttaaatggtcttttttcatgagtgatgacgtttgaaaatcgatatggtcggcagtatcttaccgtctatattattttttcggtaggggatttgaaaatgaatttgaaattctctgcttttgcttgaagtttcttgaaaatgtccttatcttgcgcgggtaataactggattttgatttccaatttgttttaagggatacgatatgagcgaacagacacagcagcaaaacagtgaagaagcggttgaaaatgtggaggcggtggaaaccgtcgagacagtaggaaatgcggacggtgtgcaggaacaggctgccgcagagccggcttatgaggatttgcaggcgcggattgccgagctggaagcgcagttgaaagacgagcagctgcgcgctttggcaaacgagcaaaacctgcgccgccgccaccagcaggaaattgcggatacgcacaagttcgccggacagaagtttgccgtggaaatgctgccggtcaaggattatctggaaatggcgcttttggatcagagcggcaatttcgatgcgctgaaaatgggcgtgcagatgactttgaacgagttgcagaaagcatttgatgctacgcaaatcaaggaaatcaaccctaaagcgggcgataagctcgatccgaatatccatcaggcgatgcaggcggtggcaagcgaacaggagccgaataccgtggtgggtgtgatgaagaagggttatacgctgtccgaccgcgtgttgcgcccggctatggttacggtggcgcagaaggaagcctgaaggcgtctggggaataatctgatttatttcctgaagcgcgttttgcgtataaaccgatcgaagtaaagcggcaatgccgtctgaacccgcctgtcgggcttcagacggcattttatagtggattaacaaaaatcaggacaaggcgacgaagccgcagacagtacagatagtacggaaccgattcacttggtgcttcagtaccttagagaatcgttctctttgagctaaggcgaggcaacgctgtactggtttttgttaatccactatatttcggcgttaacggtcaacccgtatgccgcctgcctgtttttcttcatccagtttcttttgcagggtgtcgcaaggtgtgtcgcagtcgcacatttttttcatacccaaggcagtaatgccgccgcaactgcctttgatgctgcgtttggagaaaatatagccgaccgccataccgatgatgacggtcaggaagatgccgaaggtaaggagcagggttttcatggtgtttcctaatcggtttgtatgtttagcggagcagtttttcaaattcggaagacatggcggtgcggtagccgcctttatccctgacaatcaggaaaacagcgagtttttcgcgctctgccagctttaaggcttcggtttcgcccaatacgaataatcctgtggacaagccgtccgccgtcatcgcactgtctgcgaccacgctgatggaggcgaggttgtggctgatgggtcgtttgttgttcgggttgatgatatgggagaggcgtttgccgtttttatcgacgtggaaaatacggtaatcgccggaagtggcaagcgaacggttgttcagcgggacgataatctgcgtattgccgccttggacgatattgggctgctcgataccgatgcgccacggttcgccgcgcgcgtttttgcctttgccgtgcaactcgccgccgatttcgaccagataattttgaatgccgtatttttccagttcgcccgcaactttatcaacgccgaagcctttggcaatcgaagataaatccaaataggccttggggtgggttttgctcaaggaagcgtaatctttgccttgtttcaaaatgattttgtctatgcccgtataagatgccgcctgtttgatttgttccggcgacggttcacgggtaacggatttgtcggggccgaatccccaaaggttgaccaaggggccgacggttacgtccagcgcgccgtgtgtcaggcggttcaggcggacggcttcggcagtaacgtgtgcgaagtcgcttgaaatgcggaggggcttgccggctgtgtgttggttgaaccggctgatttcggagtcgggctgataggtggacatctgccggttgacttctttaagcgcgtcatcgatgcgtttttgtatttcggcaggtgaggggagtttgtcccgattatttgaaaggtatttgacggtataggtcgtgcccatcgtttcgccttgcagggtaacggtttgcgcggtttgttccgaacaggcgttcaggaagatgaaacccagggcaaatatcaagacgcggataaagttcggcaggcgtgtttcagacggcatagtgtttgacggttttggcaaatggtttgaattatatcgcaaaacggccggtatgtttctatgccgatgccgtctgaagggtgttcggatggcatcggcatagaaaaaggaagaaaccgaggtttcttccttttgtatttgaagccgaatatttaaccgccgaaatcgtccaagaggatgttttcgtcttccacgcccaagtctttgagcattttgatgacggactggttcataatcggagggccgcacatataaaattcgcagtcttccggtgcttcgtggtttttcaggtggttttcgtaaaccacgttgtgaatgaagcccgtgtagccgtcccagttgtcttccggcagcgggtcggacagggcgacgtgccacgtgaagttcgggaactctgccgcgagttggtcaaagtcttcgacatagaacatctcgcgtttggaacgtgcgccgtaccagaaggtaatcttacgtttggagttcaaacgtttcaactggtcgaaaatgtgggaacgcatcggagccatacccgcaccgccgccgataaataccatttcggcatcggtgtctttggcgaaaaattcgccgaacgggccggaaatcgtaactttgtcgccgggtttgagcgaccagatgtaggacgacatttgtcccggaggcgcatcaggtacgcgcgggggcggcgtggcgatacgcacgttcagcataatgatgcctttttcttcaggatacgaagccatagagtaggcacgcaaaatcggctcgtccactttggaaacgtattgccacaaattgtatttgtcccagtcttcgtgatattccttaggaatgtcgaagtctttgtaggcaacagtgtgaggaggagcttcaatttgaatgtagccgccggcgcggaaggggacttcttcgccttcgggaatggcaagcttgagttctttaatgaacgtggctttgttatcgttggagatgacggtgcattcccattttttcacgccgaacacttcttcggggacttcgatgtccatgtcggttttgacgttgacttggcacgacagacggcagccttcgcgtgcttcgcgtttgctgatgtgggacagctcggtcggcaggatgtcgccgccgccgctttttacgacgacgcggcattgtccgcacgaaccgcccccgccgcaggcggaggggataaagatgccttcgttggcaagcgcgcccaagagtttgccgccggcgggcatcgtcagctctttttcgccgttgactttgatggtgatgtcgccttcgctgaccagtttggatttggcaaacagaatcatcagtgccaaaaccaaaacgatgacggtaaacatcacgatacctaaaataatctccataccgatccctttcttataactggatgccagagaacgacataaacgccatcgccatcaggccggcggcgataaaggtaatgcccaagcctttgaggcctttgggagcgtccgaatatttcattttttcggtaatgcccgccaaagcgacaatcgccaacatccagcccaagcccgcgccgaagccgtatacaacggactcgccgaagttgtattcgcgttgcgccataaacgatacggcgccgaaaatcgcgcagttcacggtaatcagcggcaggtagatgcccaatgcgttatagagggcggggacgaatttatccaagaacatttccaaaatctgcaccaaagcggcaatcacgccgatgaaggtgatgaatttcaaaaaggtcaaatccacgccttcggcaatcgcgccgtctttgagcagcgagtaaacgagttggttgacagggacggacagcccgagtacgaaaattaccgccacacccaaaccgaatgcggtggatacttttttggataccgccaaaaacgtgcacatacccaaaaagaaggatagtgccatattttcaatgaagacggatttgatgaagaggctcaaatagtgttccatagcttattcctccgcctgttcgggtttccaggtacgcagtccccaaatcaaaaagccgatgatgaagaacgcgctgggggcgagcaggaacaagccgttggtctgataccagccgccgtcctgcacggtttggaaaacggtgtagcccaagagtttgcccgagccaatcagttcgcggacggtggcgacgacaagcagcattatcccgtagcccgcgccgttgccgatgccgtcgatcaggctttccagcggcggctctttcatcgcaaatgcttcggcgcggcccatcacgatacagttggtaataatcagaccgacgaatacggaaagctgtttggacaattcgtaggcaaatgcctgcaagagttggtcgaccagcgtaaccagcgacgcgataatcgccatttgcacgataatacggatgctgttggggatgtagttgcgtaccagcgaaatgaagaagctggaaaaaccggttaccaaagctacggaaatacccatcacgatggccgtctgaagtttggtggtaaccgccaaagccgaacaaatacccaaaacctgcaaggcaatcgggttgttgtcgataaagggtgaaaacatcaaatgtttcaagcgtttcatatcagccattattgcgctcctgctgatttcaatttgttcaggtaggggatatagccgttttcgccgaaccagtaggcgaacgaaccttgcacgcctttggatgtcagcgatgcgccggagagggcatctacgccgtgttctttgtccgaacccgcgcctttgccgacgtgcagggcgagtttgccttgtccgtcaaacagttttttgccgacgaatttttgctgccacaacggattgccgatttcgccgcccaagcccggggtttcgccttgttcgtagtaggtaatgccgttgatggtgttgccgtcgggctggatggcgacaaagccgtacatgaccgaccacaaaccgttaccgtgcataggcaggatgatttgcccgattttgccgtcttcgccttttaccaaataaacctcggtgtatttggcacggcttttgatgcctgccaaatcgtcttcggttttgatgcggatgctttgggcagggtctttgcctgcgatgcgcgcgctgaagtctttaggcgcatcggcgacgtattcgccggtcgccaaatcgacaacacgttgctcgatacgctcggcaaaggttttaccgatgtcggtgtccttatccatcaaaccggctacgctcaagatatagccttgtttgtcttggagtttttgtttctcttggatgggtttcaagccgacgaccgcaccggcaacgatgaccgagcaaatcaggctgaccgccaacacgacaatcagcgtgccgctgaagctgtctttatcgaatttcttagccattgctgcgcgcctttctgcgtttgatgttcgcttgtgcgacgaaatagtcgaaaatcggggcaaacaggttggcaaacagaatcgccaacatcatgccttcggggtaagccggattgaccacgcggattaatacgcacatcacaccgatcagtgcgccgtaccaccatttgccgacattggtaaaggaagcggaaacagggtcggtcgccataaacagcataccgatggcgaagccgccgaccaccaagtgccagtaccaaggcatagcaaacatagcgttggtgtccgaaccgatgaagttgaacagcgaagacatcgcaatcataccgatcatcacgccggcaataatgcgccaagaagcgatgcgggcaaacacgataaacgcgccgccgattaagagtgccaaagtggagacttcgccaatggagccgggcagtttgccgataaacgcgtccatccaagtgatggtttgaccggttacggcgtttttcaggccgtctgcaccgtgtgccgcccattgcgccagtgcggttgcgccggaatagccgtcaaccgccgtccaaaccgcatcgccgctcaagttggcagggtaggcgaagaacaggaaagcacggcctgccagcgcagggttcatgaagtttttacctgtaccgccgaatacttctttcgcaaccacaacgccgaaagaaatacccaaagccgcctgccacagcggcagcgtgggcggaacgattaaggcaaacagaatcgaagtaacgaagaaaccttcgttgatttcgtgtttgcgcacggtggcgaacaaaacttcccagaaaccgcccacaacaaatacagtcgcgtaaatcggcaggaagtaaatcgcgccaaacagcattttgtccgacacgcccgcttcagacgacatattgatgcccaaagcgttggcaaaggcgtaatgccagtcgttggcgatgttttgttgcagcaaatcaggcgttaacgcaccgaatgcctgcgcgccgacgttgtacataccgtagaacatggcagggaacaaagccagccacaccaaaatcatcatgcgcttggagtcgagcgcgtcgcggacgtgcgccgctttgcgcgttaccgcgccggatgtgtagaaaattgtcgccgcagcttcgtagagggcataccatttttcatgtttgccgcccggcaggaagtgcggttcgattttttccagaaaatgtttcaagcccataatcagccttccttctcaatggtttccagcactttgcgcaacagcgggccgtattcgtatttgcccgggcagacgaagctgcacaaagcgaggtcttcttcgtccaattccaagcaacccaatgcctgcgcgctgtcggtatcgccgacgattaaatcgcgcaaaagcagggtgggcaggatatccaagggcatcacgcgctcgtaagtaccaatcggcaccatggcgcggtcgccgccgttgacggctgtgttgaacttgaagagtttgtttttcaggaaatggccgagggttgtacgcgtgatggagtatttgtccggctgcggcgcaacccagccgaacagctctttgctgcggccttcttcgataacggaaatctgattgtggtagcgtcccaaataatcgtgcgcgccttgtgtaatcgcgccgttcaataccgaaccggaaatcacgcggttgtctgtgtcaaccaattcgcccgcagtaatttgcgatactttcgcacccaaaacggtacgcaagaggcgcggtttgttgacttgagaaccacctagggcaatcacgcgctcggtgttcagacggcctgttgcaaacaaacggccaatggtaattacatcttgataattgatggtccacacggttttattcgcgccgaccggctcgatgaaatgaatgtgcgtgccactcaaaccggcaggatgcgggccgccgaattcatgtgtttcgatgttggcagcattttcagacggcacgtctgcgccagctgccttacaaacatggattttgcgttcggtcaaacggctcaataccaacaggccgcgtttgaaatcctcggcggcttctttgataatgaccgtagggtcggcagccagcggattggtgtccatcgcattgacgaagatggcgaacggctcggcatcgacggcaggaattttgctgaacggacgggtgcgcagcgcagtccacaaaccggattggatcaggttgcggcgcacttcttcgccgcttaagtttgccagcgcttcaggtgcgtagcgttcaaactcgatttcgtcgttgccttcaacggcaatcacgactgactgaagtacgcgcttttcgccacggtgaatcgcggcgattttgcctgaagccggcgcagtaaacaccacgcccggattctttttgtcttcaaacagcacttggccttttttgacggcatcgccttccttgactttcatcgaggggcgcataccggcatattcttcgccaagcaacgcgacttcggtaatggccgggccgtcgtaaacggcttgctccggtctgcccgcgatgggcaggtttagaccttttttgattttaatcatatatttgcattacttgtgatggttaaggtaaaaacggcgtgttttgataccgtgtcgcgtggcatcaaaagcattgaataaattaatgtagcaaagtgttagattctatcaggaattgtacctgtttgtcagatttgctgcttttttccttgcggaagccgtttttatagtggattaaatttaaaccagtacggcgttgcctcgcccttgccgtactatttgtactgtctgcggcttcgtcgccttgtcctgatttttgttaatccactataaattgtcggaaggggggatattgatttgattatgccggaatttaaaatgccgtctgaatgttcagacggcatagcgtttacagcagtttgaaaacgaaaaagataagggtatgtacgatgaagacgggtgtcaggaaggcgaccgaccacatcatatagccgaagaaagtcggcatcggtacgccgcgctgttcggcaatggccttgaccatgaagttcggtgcgttgccgatgtaggtcagtgcgcccatgaataccgaacccatagaaaccgccagcagcgaatgaaacagggtacccgtcatcaaggcttgggcatcgccgcccgccatattgaaaaaaacgagataagtgggcgcgttatccaagaatgccgacaatatgccgctcatccaaaaatacatcacattaatcggatgacctgccgtatcgtgaaccagcgataccaccccgcccagcgcgcctgcctcgcctgctttcagaatgctcaggacgggaaagatggtgatgaagatgccgaggaagagtttgcccacttcggcgatgggttcaaagttgaattcgttgcctgcgcggacttgtttgggcgtgattgccatagatacggcggtcaatgcaatcaggatgacatcgcggacgaggttttgcagggcgtaacggctgccgaggatttcaaatcccgggtgttcgggtttccaaaggccggacattagaaccgcgccgaccacgcccgaaagcaggaggaagttccatttgccgaagatggcgattttttcgggtttttcctgttgtgccggcgtatcttgtgcaatgctttcctgtttgaagaaacggttgtcgatgaaatagaaggcggtcaacaggacagcggtgctgatcaggacgggggcgaacatatgtttgaccgtccacatgaaatctacgcctttgaggaagccgaggaagagtggggggtcgcccaaaggggtcagaccgccgccgatgtttgcaaccaggaaaatgaagaagatgacgatgtgcacgcggcgggtacggttttggttggctttcagcagcggacgaatcatcagcattgctgcgccggtcgttcccatgatagaggcaagtgccgtaccgacggcaagcagggcggtgttgagcttgggtgtgccgttcaagtcgccccaaaccaaaatgccgcctgaaatggtgtacagggcaagcagcagcaggatgaaagggatgtattcttcaacgagtgcgtgtgcgacggtatggataccggcggacgcgccaaaaaccaaactgaacgggatgaggaagagcaatgtccaaaaggcggtaattttgccgtaatggtgatgccaggtatgcgaaaaaaacaagggacccaatgcgatagacagcaaaatcagggcaaagggcaggccccacagcaggtttaggtttgcgccgtccaaatctgcggcgtaaaccgatgctgggaaaagcattagtgaaaacaggggtaggtggcgcatcgtgtttcctcgattcaagcactgccttgcgcggcgcgtgggagtgatacaggcaccgtgccgcccggacataggcggactgtgctgcctgtttgtttttgaaaaaagttttccgattgattgtaaagtaaataatcaggataaaccagtttcccaaaccggaaggcggcgggaaggcggattgctgtgcttgggaatatatgttctttttgataaataattttatttaaaacaaataaatatatgtctttaataaataatctatcgaaaacgaaaaatgaatttattttaacatatatttgcaatgaaacaggtttgcccccccccgtttgtttgcccttatccctttcagtacggcattcaagattcgggcctgcgccacatccatatggcgacaagggaacaaaaaaccgatgaaaccgccccgacccaccagcgttggggaaactgccaaaacattatcaggcaggatgcggtcatcatactgatggcgaatattttggctttgcgcggcactgcgccgttttgttcccagttatgaaccatcgggccgaaatagcggtgccggtgcagccagcggtaaaagcgcggggatgcctttgcccagcaggcggcggagagcagtacgaacggcgtggtcggcaacagcggcaaaaaaatgccgatgatacccaacagtagggaaatgcagccgcaggcaattaaaagataacgtatcattttgaaatatttttcttattgtgcggataagggcaggatgtgataccgagttttgcccagccttcatgtcccattttttccagcagggcgatattgcgttcgaatattgccgaagcgtcgggaaaggcttgtgcggctttggcaatgctgtcttcgcggatgaggtgcagcgtcggatagggagaacggttggtgtagttgccaatgtcgtctgaatccgtgccttcaaattggaaatcgggatgaaacggggcgatttggacgatgccttctaagccgttttcgacaacggcggcatcggcaatgtcgagcatatcgttgaatacgtcgaaatcggggaatagggtcgggtgaaccagcagggtggtttccagttcggtggcgggtgtattgcccagtcgctgcagttcttcgtccaagtcttccaaaaaaccgtcaaggtgtttggcttcgctgatcgcgatgcggacaaggtttttaacgtggggggctttggcaaagggacacaggttcagaccgatgacggctttttccaaccattgtccggtgtgttcggcaacagcatctttattttcggaagtattgatattcattattgtcatgtaaatgtgtttgcagattgcacgtgcgggaaaatcgggaagggcactattccttcagcaggtggttgagcggcagggaggtggtgtgtttgatttcttttaaaacaaagctcgattgcgcatcttgtacgccgtggtgggacaggagcgtatccaaaacaaaatgggaaaacgcgttcatatcggtaaaaaacgcctgaagcaggtagtcggtttcccctgtcagggcgaagcagctcaagacttcaggccattttcgaaccgatgcggcaaagtcttcccgcgcgtcttttgctttgcggatggaaacgcggataaatgcctgaagtcccaagttgacagattccggagacagcagcgcggcatattggcggacgataccggcatcttccaactgcttcagacggcgcaggcacggagaaggcgaaagtgcgacacgttcggacagttcgacattggtcagcctgccgttttcctggagaacctgtaagattttaatatcggttttgtctaaagtgagttggggcatatttgcgttccgttttaaggaattcggattgtctgtccgtatgtttgcggcaatccgcacagatggagaccatattaacatataaaaagttataccgtcatccgggacaaattttgttttcggaaaatcatgtgaaaacagaggcggtcggtttgcatctctttaagacggcttgcccaaaccgccgattcaagacataatcgggaaatgtgcaggagagtgttacacccaactacaatgtaaccaccgaaggcgcagacacccttaaatcgctcaggtatcagggactgcacattgaaacaaacaatctggagagcggcgttggaataacgtccaccgaaggggagaaggccgtctgaaccaccattcagacaaccgcgcaaagcagtgagcagactggtttgccatcatgcggatacagccgaaaatctcaggttcaaggacagatagggtcatccgcgcacaggtgcgcgggcggcatctgaacaaaaaatccggagaaacttgagaatgactgctctgaaaaccaccccatttcatcaagcccatcaagatgcaggcgcgaagctggtcgattttgccggctgggagctgcccatccattatggttcacaaatcgccgaacacgaagccgtgcgcaccgacgccggtatgtttgacgtatcccatatgctcgttaccgacgtagcaggcgcaaatgccaaagcctttttccgcaaattgattgccaacgatgtcgccaagctcgcttttgtcggcaaagccctttattccgctttgctcaacgacaacggcggtgtgattgacgacttaatcgtttaccgcaccaatgaagccgaaacccaataccgcatcgtgtccaacggcgcgacccgcgaaaaagacacggcgcaattccacaaagtcggacaagagttcggcgtcgccttcaatccgcgctacgacctcggcatgctcgccgtacaaggccctaaagccattgaaaaactcctgaccgtcaaacccgaatgggcagatgtcgtccataacctcaaaccgttccaaggcgcggatttgggcaacgactggtttgtcgcccgcaccggctacaccggcgaagacggcgtcgaagtcatcctgcccggcaccgaagccgtcgcattcttcaaagccctgcaacaagccggcgtacagccctgcggcctcggcgcgcgcgacaccctgcgcatggaagccggcatgaacctctacggcaacgatatggacgacgacaccagcccgctcgaagcaggtatgggttggaccgttgacttgaaagacgaaagccgcgacttcgtcggcaaagccgccttgctggcattgaaagaaaaaggcgttgccgtcaaacaggtcggcctgttgctcgaaaaaggcggcatcctgcgcgcgcatatggaagtgttgaccgacaaaggccaaggcgaaaccaccagcggcgtattctccccaagcctgaaacaatccatcgccatcgcgcgcgtaccgaaagattttgacggcgataccgccaaagtgctgatgcgtggcaaagaagtggacgtgcgtgtactgaagctgccgtttgtccgcaacggacagaaacagtttgattgatgcggtttcagacggcattttcatttcatatgccgtctgaaagcaggttttaattgttgtccgatacggacgtttgtagaaagcattgaacaaggcatctgtggatattgattcatgcagatgccgtctgaaaataacccctatcaatggagtatcaaaccatgagcaacaacatcccggccgaactgaaatacgttgccagccatgaatggctgcgccttgaagaagacggtacgattaccgtcggcattacccaccacgcgcaagagctgttgggcgacatcgtgttcgtcgagctgcccgaagtcggcgcgaaccttgccgctgaagagcaagccggtgtggttgagtctgtaaaagccgcgtccgacgtgtacgcaccgattgcaggcgaagtcgttgccgtcaacgaagatttgccaagcgctccggaaactgccaacagcgatccttacggtgcaggctggttcttcaaactcaaaccggcaaacgttgccgattacgacagtctgctgactgccgaacaatacgcgggcgaagtggattaaaccgcccggctgcccgacggcaaccgccggacaaacggaaactgcaccttcagacggcatttttgcggtcggaggtgcagttttttgtccgtgttttaaggaagcagttaggctataataacggtctatattcatctttaccgattttttcatgcaacttaccgctgtcggactcaatcatcaaaccgcacctttaagcatacgggaaaagctggcgtttgccgccgccgccctgcctaaagccgtccgcaatcttgcccgaagcaatgcggcaacggaggcggtaatcctttctacctgcaaccgcaccgagctttactgcgtcggtgattcggaagaaatcatccgatggcttgccgattaccacagtttgccgattgaagaaatccgtccgtatctgtacgcgctggatatgcaggagactgtgcgccatgctttccgcgtcgcctgcgggctggattcgatggtgttgggcgagccgcagattttaggacagattaaggatgccgttagggttgctcaagagcaggaaagtatgggtaagaaactcaatgccctgttccaaaaaaccttttccgttgctaaagaggtccgtaccgatactgccgtcggcgaaaactcggtttccatggcttccgcttccgtcaaattggcggaacagatttttcccgacatcggcgatttgaatgtcttgtttatcggcgcaggcgaaatgattgagctggttgccacttattttgccgccaaaagtccccggctgatgacggttgccaaccggacgctggcgcgtgcacaggagttgtgcgacaagctcggtgtcaacgccgaaccgtgcctgctgtccgatctgcctgccattctgcacgattacgacgtagtggtttcttcaacggcaagccagttgcccattgtcggcaaaggcatggtggagcgtgcattgaaacaaaggcagagtatgccgttgttcatgcttgatttggcagtgccgcgtgacattgaagcggaagtcggcgatttgaatgatgcctatctttatacggtggacgatatggtcaatatcgtccaaagcggcaaggaggcaaggcagaaggccgccgccgccgccgaaacgctggtgtccgagaaagttgccgaatttgtcaggcagcagcagggcaggcagagtgtccccttgattaaggcgttgcgggacgagggcgagaaagcgcgcaaacaggtgttggaaaatgccatgaaacagcttgccaaaggcgcaacggcagaagaggttttggaacggctgtccgtccaactgaccaacaagctgctgcattcgccgacccaaaccttgaataaggcgggggaagaagataaagatttggttcatgccgtcgcgcagatttatcatttggacaaataacggtgcgccgggaaaaatgccgtctgaagaggtttcagacggcatttttttgtgccgcctgacaacatcgtgaaatcccacattatatcgatgtaatcacaaagtatagtggattaacaaaaatcaggacaaggcgacgaagccgcagacagtacagatagtacggcaaggcgaggcaacgctgtactggtttaaatttaatccactatattatcccgtatgcggattggttttaagatttgtaaatttgatttgcatcaaaaaatcgccgatagatgattcatataatatcaatattaaagagtatcggtatatcggggatagtcatgtcctgtttttcaatcaaacgtatgtccgcgtttcgggcgcggataacggcgttttttgccgcctttgtctttttgacggcggcactgcccgcttatgcggagcgtctgcctgattttctggcgaaaatacagccttcggaaatttttccgggtgcggaccgttacggcaagccggaaggtaagcctatggttgcccgcgtttacaaaggcgatgagcagttgggcttggtctatatcacgaccgatgcggtcaatacgcgcggttattcgagcaaaccgattgatacgctgatggtgttggcaaacgacggcacgatagccggggcgaaactggtcgaccatcacgaaccgattatgctgatcggtatcccgcatttgcccgcgcccgggcgggcgatacgctcaaactggcttccggcgtatataaaaccaaacttcacattgacaaaccgattacgattgaagggcctgccgaccgttccgcaaccatcgaaggcgacaggagcgggcgtaccatagccgtacacgcgccggacgtaacgctccgcaacctgaccgttacccgttccggtatgagcctgcccgcaatggatgccggtatttatctcgaagaaactgccccgcgcgccctgattgaacacaacaatattttggataattcggtcggcgtatatctgcatggttctgccgatgcgatggtgcgcgagaataaaatcgtcggcgacgcgactttgcgcgtgaacgagcgcggcaacggcgttaccgtttggaacgcacccggtgcgcaggtcgtcggcaacgacatttccaaagggcgggacggcattttttccaataccagcacgcacaacacctacaaaaacaaccgcttcagcgatttgcgtttcgccgtccactatatgtacaccaacgacagcgaaatcagcggcaatatttccgtgggcaacaatatgggctatgtgctgatgttttccgagcggctcaaagtattcgacaatatcgccgtcggcagccgcgatcagggcattatgctcaactatgtcaactattccgatattcacgacaacattatcaacaaggcaggcaagtgcgtatttgcctataatgccaactacgataaacttttcgccaatcattttgaaaactgtcaaatcggcatacactttaccgccgccatcgaaggcacgtccttgcatgacaattcctttatcaacaacgaaagccaggtcaaatacgtcagcacgcgctttctcgattggagcgagggcggacacggcaactattggagcgacaacagcgcgttcgatttgaacggcgacggcttcggagacagcgcgtaccgccccaacggcatcatcgaccaaatcatctggcgcgcgcccgtatcgcgccttttgatgaacagtcccgcaatcagcatcgtcaaatgggcgcaggcgcagtttcccgccgttctgcctggcggcgtggtggacagcaaaccgctgatgaagccttatgcccccaaaattcaaacccgttatcaggcgatgaaggacgagctactcaaagaagtcgaaacgcggcagtcggaatggggcagggcggaaaacggttctttgaactagtctgcttcagacggcatccggattcaaatgccgtctgaaaacacaaaaggaacaaccatgaccacacatcatgtcgaattgaggaaggtaaccaaacggttcggggcgcaaaaagccgtcaaccaagtcgatttggttttgaaggcaggagaaagcgtcgggcttgccggacacaacggcgcgggcaagtccaccattatgaagctgatactcgggctgattaccccgaccgaaggcgaagtgatgcttttgggcgaacgtaccggtagcaaagcgggggcgcggcttcgcagccaaatcggctacctgcccgaaaccgttgcgctgcacccttcgctgatcggcatcgaaacgctggatttttatgccaaacttaaaaaacagccgctcacgcagaaccgggggctgcttgagcgcgtcggcatttcacaggcggcacaccgccgcgtcggcacttattctaaagggatgcgccaacgccttgccttggcacaagccctgctgggcgagcccaaagtcctgctgtttgacgaaccgacaaccggtcttgaccctgcatcacgacaaatgttttacgaagtcgtgcgcgaactcaacgggcgcggcgcgaccgtattgctcagcacccacgcccttgccgagttggacgggcacgccgaccgcattatcgtggattaaatttaatccactatatgcgggtatggcgggtttgagcggacaaatcagcctgaccgtccccgttttgctgaccgctcaggttttatgggttatcattccgcttgttttggcagccggaatttttagaaagcgacaaatatgaaaaaaaccctgttggcaattgttgccgtttccgccttaagtgcctgccggcaggcggaagagggaccgccgcctttaccccggcagattagcgaccgttcggtcggacactattgcagtatgaacctgaccgaacacaacggccccaaagcccagattttcttgaacggcaaacccgatcagcccgtttggttctccaccatcaagcagatgttcggctataccaagctgcccgaagagcctaaaggcatccgcgtgatttacgttaccgatatgggcaatgttaccgattggacgaatcccaatgccgacacggagtggatggatgcgaaaaaagccttttacgtcatcgacagcggctttatcggcggtatgggtgcggaagacgcgctgccgttcggcaacaaagagcaggctgagaaatttgcaaaggataaaggcggtaaggttgtcggtttcgacgatatgcctgatacctatattttcaaataatattgaaaaaaccggccgaaactttaaaaacgagtttcggtcggtttttcttttcttgttcggtatagtgtcggcaggaaagaaccttcacatcccgccgtaattcggcccgctcgcgccttcggggcaaatccaagtgatgttttgcgtcgggtctttgatgtcgcaggttttgcagtgcacgcagtttgccgcgttgatttgcaggcgcggattgccgttttcttcaacaatttcgtacacgccggccggacaatagcgcgtttcgggcgaggcgtattctttgtagttcacgtctatcatcgtttgcggattgttcagcaccaaatggtcgggctggttttcttcgtgcgcgagattggcaaggaagacgctgctcaagcggtcgaaggtcaacacgccgtcgggtttcggataatcaatcggcttacacgcggcggcttttttaagctgctcgttgtctttgccgtgatgtttcaaggtccacggggctttgcctctgaaaatcatctgatcgatgccggtgtagattgagccgaggtaaacgccccatttgaatgacggacggacattgcgcgcggcgtaaagctcttgatacagccagctttgttcaaaacgttgctgataatccgccgcctctttgccgctgtcgaaaccctccacttcttcaaggttttccaacaaggggaacacggcttcggcggcgagcatggcggatttcatcgcggtatgaatgcctttgatgcgcggcatattgaggaaacccgccgcatcgccgaccaaaatgccgcctttgaacgagagcttcggcaaactttgcaaaccgccttcaatcagcgaacgcgcgccgtaagcaatgcggcggccgccttcaaaggttttgcggatttcgggatgggttttgaaacgttggaactcttcaaacggcgacagataaggattttgatagtccaaaccgaccacgaagccgacggcgactttgttgtcgtcgaaatggtaaacaaacgcgccgccgtaggttttgctgtccagcggccagcctgcgctgtgcaccaccaaaccgggctgatgctgttcggacggcacttcccaaacttctttaatgcccaagccgtaagtttgcggctggctgttttggtcgagttggaaacgttcgatgatttgtttggaaagcgaaccgcgacaaccttcggcaaacagggtttgctgcgcccaaagctccatgccgggttggaatgaatcggtcggctcgccgtctttgccaatgcccatattgccggttgcaatgcctttgaccgaaccgtcttcgtgatacagcacttcggcggcggcaaagcccggatagatttccacgcccatattttccgcctgctccgccaaccagcgcacgacttcgcccaagctgacgatgtagttgccgtgattgtcgaaattcggggtaatcggcaggttgaacgcttttttctcggtcaggaacaacactttgtcctgcgttactgtgcgtgtcagcggtgcgcctttttctttccagtcggaaatcaactcattcagcgcaatcggatcgataactgcgccagccagcgaatgcgcccccacctccgaacctttctccaccacgcaaacgctgatttcgcgcccgttttgttcggcaagctgcttgagtttgatggcggcagacaaacccgacgggcctgcgccgacaatcacgacatcgtattgcatactgtcgcgggtgatggattctgtcatggcggttcctgtgtatttattattgaattgcaaatccgtaattatacaacgggaacatatagttaccaaatacaacaaaggtcgtctgaaaaccatattttcggttttcagacgacctttgtcgaaatttcaataagcacgccaccattttacctgtccgaccgcaaactccgtctgacgtttcggactgcgtgtgaaaaacgccttatccccgccggcatccctccctttcggcacaaccgccaaaatcttacctgccaaatttccctcacgggtttgccaagcatccaaaaactgcgccctgctcattgaaacatgacccagcgacgggtcggcaagcaaaaccgtattgccgtctataccgcgcaataccgagaaatgatcatccttgcggtatttcagatacacgatgacggggatttgcaactgtgcaagctgctcgaaagacagggcatagcctttcgcttcaaaacccaaatcaggcataatgcgccgcatatcctcaaacgacgcgggcatctgctccttatccagtttttttaacacgtcctcttccgtcagcttttgcccgtaaaaattgttcaaaagcgtcaccaccgaagccgccccgcaggaaaaatccaaatcctgctttacaatattgaaatcgcgcctttctttccaactctgcactttgatttttccataagcaacaggattatagtggattaaatttaaaccagtacggcgttgcctcgccttgccgtactatctgtactgtctgcggcttcgtcgccttgtcctgatttttgttaatccactataggtttccgtgcggacgtgttcagattcccgccttcgctggaatgacggcggagcgatttctacttttccgataaatgaccgtaacttaaaatcccgtcatccccacgaaagcaaaaatcccgcctgtcggatttcggtttttttgggcgtttcgggaaacttataaatcgtcattcccgcgcaggcgggaatccggtttgctcggtttcggtttttcgggcgtttcgggaaactgatgaatcgtcattcccgcgcaggcgggaatctagaacgcgggacggcggcaatattcaaaggttgtctgaaaattcagaggttctagattcccactttcgtggggatgacgggatataggtttccctacggacgtgttcagattcccgctttcgcgggaatgacggcggagcgatttctacttttccgataaatgaccgtaacttaaaatcccgtcatccccacgaaagcaaaaatcctgcctgtcggatttcggtttttttcgggcgtttcgggaaactgatgaatcgtcattcccgcgcaggcgggaatctagaacgcgggacggcggcaatattcaaaggttgtctgaaaattcagaggttctagattcccactttcgtgggaatgacgggatataggtttccctacggacgtgttcagattcccgctttcgcgggaatgacggcggagcgatttctgcttttccgataaatgaccgcaacctaaaccccatccttcccgcaaaaacagaaaaacaaaaacctaaaatcccgtcatccccacgataacagttgcgtaattgcgtagagtgggcttcagcccaccgttttttctttttcggtcgttgattggtgggctgaagcccacccttgtatatcggaactcccgtatcatagcaacaaaccgcccggccgccacccgcgcccacccaaggcacacaaccgttgcgtagcacagggagcggcagggcaacccatcgacacaaccggacagttgccggacaacacaaccgaatgtaaggcaggttgatgatgagtacccgataccattacgcaggtatagtgaattaaatctaaggggctgtactagattagccctaaattccacaccaatcccgcaggattttaagctgttgagacggtgtgccgaagttaaatcgaaattcgcattctttcaagaacagcgggaaagatttacgatcgattccgttgtattttcgcaagacgcgttttgcctgattccaaaagttctcaatgccgttaatgtggttctgacggtctgcacactccttggaatggttgatgcggtaatggataaaaccgctcacgtccaacttgtcgtagctgctcagactatcggtataaacaatactatccggcatgattttctttttgatgacagggagtaacgtttcagacttggcattatccaccacaacggtatagacccgtccgttgcgtttcagaatgccgaaaacaaccacttttcctgccgcaccgcgaccacgtctgcctttacgccgtccgccgaaatcgctttcgtccggctcgacagggccctcaaaaacctcatcggcagccaaggccaaatgatggttgataaccgtgcggattttacggtagaacagtgctgccgaattgggatggatacccaaaatatcggcggcagaacgggcggtaacttccagtacaaaaaacggagcagttctttctgtacttttttctttaatttgcagtgcgttatcttcatatttcgagggtaacatatctgctaatctagtacagccccaaaaatataccaaaaacagcaaaacaaattgtaaggatacgtataggctttgtaaaggtaaattgtgaaaaaagcagttttttaaacgaatgaaacggcttcgggctgaaatatatgctgatgccctgttcttcccgtatttctcgtgtgttgtcaaagtgcaggctgctttgaaatcggtattgccatctatgaaccaccactttgctttatttcagcgggcttgagatgtgtataagaatattgttttgaataaatttaaagaaaatgataatcgttattgacgatttttaaaggaaagcgtagagtgccaattctatgaagcaatacggtaagtaacaatgaaaatatctactgcttgggtatagagcatatttcacaacccgtaactattcttgcggaaacagagaaaaaagtttctcttctatcttggataaatatatttaccctcagtttagttaagtattggaatttatacctaagtagtaaaagttagtaaattatttttaactaaagagttagtatctaccataatatattctttaactaatttctaggcttgaaattatgagaccatatgctactactatttatcaactttttattttgtttattgggagtgtttttactatgacctcatgtgaacctgtgaatgaaaagacagatcaaaaagcagtaagtgcgcaacaggctaaagaacaaaccagtttcaacaatcccgagccaatgacaggatttgaacatacggttacatttgattttcagggcaccaaaatggttatcccctatggctatcttgcacggtatacgcaagacaatgccacaaaatggctttccgacacgccagggcaggatgcttactccattaatttgatagagattagcgtctattacaaaaaaaccgaccaaggctgggttcttgagccatacaaccagcaaaacaaagcgcactttatccaatttctacgcgacggtttggatagcgtggacgatattgttatccgaaaagatgcgtgtagtttaagcacgactatgggagaaagattgcttacttacggggttaaaaaaatgccatctgcctatcctgaatacgaggcttatgaagataaaagacatattcctgaaaatccatattttcatgaattttactatattaaaaaaggagaaaatccggcgattattactcattggaataatcgagtaaaccaggctgaagaagataattatagcactagcgtaggttcctgtattaacggtttcacggtacagtattacccgtttattcgggaaaagcagcagctcacacagcaggagttggtaggttatcaccaacaagtagagcaattggtacagagttttgtaaacaattcaagtaaaaaataatttaaaggatcttattatgaatgagggtgaagttgttttaacaccagaacaaatccaaaccttgcgtggttatgcttcccgtggcgatacctatggcggttggcgttatttggctaatttgggtgaccgttatgcggatgatgctgctgcaattgtcggtaaggatgcaaacttaaatggtttgaatttatggatgaaaaaaggtgtggaaaacctatgggatgatacggtcggtaaaaagacccgtttagagaaatttgatcgggttgcattgcaacatttcagccaatatgtagatctaattaatgaaaataatggtagattacctaacactagtgaaattgagagaagttactataaagccgttaccgaaaatggtgtttcttctagtgcagctattgatttagttattaatcgctcacttccggatatggcagatggttattgggcattaggtttggggatagaagccgaacgtatccacaatgagcaagcagtaaataatccgaacggtagcgaaagggataatagaaagcagttaatatctgctttagataaaggatttgatggatcttttaaagagaagcattttacttttttacaatctgtgataatggatgtaacaaagttaggtgttgaatatacaatagatggttggcaaaaaattggaggttggggtaatgggataatcaatgatttatataaaagtgttgtaaaaagagagtggactggaatatttgagatcgttaataataacatcaagcaatttagagatctgttcccaaatccggaaggctggatcgatgatggtcaccaatgtttcgctccttgggttaaagaaactaaaaaacgcaatggcaaatatcatgtctacgacccccttgccctagatttggacggagacggcatagaaactgtcgctgccaaaggcttttcaggcagcttatttgatcacaccaacaacggtatccgcaccgccaccggttgggtttctgccgatgacggtctgcttgtgcgcgatttgaacggcaacggcatcatcgacaacggtgcggaactcttcggcgacaataccaaactggcagacggttcttttgccaaacacggctacgcggctttggccgaattggattcaaacggcgacaacatcatcaacgcggcagacgccgcattccaatccctgcgtgtatggcaggatctcaaccaggacggcatttcccaagctaatgaattgcgtacccttgaagaattgggtatccaatctttggatctcgcctataaagatgtaaataaaaatctcggtaacggtaacactttggctcagcaaggcagctataccaaaacagacggtacaaccgcaaaaatgggggatttacttttagcagccgacaatctgcacagccgcttcaaagacaaagtggaactcactgccgaacaggcaaaagccgccaatcttgcgggcattggccgtctgcgcgatttgcgcgaagctgccgcattgtccggcgatttggccaatatgctgaaagcttattctgccgccgaaactaaagaagcacagttggcattgttagataatttgattcacaaatgggcggaaaccgattcgaactggggcaaaaaatcgccaatgcgactttcaaccgattggacgcaaacggctaatgaaggtattgcactgacaccatcccaagtagcacaactaaaaaagaacgctttagtttccctttctgataaagctaaagcagctattgacgccgcccgcgaccgcattgccgtgcttgatgcctacacggggcaggattccaacacactctattacatgagcgaggaagatgcgcttaatatcgtcaaagtaaccaacgatacatacgaccatctcgccaaaaacatctaccaaaacctgttgttccaaacccgtttgcagccatatttgaatcaaatcagtttcaaaatggaaaatgatacgttcactttggattttagtggtcttgttcaagcatttaaccatgtcaaagaaactaatccgcaaaaagcttttgtggatttggccgagatgcttgcatatggcgaacttcgttcttggtatgaaggccgaagactaatgaccgattatgtggaggaggcaaaaaaagcaggtaaatttgaagattaccagaaagtgttgggtcaggagaccgttgcattattagctaaaacatcgggtacgcaagcagatgatatcctgcaaaatgtaggctttggtcataataaaaatgtttctttatatggtaatgacggcaacgacactctaatcggcggcgccggtaatgactatttggagggcggcagcggttcggatacttatgtcttcggcgaaggcttcggtcaggatacggtctataattacgactacgctaccggacgcaaagacatcatccgctttaccgacggtattacagccgatatgctgacttttacccgagagggcaaccatcttcttatcaaggcaaaagacggcagtggacaagtgactgttcagtcctatttccagaacgatggctcaggtgcttaccgtatcgatgagattcatttcgataacggcaaagtactggatgttgccactgtcaaagaactggtacagcaatccaccgacggttcggacagattgtatgcctaccaatccggaaataccttaaatggcggattgggcgatgactatctgtacggtgccgacggggatgacctgctgaatggtgatgcaggcaacgacagtatctacagtggcaatggcaatgatacgctcgatggaggagaaggcaacgacgccctgtacggctataatggtaacgatgcactgaatggtggcgaaggcaatgatcatttgaacggcgaagacggtaacgacactctaatcggcggtgcaggcaatgattacttggagggcggcagcggttcggatacttatgtcttcggcaaaggcttcggtcaggatgcggtctataattacgactacgctaccggacgcaaagacatcatccgctttaccgacggtattacagccgatatgctgacttttacccgagagggcaaccatcttcttatcaaggcaaaagacggcagtggacaagtgactgttcagtcctatttccagaacgatggctcaggtgcttaccgtatcgatgagattcatttcgataacggcaaagtactggatgttgccactgtcaaagaactggtacagcaatccaccgacggttcggacagattgtatgcctaccaatccggaaataccttaaatggcggattgggcgatgactatctgtacggtgccgacggggatgacctgctgaatggtgatgcaggcaacgacagtatctacagtggcaatggcaatgatacgctcgatggaggagaaggcaacgacgccctgtacggctataatggtaacgatgcactgaatggtggcgaaggcaatgatcatttgaacggcgaagacggtaacgacactctgatcggcggtgcaggcaatgattacttggagggcggcagcggttcggatacttatgtcttcggcgaaggcttcggtcaggatacggtctataattaccatgtggataaaaactctgacactatgcactttaaaggatttaaagcagcagatgttcattttatccgttccggaagtgatttggtgcttagcgcttctgaacaagacaacgtacgtatttccggatttttctatggtgaaaaccatcgtgtagatacatttgtctttgatgatgcagctatcagtaatccagattttgccaagtatattaatgctggcaataatttggtacagtctatgtctgtgttcggttctaatactgctgcgacaggaggaaatgtggatgccaatatacaatccgtacagcagccgttattggtaacgccatctgcataaggagcctaattacattcatggcttaaactgaaaaacagcaatcaagtttattttgattgctgtttttcttaatattgggataagggtcgtattttaattaaccttaatcggtgcacttctagcaatatagtggattcacaaaaaccagtacagcgttgcctcgccttaccgtactatctgtactgtctgcggcttcgtcgccttgtcctgatttttgttaatccactataattttcagacggccttttgccttttcaaattcaaaccaatcaaacggttttattgcttcatcgcgttggtcaaggctttgatgttgtggcggtacattccgatgtaggtgtctgcgggcgcgttgccgagtgcgtcggaatacagtttgccgctgacgttgacaccggtttctttggcgatacggtcaaccatacgggtgtccttgatgttttcggtaaagacggctttgatgccttcgcgtttgatttgtcggatgatggcggcgacttgtttggccgaaggctcggcttcgctgctcacgccttgcggggcgatgaattcgatatggtaacgtttgcccatataggaaaaggcatcgtgcccggtcaggactttgcgtttggcagcagggacggcattaaatgcggcttgtgcgtcgctgtgcagttttttgagctgcatttggtagttgcccaagcgttgttgataataaactttgccttcgggatcggcctttatcagggctttggcaacgttttgggcataggcggacataaggacggggtcgttccagacgtgcgggtcatattcgccgtggtcatggtggtgtccttcgtggtcatgatcgtggtcgtgatggtgtccgccttcttcttcggctttgaggggttggatgcctttggtcgcttcggtataggatactttgctttgtttgacggcgcgttgcacatcggcagcttcaagtcctaagccgttgagcaggacgagttttgcactgcggatttttttaatgtcgccactggtcatatgataggcgtgcgtatcttggttggctccgaccaaactttgtatggatacgcgctctccgccgatttgtttggctacgtcgcctaaaatgctgaagctggttacaaccggcaggggggcggcagttgcggaggcggtcagcaatgcggcaataagggtgagtttgaggtgtttcataactgttctcctgtgatataacgtaacatctgttatggtaaaacaagccgcctgtttgttcaagcggcttgcggggtcaggtggtgtggtggcggtggtttttgagccatttggtcagaatgccgccttctttgccgagtatgacggaaaagagataaaggacgctgcaacagaggatgatggcgggaccggaaggaatttcgatgtggtaggaaatgagcagtccgctcaagccgcacagcagggctgtcagaacggataggaggatgagtgcgcccatatgcttcgcccacaggcgggcggtaatggctggcagcatcatgagtccgacggacatgagtgtgccgagggcttgaaagccggatacgaggttcatgacgaccaggacgagaaagaggacgtgccaaagcccgcctttgccgccgacggatttgagaaacagggggtcgatgctttcgagtacgagcgggcggtagatgacggcaagggtaatgagcgtgaggctggagacggcggcgatgagctgcagggcaggaatatcgacggcaagtacagagccgaaaaggaggtggagcaaatcgacgctgctcccgtttttgctgacgaggactacgccgatggcgaggctgctgagataaaaggcggcaaagttggcatcttctttcagggtggtgaagcggctgacgagtccggcaagcagtgccatcagcatgcctgcggctacgccgcccaaacccatggcgggcaggctcaagccggcaaacatgtagccgacggcggcaccgggcaggacggcgtggctcaatgcgtcgcctatcaggctcatacggcgcatgacgaggaatacgccgacgggtgcggcactgagggacaggcagaagacggatgcgagggcgtagcgcataaagtcgaattctgcaaagggggcaaggagcaggtcgtagagattcatggtttttcggtttcagacggcatttatgaggcgcaccagtcggggctttcctgttgctgcattttggcgttggcttgggcgaggtagggttctgtcagaatggtctcggttgcgcctgccgcaattttttcgcgggcgagcagcagggtattgggaaagtaggcacggacttgttcgtaatcgtgcagtacggcgatgatggcgtgtccgccgcaatggcatttctgcaatacgtcgagaagctcgtaggttgtccgtgcatcaacggcattgaagggttcgtcgagcagcaggaatttggcattttgaaccagcattcgggcaaaaaggacacgctgaaattgtccgtttgagagataggcaatctgacggtcggcaaaccgttgcattccgacgcgctccaaggcttcgtgaacgcgttgtttttgagcggtatttatccctttgaaaaagccgatttcataccatagccccattgccgccaagtcgaaaacggtcataggctgggagcggtcgatatcggactgctggggaaggtaggcgatgttctgacgggtcaatccgtccagccggatgctgcctgtatcgataggctgcaatcccatcaaggatttgagaaaggtggatttccctgcgccgttgggaccgaaaaccgcccacatactatgttcttcaaaagtaatgtccacatggtgcacggcaggtcggcggcggtagctgacggtcaggttttcgacaatgatgctcatgcggatactgcccaaaagtaaacgccccataaaagggatacggcaatcagggcaaggatgaggcggaaggtcaatcctgatagtaaaagggaaggtgtcatgatgatttgcggttttgaaagggaaggcggtaaagcgtttatcgttatatggctgatatgatactgtataacgtttggtctgtaaattatgcttgaataggcgggagtgattgttaatcaaggtggatgaggggcaggcatatcgttgacttgccggcatcgcagcaataagaaatgccgtctgaaggttcagacggcattgggggaaaacggtttgaatcaacctttgcgtgcaggcagtttttctttgatgcgtgcagctttaccggtcaggccgcgcaggtagtacagtttggcacggcgtacgtcgccacggcgtttgacttcgattttttcgacggtcggagagtacagttggaaagtacgttcaacaccttcgccgctggagattttgcggacgatgaagttgctgttcagaccacggttgcgacgggcaataaccacgccttcgtaggcttgcagacggctgcgggtaccttccacgacgcgtacggatacgactacggtgtcgcccggtgcgaattcggggatttctttattcaggcgggcaatttcttcttgctcgagctgttgaatcaggttcattgtttttttcctaaattatgattggatttcccgttgctcttgccggatggtttctaagaggcgggattcctttgggattaaaacgcgcttttccaaaagatcgggtctgcgctccaaggtgcggcgcagcgattgttccaaccgccattccgctatcaagccatgattgccggaacgcaatacttccggaacagccataccttgaaattctaagggtttggtgtagtgggggcagtccaaaatgccgcttgagaacgaatcctgttcggcagactgcatatcgcccaatacgccgggtacgagcctcaataccgcatccatcagcatcatggcgggaagctctccgccggaaacaacgaagtctccgatgctgatttcttcatcgacgctgctttgcagaagcctttcgtctatgccctcataccgtccgcacagcagaatcagatgcggaagttctgccagttctaccgctttttggtgtgtcaagcggtttcccttgggggctgaggtagatgacttttgcagcttgggaggattgtgttttggcgtgttctattgccgcatgaagcggcggagccatcataatcattcccgggccgccgccgaacgggcggtcgtcgatgtagcccaatctgttgtcggcaaactttcggggattgactgcttcaaactgccagattccctgtctgttcgcgcgtcccgttacgccgtagcgggtaatgctgtcgaacatttcggggaaaatggtaactgcctggataagcatcagtagtccaaaccccagtcggcagtaatggtcttgctgccggtatcgacggtttcgatatattgggaaacgaacggaatcagaatctgcccgtgttctccgtcaatcatcaatacgtcgtttgcgccggtttccatcaggttgcttaccttgcctaaaacggtatggtctttgttgacaacggtcatgccgaccaagtctgtccagtagtattcgtcttcttctgtcggggcgaatgcttcacggggtatttcgatggtgtaaccgcgcaatgagaatgccaagtcgcggtcgtttatgccttcgaatttgacttggagttcgccgttgacgacttttccggcttcaagggtaacgctgatggttttgccgtccttgaccaaatgccactcggggtagtccaaaaggctgtcggaatattcggtgttggcggcaattttcaaccagccttttatgccgaatacgcctttgatgtagcccatggctacccggttttgagtgtctgtcatggcggcaaatgcggattaggcggctttttgttctttaatcagttttgcaacggagtcgctgacttgcgcgccttgtgcaatccagtggttcaggcggtctgcattgaggcggacgcgctcttgtttttcgttggctacggggttgtagaagcctacgcgttcgatgaagcggccgtcgcggcggctgcgtgagtcagtaacgatgacgttgtagaaggggcggtgtttcgagccgccgcgtgccaaacggataactaccattttgagtccttttgagaaaatcggatatatggaaactgccgattttaggttattttgtggtcggtgcgcaagtttttatttgttttttctgttgttttgtctgccgcaaggttcagatatgcgcggtacaggtttttttcggtgtccgattccttgagggtaaatcctgatttttcagcaagtttgatcatgggggtattggttttgagaatgtcggcactcatagtccggtagccttgctgtgcggcggtttggatgatgagttccatcattttctgtgccagtccgctgccgcgcatatgttccgccagtgtgatgccgaattcgcattcgttgcgattcaggcggctgtggcggacgacggcgacgatgttgctgtcggcatcctttgccgtccatgcggcttcacagtggtaatcggggttgcacaggcgtgccaacgtggctgcgggcagttcgttggtgtgggtcatgaagcgtgtgtaccgtgcttcgggaccgaggctgcggacgaactgctgtttggcttctgcgtcttcgggcaaaatgggggtaatggtaacggtcgtgttgtttcttagggacagtgttttggggtatgctgcgggatagggggcaagtacgttgggtacggctgctccggtttcggttttgctgccgagcagttctgcggcggcttcgcttgtgtggcggagaaattcggcggctgtcgggtttttgtgtttcaggtatgcggcggcactctgcatttttgcggcggcatgttcgagggtttgggcggctttgcctgtgttcttgcgtttgggcgtgtcgtgtgtttcgggtgtctttaagaggaaatcgctgctgtattgtccgccgttgaggttgagggtgatgccgagaatgtgttggcggtattcgggaatgacggtcagtgtgtgcaggaactggtcgagggtttgtgtgccgtcgagttcggcaaagcgggcaaggtggcggctgtcgagcgtggtaaacggcgggagtacggcagtggtttgtccgttgcagcgtgcggtcaggatgtcgccatagagggggtggctgtcgaattggaattgtacggcgttatgggtggtgtgccggtagggggggaggtgcagggcttcggcgagcagggaggggtttgccgctgcaagggcttttttgatgttttggggttgcggtgttttcagacggcatggctgcggcggtgcaatgtcgagctgtgcctgtttcagggcggcggcggtgttgcggtaggaaagggtgcggattgcctgagtgggggtgtcgaaatgggttatgccgtctgaaaaggggctgctgacgagcaggggtttggcggtctgttcggacaggcggataagggcgcgtgctgtttttttgtaatcctcgtgtccggagggactgaggatggttaggacggcttgggtgtcggggtgggcaagctgacgtgaggcgatgtcgtggcagattgagggtgtgggtgtgccggtcaggtgtccgttgcggatgtggtggggaaggttgggaaagtggagggtgaggttttttggcgcgtgcgcgtgcagccattcggcaggcgtgtcggacaggatgtcgagtcgggacaggggtggaaggtcggacagttgggcgcgcagtgcggcttcgaggtcgtcggcgttgaaactgacgaggaagttgcagtgtcgggcgaggcagtgcagtacggcacggtcggtttctgtcgtgcggcaggtgatgtggagaatcagcggcgtatggcgggtaaattggcggattgcgctgaacagtttgcgctgatcctcttcagggttgtggtgtaggacggcggttttggtgtgcaggctgtgtccgaagcggttgagccaatcggcggatgtgatggggctgatgccgggatgcaggctgatgtggcgggatgtgccttgacggagtttgttcaggatgttgtcgatttggcggctgacggcggcattgccggtcagtatggcggtatggcctgcggcgtatccgtcttgggtactgatgttgagtccgagtgagggcagttggatgcctgcggtggtgcaggcggtgatgttgagtccgttgccgtggtgtttgcggatggcagtttcggcggtgtgcagttctgcggcagacaggttgtcccagtcctgtatgaggatgatgtgtcggagctgctttttgcggcaggttttgaagagggtgtcgtaactgtcgggtagggtaacggcaataatcaggtctgcattgccggggattttgttgaggctggtgtaggcgggcagtccggctatggtgtggtggcgcgggtttacgggggtgatttttccttgaaagggcgtactcagcaggttgctgagtacacgttcgcccaggctgtacggttgttcgctcgcgcctatcaggatgatgtggttgggcatgaagaagtagcccggatcggtttgtgccgacatgatatattcctttgcggacggtatgtgcgtgatttttggagagacacccgctgtgtgtttgttttggggtaactgtttgtgcaatgccgtctgaagccggttcagacggtattatggtcagttcgcacttttttctgttttggaaccggtttttttcttgggcaggataaagcgcatccgcagaccgttcggtttgatgttttcggcgatgattttgccgcagtgctgttcaataatatgttgggtcaatgcaagccccagtcctgttccgggtttgttggcactggagtctgcacggtagaaagcggtgaagatgtgcgggagctgcatttcgtccacgccggggccgttgtcggtaacgtcgattatccagtgtttgtggtcttgtccgatgttgatcaggatggtgctgccttcgggactgtagttgacggcgttgcggatgacgttgtcgaaggcgcggtacaggtagctttcgttggcaaggatggttgtgttttcggggatttttccgtcggcagacagggtaaccgtttgtccgtttttctgggcaatgctttgattgtcttctaccaggttgcccaggaagggcaggagtttcaggctttctttttccaaagccatattggaagtttcgagacgggacagggttaacagttccccggccagcgtatccatgcgggtcagttcgccttccagccgtttgagatattgctcctgtttttggggctgcgcctgaatcagtccgacaattgcctgcatgcgcgcaaggggagaacgcatttcatgggagacgtgatggagcaggtggcgttctttggcaacgagtttttcgagtttttccaccattttgtcgaattggatggcaagatgggacaattcgtcgtcgcggtcgtcgacctgttgggagatacgggtttcaagttctccgtttgccaccctgtccatgccgttgcctaagattctgatgggtttggcaatgttgccggcgaggatatatgccatcagcagtccgacgatgatgatgaaggacaatatgatgagttcgtgccaaatcggggcgagcggcaggccggggatcaacagggggctgggcaggcggcgggcttggagtttgtcccagtctttggtgaagaacaggtattcttcgccgaagcggtcgtattcgatatggacgaggttggaatgcgggtgtccggcggcgaaaagccgggcgcgttcgatggtatagctgtcgatataccggttcaggatatcttttttctcgtcgccctgtataacgtacacgcccgatgagacggggctgtctttccattccgtcaggatttcgcgcgcacccgcgtccccgcgtgcccggaatgcggaaatgatgctgcccatcaaagtggtttcgatggtgcggcgttggttgaactggttttcggcaagggtgttctgcaccagccagaaagaaaaactcgccacaaagattgcacagacgataaccgcgcaaaatgtggcgaaaatgcgttggaacagtttcatttatctgtttatttcagtttttgacaaacaggtagcccaagccgcgtacggtttgaatcagagaggcatcgcccaacttgtggcggatgctggagatgtgtacgtcgatactgcggtcgaattttgccagcttgcggtcgagtgcttcgacggacagggtttctttgctgactacctgtccggcatggcgcatcaggacttcgagcaggttgaattcggtgctggtcagttcgagcggcatgtctttgacggatgcctggcgtttggcggggtacaggacgacatcgctgacggagatgctgttgggtgcgttgttctgttcgccgctgtgttgtgcgcggcgcaggatggcattgatgcgtgccaagagttcgcgtggtgtgcagggtttggggacatagtcgtccgcgcccatttccaagccgatgattcggtcgatgtcgtcgcctttggcggtcagcatgatgatggggacggtgcttcgggcgcgtacgtttttcaagacatccaagccgttcattttgggcatcatggaatccaatacgactacatcgtactgcccgctcaggatttcctgtacgcctgcttccccgtcgggaacgctgcggacgttcagaccttcggcgctcaggtattcggtcagcagttcggttagcagggcatcgtcatctacgagtaatacgcggctcatggtgtttccttttcgtaagggtatgccccgaccctgtttcgggcggggcgtgaaaagattgtttgacggtttatcttaacacggctgcaatgttttttgatagcgtatttccctaccggtttgctgttttttgcaatgtcttgcatggagctttacatttcgggcggtatccgcatccgccggcgcgggtcatttgcagggttttgcttccggatgaccgggcgcggcggcgaaggctttgcagtctttgagcagttcgggtagcagcggcgcccatacgggcagtttgcggatttcgtcggcgtatcggggcatcaggtaggggtaataggactgtgtcgcccgcatccattgttttgcttctgcaactttgccttgccgcatcaggtagagggcgatgcggtaggtggcggagtgggggcggtattttagtgatttgagggttgcttcttccgcccaagtctgggtttcggggtattccggcagggcgaagtttacgagggagaagtcggcataaaaggacagcatcggactgtttgcggaaatatagcgcaactcgttgattttccggttgagggttttggcactgtcgtcagtggcgggggaaaaggcgttaaccagccgggtgtatgtccagtccaagtgcagcaatcctgcgaatatggcggcggaggcggtcagtatgccgagattggcggcttttttgaaggcgatgccgtctgaagcctctgcgggggacaggaagagcatcagtccgaaagggatgaggaaatagacataccacaaaggatattcgagcatactgtggcacatactgacggcaagcgtgcagattaggaaaagcgatgcgggggtcagggggcgtttaagcagcccggcaatgcccgtcagcagggttgcggcaaccagaagcgtgccgctgattcccatctctgcaaggagttggaggacgatgttgtgggaatgggtgaacaagttgctgaggaggttgtcgtatatgttgtgctgttcggcattgatgaggaaggtttgttgggcaaaactgttccagccgtgcccgaatatcggggcggactggaaggcggcaagggctttattccattcgatttggcgcggcaagtctgtgaaaccgccgttggcgacgcgttcgacggcagtttcgtagcggatgccagtaaaggtttccagaatggtgttcatggaaaattggaacagcgcggtaaggaatacggctgcggctatgccgagcatcgtccgcctgttggatttgtccgaacggaaataccagaagggaaggatgagggcgatggcggctatgtaggtcaagatggtgcgcgagttgaccaaacctaaaacggcggtctgcataatcaggcagattacgccgagggcggcggggatttttcgttgtccgttgaggtaggcggcggcgagtatgccccacatgaggtagtgtccgaggttgttgcgctgcccgatgtgtccgattacgccttgcccgctgtaaacgatgatgttttgaaacagaggggtgtcttcccagccggcaaactggatgacgacgatgcaggattgaagcagggagccgataagcagcgaccaggcaaacagggtcacgatgcgttcttgtccgaagtgtgcgaccaagctccggcaggcccacgcgctgacggcgagcaagatgaaaatccaagagacgatgtcgttcataccggggtaaatcaggttcatcaggcgtgcctgaagataccaaaacgccgccattgcaaacagaaggaagctgatggcggggattttgacatcaaacagtttttttcctgccgtgaggaacaacaggacaatcaggccggctgcggcggcggcatcgtggtaaaagtcgggcgacggtttcagtttgagcgcgaaggtaaaggggacgatgcctatccaaaggaagcagggcaggatgtaaatcggcagtttggcggcggggtgcgcgccggatacggtcgtttcagcgggcattgtttgtttccttgtattgtttgacgaacgacaggcaggatatgaagaagatgatgctgaatactgcggaaagcgcggcgcaaatctgttctgcgggataggcgtcgaacaggcgcatgacggcttcggcaaagtaaatcagaaccagcatggagctgtattggtaagtatagattttctttttcaagatgcctgaaagcggcagacagagggggagggctttgagcgcgagccacgagccgcccgggcgcaacggtgcaatccacagttcccaggaaagggacaggattatcagtgcgatcaggctgaaagaggcaaggaggtaagcggtttgtctgttcacggcggtctttacggtttaagggcggacaagggggagcggtatcccaaatcctgcaacatcgaaacggtttcataaacgggcagtcccataatgccgctgaagctgccttcgatagattggataaagatgccgcctatgccttgtacggcgtaggcaccggctttgtccatcggctcgccgctttgcacataggcggaaatttcttccgaactcaggggcttgaaaacgacgcggttggtttggacgcggcttgacgttttgccgcgataatgaatgcagacagcagtcaggacggtatgttgtttgccggacaatcggtttaaaaattcgattgcttcggcttgggagcggggtttgcccaatatgatgccgtctgaaacgacgcaggtgtcggcggtaatcagggggaaatcgggcattgtgccgttggtttcgcaaaagagggtcagggcggttcggtttttttcttctgccatcctttgaacgtaagcgaaaggtgtttcgccggctttaacggattcgtcgatgccggcaggcagttggatgacgcggtagcccaactgtgtcaggatttccattcggcgcgggctgtttgaacctaaatagagggtattcaaaggtattccttaatctgttgcggtatgaggcggaggttcggacggcatagtgtcaggttgttgcaggcggccgtatgtcgccatcctgttctgaacgtggcgtgaaaaagcgtccgaaccaaatacctgcttcgtataagagaatcagcggaatggcaagcagggtttgtgaaatcacatcgggcggcgtgatgatggcggcaatgacaaacgcgccgacaatcacataggggcgggcgcgtttgagctgtccggttgttaccacaccaattttggttaacaggataacgacaatggggacttcaaacgttgtgccgaacgcaacaaacatccccaagatgaaggagaggtatttgtcgatgtctgtcgccatattgacaccgacaggggtaacgctggcaaggaatttgaaaatgacggggaaaaccaaaaagtaggcaaatgccatgccgatgaaaaacaggctgacgctggagaggacgagcggcgtaatcaggcgtttttcgttttggtagagtgcgggcgcgacaaatgcccagatttggtagagcgtatgcggcagcgaaattaaaaatgccgccatcagggtaactttgaccggcacgaaaaatggtgcgatgacatcggtggcaatcatgctggtgtctttgggcaggtttgccatcagcgggtcggcgataaaagtatagagttgttgggcaaacggcattaggccgaaaaagcagactaagatgccgacaaccgtccacatcaggcggcggcgcagctcgatgagatgctcgacaagcggttggacgggttgttcgttttgtgtttcggacaccggattgctctctttatgatttacggacgcgcaatttaggtttggcgcggtgtttcggacgaaaatcgcgtttgcggcttattgcctgtttgcgcagggaagtggtgtgcggaacaggcgtttcaacagcagtatcgatatagctgacttcgacggtctgtacgacgggtgcggcggcagaagcagtcaggtattcccgccatgcgcggtcttggtcggtttccgcgggttcggctgtactgccggtttgcccgctgtccccaagggtttcggcggaagcgtaggaacgttcggacggcataacgtcggaaatgccgtctgatagggtgtttgccgcatcgggaagcggattgccgttttcatcgacaccgaaatcggcaggtgtccgctgttcgggcagtttttcccaaggcttcagaccgtcggaaatgtcgtgcagattgccttccatatccgtaccggtttctttgaggctgtctcgaacctgagcggcggcagcttcaaattcctgctttgccttcctcagttcttccagttcgatttgagtgtcaaattcctgtttgacgctgccgacaaagcgttgcagcctgccgatgagccgtccggcggtgcgggcggcctcgggcaggcgttcggggccgaggacaatcagggcgataatgccgacaaaaaccagctcgcccaaaccgaaatcaaacataaattacgctttgtcttcgtcttttttgtgttcgattacatcgtctttttgggcttctttgccgtctgtaccttcgttcagcccctgtttgaagtcatgaaccgcaccgccgaggtctttgccgacgttgcgcagttttttggtgccgaatatcaaaacgacgataatcagtacgataatccagtgcgtcagagaaaaactgcccatgatgtatccttaagtaagtattaggggttgattgtgaaataacggtttatacgggtgtacccatgatgtgtatatgcaggtggaagacctcttgtccgccgccttttccggtattgatcagggttttgaagccgtctgccagtcctgccgctttggcgatttcgggaactttcaacatcattttgcccagcagcatctgatgttcgggcgcggcgtgtgccaacgaatcgaaatggactttgggaatcagcagcagatgaaccggagcagcggggttgatgtctttgaaacaaaccatttcgccgtcttcatagacggtttgcgccggaatgtctttggcggcgattttgcagaaaatacagttgtccataacggctccgatgccgtctgaaaagcggtcagacggattgaatgtgggaaagtgcggattttaatataaattcaagattctgtgcgagcggctttttcgaccagccccgacagcccctgacggcgcgcaagttcgtccaatacgtcttccgccttcaggtcgtggtgtgtcagaagaatcatggtgtgaaaccataagtcggcaacttcgtaaaccaggtgggacgggtttttgtctttggatgccatcaacacttcgcccgcctcttcaatcactttttttaggattttgtcttcgcccttatgcaagagctgtgcgacgtaagattcggacggattggcagattttcgctgggtgatggtttgttggatggcggatagtacggaatctcccatgattttccttctgtttgtttctgtttgttcggaatgataggctaaacggctgctctcgggcaatacgcctgttgcgcttcgttggaaaatgccgtctgagcgtttcagacggcatttgtgctgttgcaaatgtaatttgcttacaggtttggactcacaataattttaacggcggattcgttgttgtgaatcagacgctcgaagcctttggaaaccagctcgtccagcttgatgcgctgggtgatgaaaggctcaaggttgattttgccttcttcgaccagtttgatggtttcggcgtggtcgttgcagtaggcaatcgtgccgcgcacgtccaactctttcatcacgacgctgtggacgttgatggtggcggggtggctccagatggatacgataaccaaattggcggcaggtttgcaggcttcgaccaaagtatccaacactttgttgacgctggtgcactcaaatgccacgtccacgccttcgccgttggtcagttttttcacttctgcaacaacatcgacttcggacgggtcgaggatgtagtcggcaacgccggattcgcgcgctttgtctttgcgtgctttactcaactcggtgatgatgactttgatgcctttggctttcaacacggcagccaacagcaaaccgatcggacctgcaccgccgaccaatgcgacgtcgccttctttcgcgccgctgcgtacataggcgtggtgtccgacagacagcggttcgatcaaagcggcttgatccaacgggattttgtcggaaatcggatgcacccaacggcgtttgacggcgattttttcggacagaccgccgccgcagccgcccaagccgataaagttcatatctttggagaggtggtagttgctgccttctccggtcggtacgtcatcgcggatgatgtagggttcgaccacgacgtgttggccgactttgatgtcgtccacgccttcgccgacggcatagaccacgccggagaactcgtgtcccatcgttacgggtgcggactcgccggaaatcgggtgcggatgaccgcaaggcggaatgaaaatcgggccttccatgaattcgtgcaggtcagtaccgcagatgccgcaccaggcgacattgatgccgacagtgccgggggcgacggtcggttcggggatgtcttcgatgcggatgtcgcctttgtcgtaaaaacgtgctgctttcattgtaacgctccttgttttcaagtaggaataccgtctgaatctggcaggcggcggttgaaatgggaatggcgtgaagaagcttgaccgtttccagttgaatctgtttagatattttactacaagaggagacctttgcaataacataggttactaaaattttatgctcaatctcattttcaaaatgcaaaacttttctgatttttcctactttttgctcaatattaggaaggttttaggcaattgaaaattttttggcgcatttttatgcgtcaaatttcgttaacagactatttttgcaaaggtctcaagagatgtgtttaagcacgcggaaggctttctgtttgcgtcaggtcaaataatgatgtcgtctgaaaaccgaatcggcttcagacggcatttatagtggattaacaaaaaccagtacggtgttgcctcgccttagctcaaagagaacgattctctaaggtgctcaagcaccaagtgaatcggttccgtactatctgtactgtctgcggcttcgtcgccttgtcctgatttttgttaatccactatatgtcgtaacggtcggattgggtaggttggcgcacctgtccggttttcggtttggcaaaccgtttttttgttgggtccagtgttttctgataggcggttgcggcatcggatttgcccagccctgccagcacgcggatatgctcggcagcagattgtgccagaggttcaagggtgtagccgccttcgagtacggatatgattttgccggggcagcccgatgccgtctgaatgattttgtgtgtcagccaggcaaaatccgcctcgtgcaggttgagcctgcccgattcgtctagacggtgtgcgtcgaatcctgccgacagcagcaccagttcgggtttgaatgcggcaagtcggggtagccactgcctgcggacggcttcgcggaatgtgcggctgcccgttcctggcggcaagggcaggtgcaccatattgccgccgtcgggcatatcgttgttttcggggaaggggaaaaggtcggtttcaaacaggttgaaaaacaggatgcgcggatcgtctttgaatatttctgccgtaccgtcgccgtagtggacatcgaaatcgatgacggcaatgcgtttcaggcggtattcggcaatggcatgcatgacgccggcggcaacgttgttcagcaggcagaatccgccggctttgccgctgcccgcatggtgtccgggcgggcgggcggcgcaaaaggcatgccatgctttacggttcatgaccatgtcgactgcctgaactgccgaaccggcggcaaagcgtgcggcagacagcgatcctgtgctgattgcagtgtcgttatccaggcgggaaatcttgcctttttggggcaggcaagattccaaacggttcagatatttgctcgagtggacaagtgcgaggcgcgtatcgctgatttcttccgcctctatggtttggaggtgctgccaaataccggcgcggcgcaatgcctgctcgatgcagaggatgcggtcgggcgaatcgggatggtttgcgccgggttcgtgcccggcacaggcgggatgcgaaatccatgcggtgcgggcgtttttgcccaaaaaaaggcgcaacagtgcatagaatttcaagattaggcgggtcaaggacatgggtttgtggacgggcaggctgcggtatacggtcggtacggacggcaaacccgatatattgtttacggtcttatgttattatatacccctctcgattttcaaccatattagaaagaacggataaattatgaatcaagctgttgcacaatttgctcctttagtgttgattatggtggtgttctacttcctgatcatgcgtccgcagcaaaagaaattcaaagcgcatcaggcaatgcttgccgccttgaaagtcggcgacaaagtggtcttggcggcaggtttcaagggtaaggtaaccagagtcggcgaacagttttttaccgtggatatcggacagggtacaaaaatcgaggtcgaagtggaacgcaatgcgattgccgcaaaagtcgattgatttgtgccgacaagccgcatctggaaagcccgaatgcggcactttgttttgaattccaaccgaaggcttgaccatgttccgacacgcagggcggcatattcaggatgccgctttccggtcttgcctggctgggaagggtttttgcctcttctgaaatagcccgattccgacaccaccgaaagggtggggttccaaccattaaggaacaatgatgaaccgttatcctttatggaaatatctgctgattgtgttcacgattgcggttgccgcagtgtattcgctgcccaacctattcggcgaaacacccgccgtgcaggtatcgaccaaccgacaagccatcatcatcaacgaacagactcaattcaaagtggatgccgcgctgaaaaacgcaggtattcagaccgacgggatgtttgttgtggacaattcactgaaagtgcgtttcaaagacacagaaacgcagcttaaagcgcgcgacgtcatcgaaaacactttgggcgaagggtatattaccgcgctcaacctgttggcggacagccccgaatggatggcgaaaatcaaagccaatccgatgtttttgggtttggacctgcgcggcggcgtgcatttcaccatgcaggtcgatatgaaagcggcgatgcagaaaacgtttgaacgttattcgggcgacatccgccgcgaactgcgccgcgaaaaaatccgcagcggcacggtgcgtcaggctggaaacagcctgaccgtccctttgcaggatgcaggtgatgtgcaaaaggctctgccgcagttgcgcaagctgtttcctgaagcaacgctgaattcagacggcagcaatatcgtcttgacgctttcggaagaggcggtcaataaagtgtgttccgatgcggtcaaacagaacatcactaccctgcacaaccgtgtgaacgagttgggcgtggccgagcccgtcatccagcagtccggtgcagaccgtatcgtcgtgcagcttccgggcgttcaggatactgccaaggcaaaagacatcatcggccgtaccgcgactttggaattgcgtatggtggaggacgatcctgccaagttgcgcgaggcattggaaggcaacgtgccgagcggttatgagctgctttcaagcggcggagatcgtcccgaaattctgctgatcagcaaacaggtcgagctgacgggcgacaacatcaacgatgcgcaaccgagtttcgaccaaatgggcgcacctgccgtcagtctgagcttggacagcgcgggcggcagcattttcggcgaactgactgccgcaaatgtcggcaaacgcatggcgatggttttgatcgaccaaggaaaatccgaggttgtaaccgcgccggttatccgtactgccattaccggcggacgcgtggaaatttccggaagcatgacgacagccgaagccaatgatacgtctttgctgttgcgtgccggttctcttgccgcaccgatgcagattgtcgaagaacgtaccatcggtccgtctttgggtaaggagaacatcgaaaaaggcttccattcgactttatggggttttgccatcgttgctgcattcatggtggtttactatcgtctgatgggtttcttttctaccattgcattgagtgccaacatactgttcctaatcggtattttgtctgccatgcaggcaacgttgacgttaccgggtatggccgcgctggcgttgactttgggtatggcaatcgactccaacgtcttgattaacgaacgtatccgcgaagaattgcgtgccggcgtgccgccgcagcaggcaatcaatctcggtttccaacacgcatgggcgaccattgtcgattcgaacctgacttcgctgattgccggtatcgcgcttttggtattcggttccggcccggtacgcggttttgcggtcgtacactgtttgggtattctgacttcgatgtattcatccgtcgtcgtattccgtgcgttggtcaatctgtggtacggacgcagacgcaaattgcagaatatttccattggttcggtgtggaagccgaaagccgaaatggcaggaggcaaggagtaagctatggaactctttaaaatcaaacgcgatattccgtttatgagctacggcaaactgacgaccttcatttcgttggttacgtttatcgctgccgtgttctttttggttaccagaggtctgaatttctctgtcgaatttaccggcggtacggtaatggaagtccaatatcagcagggtgcggatgtcaataagatgcgcgaacgcctcgatacgctgaaaataggtgatgtacaggttcaggcattgggtacgaacaaacacatcatgatccgcctgccgaacaaagaaggtgttacttccgcacagttgtccaatcaggttatggatttgctgaaaaaagacagtcccgacgttaccttgcgccaagtcgaatttatcggcccgcaagtcggtgaggaattggtaagtaatggattgatggctttaggttttgtcgttatcggcatcattatttacctgtcgatgcgttttgaatggcgttttgccgtatctgccattatcgccaatatgcacgacatcgtgattattctcggctgctttgccttcttccaatgggaattttcgctgaccgtcttggcgggtatccttgccgtattgggctattctgtgaacgaatccgtcgtcgtcttcgaccgtatccgtgaaaacttccgcaagccggcgatgcgcggacatgccgtgccggaagtcatcgacaacgcgattaccgcaacgatgagccgcaccatcattacccacggttcgaccgaggcgatggtcgtatccatgctggtgttcggcggtgcggccttgcacggcttttctatggcgttgaccattggcatcgtgttcggcatttattcttccgtattggttgccagcccgcttctgctaatgttcggtttgagccgcgacaatatcggtaaagaaccgaagaagaaagaagaaatcgtggtttgaagcgcatatgccgtctgaacattgccgtctcaagcagacaatgcttcagacggcatttttaacggttacttccacggtcttaaaatattgtgcagaaatgcgggaattgtgtcataatgccacgttgtcctatcttgggcatagggagtttgccgttgtcttcaggcttggcaaacttgtctgaatccctatggggattcttatatttttggagttttcattatggcactgaccgtagaacaaaaagcacaaatcgttaaagatttccaacgcaaagaaggcgacaccggctcttccgaagtacaagtcgctctgttgactttccgcatcaacgacctgaccccccacttcaaagccaaccccaaagaccaccacagccgtcgcggcctgttgaaaatggtcagccaacgccgccgcctgctggcctacttgcgccgtacccagcccgatacgtatcgcgcgttgattacccgcttgggtctgcgtaaataattacgctttccgacaccgcccagaaaaatgggcggtgttttcttttctgttgctttccgacaagctcaaatccatatttatagtggattaaatttaaatcaggacaaggcgacgaagccgcagacagtacaaatagtacggcaaggcaacgcaacgctgtactggtttaaatttaatccactatattgcccgaaaaccgcataaactaatataatataaagttctttggaatcttgttccatttcatgctgcccgtgcgctttacaagagtttcagacggcatcaaacgtttaactcccgccagcaatcaaacagctttttatcacccattcgaaaatccgttttgccggtactcgtctttttattggagtattgccattatgaccgcaaccactgcgtcttcagccaaaccttatctcaaaatccaaggtttggtgaaaaagtttggtgacaattacgctgtcgataacatcgacttggacatttatcaacacgaaatcttcgcccttttgggcagttccggcagcggaaaatctacactgctgcgtatgctggcgggtatggaaagtcccaatcagggaaaaattatccttgatggtcaggatattaccaaacttgcaccctatgatcgccccatcaatatgatgttccaaagttacgcgctttttccgcatatgaccgtagaacaaaacattgccttcggtctgaaacaggacaaaatgcctaaaggcgaaatcgccgcgcgcgtcgaagaaatgctccgcctggttcagatgaccaaatttgctaaacgcaaaccgcaccaattgtccggcggtcagcagcagcgcattgctttggcacgcagtctggcaaaacgtccgaaaattctactgctggatgagcccctcggtgcattggacaaaaaactgcgccaacaaacccagcttgagttggtcaatacgctggaacaagtcggcgtaacctgtattatggttacgcacgaccaagaagaggcgatgacgatggcgacccgcatcgccattatgtctgacggtcagttgcagcaagtcggcacacccagcgacgtgtacgactatcccaacagccgcttcactgccgagtttatcggcgaaaccaacatctttgacggtgtggtgattgaagatcatgccgactatgccgttatcgaatgcgaaggtttggaaaaccacgtccgcatcgatcacggtttgggtggtccgagcgagcaggacctttgggttagtattcgaccagaggatattgatttatataaagaaaaacccgaatatttgggcgactacaactgggcgaaaggcacggtaaaagaaatcgcctatttgggcagcttcgccatttaccatatcaagctcggcaacgggcgcgtcgtcaaaagccaagtccccgccccttactggtatgtgcgcaacattacaccgccgacttgggacgaaaccgtctatatcagctggccggaaaaccaaccgactccgttgttccgttgatttaaggggaatgcaatgaaccttaataaactgaaaaacaaactgttccgccgtccggggcagcgtgcggtgattgccgtaccgtatatttggcttttggtgctgtttctgattccgttcgccatcgtgctgaaaatcagctttgccgaacaagaaatcgccatcccgccgtttactcctttaacgacgatagatgaggatttgggtcgtctgaatattgctgtcagctaccaaaattatgcagacatcttccaaaatttttggagtacgctcaatccgttcggcgacggtgaaaacagcaatatctatctgatgacttattggtcttcaattaagactgcgctgactacgacggtaatttgtctgttggtcggttatccgaccgcctatgcgatttctcgtgccaatccttctgtccgcaatggtttgctgcttgccattatgctgcccttttggacatcgttcctgttgcgcgtctatgcgtggatgggtctgctcgggcataacggcattgtaaacaacctgttgattaaaatgggtattatcagcgagcctttggatttgttctacaatgccttttcgctcaatttggtgatggtttacgcctatctgccgtttatgattctgccgctatacacgcaactggtgaaactcgacaaccgcctgcttgaagcggcttccgatttgggcgcggggccggtcaaatcgttcttgacgattaccctgcctttgtcgaaaaccggcattattgcaggctccatgctggttttcgtccctgctgtcggcgagttcgtcattcccgagctggtcggcggttcggaaaacctgatgattggtaaagtcttgtggcaggcgttcttcgatcaaaacaactggccgctggcttccgccgtcgccgtcgtgatggtcgcgctgctggtcgtgccgattgccctgtttcagcattatgaaaaccgcgaattggaagaaggagccaaataatgcagaaatccaaattatcttggttcttgaaactgatgttggcactgtcgctggcgtttctgtatatcccgctggttgttttggtcatctattcgtttaacgaatccaagctggtaaccgtttggggcggcttttcgaccaagtggtacggcgcattgctggaaaacgacaccatcttggaagccgcttggctgtcgctgcggattgccgttgtgtcttcgcttgccgccgtcgttttgggcacgctggcaggctatgcgatggcgcggattaaacgttttcgcggcagtaccttgttcgctggcatgatttccgcacctatggtgatgcccgacgtgattaccggtctgtctatgctgctgctgattattcaggtacagatatttttgcagggcagcgaatggttacaacatctctacttcgatcgtggctttttcaccatcttcctcggacatacgacgctgtgtatggcgtacattaccgttgttatccgttcgcgtctggttgagcttgaccagtcgctcgaagaagccgcaatggatttgggcgcgcgcccgctgaaaatcttttttgtcatcactttgcctttgattgcccctgccatcgcttcaggctttctgctcggcattaccctgtctttggatgatttggtgattacctcattcctctccggccccggttcatccacattgccgcaggtgattttctccaaaatcaagttgggtctcgatcctcagatgaatgtcttggcgaccatcctaatcggcatcatcggaacattggtcatcatcgtcaattattggatgatgaggcaggcaaccaagcgtgaccgagaagcggcagaagcctaccgccaggaaaaattggctgccgagaaagcaaattaattaataaggcaggctgaccgcatgactgggtcagcctgttttcttcaaccgattttctgtttggacgatatggcccgacagcctgtatcattccgtccgaaaatacacctgataaagcaaacacaatgattcgccctgattttcaagaatatctgccttcttattatttcagttcggttaatcctcatactgtttatccgaaacttcaatgccgtctgaaaaccgatacctgtatcatcggcggcggattgggtggtttgtgcactgcattgcccttggcggagcagggacatgaaacggttgtgttggaagccgcgcgtatcggtttcggcgcgtcgggacggagtggcgggcaggttatcagcgattacgcctgcggtatgggggaaattgaaaaacaggtcggcttggagcaggcgcaatggttttggcaacagtctttgcaggcggtcgaactggtggacgaacgcgtccgcaaacatgccgtcgattgtgattggcagcgcggttatgccacggttgccgtccgtccgcagcattgggaagagttgcagcagtggcatgaacacgcccaacggcattacggtgcgagtcattatcaactttgggataaagccgagttgaaacagcagcttgacagcgatatgtaccaaggggcacaattcgaccccttatccggacacctgcatccgctcacttacactttgggcatcgctcgtgccgctgccgaagccggtgcgcagattttcgagcaatccccgatgacgtgcatcgaaccgcatcaaaacggttggctggtttacacgcccgaaggcagcgtcgagtgcaaaaatgtggtctatgctgtcaatacttatgcaggtttgaacccgatattccggcctttggaacgcaaggcgattgctgtcagcacctttattattgcgaccgaacccttgggggcgcgcgcaaaagggcttatccgtaacaatatggcagtatgcgacaaccgccatattttggattattaccgcctcagcgcggacggcagactgcttttcggcggtaaggataacgagtttatcgacaatcctgagcgtatgaccgagcttgtccgccaagatatgcttaaagtttttccgcagcttgccgatgtcaaaatcgaatattcgtggggcggggagtgcgacattaccgccaaccttgtcccgcatttcggacgtttagccccgaatgttttttatgcgcaaggttattccggacacgggatggcgataacaggcattgcaggtctggcggttgccgaagcaattttaggggacgaatgccgtctgaagccgtttgagcggttgcgccagccgaatattatcctgcaaccgtttttgcgcaaactcggttctttcctcggctcgaaatattatcagtggaaagacagccgttaagcgtcgcaggcagtatagtggattaacaaaaaccagtacggcgttgcctcgccttagctcaaagagaacgattctctaaggtgctgaagcaccaagtgaatcggttccgtactatctgtactgtctgcggcttcgtcgccttgtcctgatttttgttaatccactatatgtttatccatcggcggcaaacgtgaaaaatgccgtctgaaacccgattttcaggcttcagacggcatagccgcccttattccacgcgttcgccgtggatattcagatccaaaccttcgcgttcgacatccttgccgacgcgcaggccgccgcagattttccccacgaccttcaaaatcgcccaactcattagcccgctgtatgccgccataacgaccccgtcttttacctgtatccacaactgctgccaaactgccgcatccccgccgaaaatgcggttgtcgaaaaagatgccggtcaatattccgcccaccagcccgccgaatccgtgtatgccgaaagcgtccaaagaatcatcgtaacgcaatttgtgtttgacgacggtgacggacacaaagcacgcggcggcagtcaatataccgatggcggccgcgcccgacgggccggtaaagccggcggcaggggtgatgccgaccagaccggaaaccgcgccggaagccagccccaaagcggaaggtttgtgtcccgctattttttcgcaggcaagccagcctgccgcgccgaatacggccgacacctgcgttaccgccatcgccatacccgccgccgcgtctgccgcaagcgccgatccggcgttaaagccgaaccagccgaaccacaacattgccgcgccgatcagtgtcatcgccatattgtgcggaggcatcgcctcgcgcccgtagcctatgcgcctgcccaaaaccaaggcggcgacgagtcccgcgataccggcattgatgtgcaccaccgtaccgccggcataatccaatacgccgcccttgctcataaagccgccgccccacacccaatgcgcgcccggcacataaaccaataaaaaccatatgcccgaaaacagcatcattgccgaatatttcatccgttcggcaaacgcgccggtaataatggcggtcgaaataatggcaaacgtcatctgaaaaaacataaataccggttcgggaacagtcggcgcattgggcgacacggtcagcatctgtgcggtagcgtctatctgcatcccgcttaaaaatacgcgccccaaaccgccgataaaggcatttcccggcgtgaacgctaaagaatagccgacggcgacccaaaggatgcccaccaatgtcgcgatggaaaagctgtgcatcatcgtcgagagcaggttttttttccgcaccataccgccgtagaataaagccagcccgggaagcgtcatcaacagtaccaaggcagccgcagtcatcacccaggcggtatcgcccgaattgacggcggaataaggcttccaccagtttaaaggttctgccgatagggatgccggcagcaaagatgccgcccatatgtgttttttcattttgactaaagtttccttaatggttgagcccgtctttcggaaaggcggggtcggggcttgtccgggagggacgcaagccctgccggaccggggcggcgcggggattttgccgatgtgccgccaatcccttgtttgaatatggaaatatcgcatccgatcccttgcacccgttgtccggcgggaggatttatccttaggcggcgcatatgtgggcgtatggattgtcaacaatttactgtaggaaaatatacagaggtttgggcgataaggcaaaatattgttgacaatatttttattttataaaattaatttattgattaatatattaaaaatttttaattggaaatatagtggattaacaaaaatcaggacaaggcgacgaagccgcagacagtacaaatagtacggaaccgattcacttggtgcttcagcaccttagagaatcgttctctttgagctaaggcgaggcaacgccgtactggtttttgttaatccactataaaaatttatggggctgtcctagataactaggataaactcgattttactaattgttttaaaatggaaatttgaacttttatctcgctgttgttaaaacgtcgttcgtacccctttaaatacagctcaaaatgcgctttgggaatgccgtcaaacttgcgtaaatgacgttttgcccggttccaaaagttcccaattccattgatatggttttgtcgttcagcaaaataactttcatctgcttctacttcgccgtcaaacatttccaaatgcggactgttttgataaataagtaatcgtaaacgatgaaaataataggctgaggtacttttattaacgcctactaactctgctgctgttcttgcagttacacctgcgacaaacagttcaatgagtttattttgtttataccggcttagacgaatttttctcataggggcaactctaacttaatttgaatttccctagttatctaggacagccccaaatttatacaaaaatgagtgcggttcggcgcaaccttgaatcaagttcccgcatcggttttcattgccggtacggatgcgttcaagccggctttgcaaaggccgcgctttcggcaagcggacacggacactgccgacggttgcgccgttaacggggggagggaggagctgcgccgaccgtgtgaatgaaagtgccgtctgaaacccgattttcaggcttcagacggcatttcgcattaatgcgggcggcgcgtttatttgccgcgcatcagttcaaagaaatcgtcgttgtttttagaggctttgattttcccgattaaaaattcggctgcctcgatttcgtccatcgggtgcaggaacttgcgtaagagccacatacgttgtaactggtcgtttgggacaagcagctcttcgcggcgcgtgccggatttgttgatgttgatggcggggaagaggcgtttttccgccatacggcggtcaaggtgcaattccatattgccggtgcctttgaattcttcgtaaatcacatcgtccatacggctgccggtttcaaccaatgcggtggcgatgatggtcagcgaaccgccttcttccacgttgcgcgccgcgccgaagaaacgtttgggacgatgcagcgcgttggcatcgacaccgccggtcaggattttgcccgaggtaggcacgacggtattgtaggcgcgggcaaggcgggtaatcgaatccagcaggatgaccacgtcttttttgtgttccaccatacgcttggctttttcaagcaccatttcggcaacttggacgtggcgttgagccggctcgtcaaaggtggaggagactacttcgccacggacggagcggctcatttcggttacttcttcgggacgttcgtcaatcaagaggacgatgagttcgacttcgggatagtttgcggtaacggcgtgggcaatgttttgcagcatcacggttttaccgcttttgggcggggcaaccaagagggcgcgctgacctttgccgataggggaaatcaggtcgatggcacgtccggtcaggttttcttcggactttaagtcgcgttccagcttcaactgttcggtcggaaacagcggggtcaggttttcaaacaggattttatggcggcatacttccgggtggtcgccgttgatggtatcaagcctgaccagggcaaaatagcgttcgttgtcttttgggacgcgcacgcttccttcgatggtgtcgcccgtatgcaggttgaagcggcggatttgggtgggcgagacatagatgtcgtcggggccggcaagataggacgtgtccgcgctgcggaggaagccgaagccgtcgggcaggatttcaagcgtgccggagcaggtgaaaccctcgccttttttcatcatctggcggacgatggcaaatacgaggtcttgtttgcggaatcggttggcgttttcgatgccgtgttcttccgccaattctaagagtttggaaatgtgcagggtttgtaattcggagacgtgcataataatgatgtattttgaagaggaaaaagacaggcagatgccgtctgaaagaagaagctgaccgttgccggttgctcggggaagggggaattgtaggcagtcggcgcgtgggtgtcaaatattatcgcggacggggcatcggcaggaaatgccgtctgagcggagctgcttggaaaaaaatacccccgcgcttttcaggctcgggggtatgggcattgattatttgttcaattcattcgccaaatatagccaagtttcgatgacggtatccgggttcagggaaacgctttcaatgccttcctcaaccagccatttggcgaagtccggatggtcggacgggccttgaccgcagatgccgacatatttgttctgcttgcggcaggcggagatggcaaggtgcagcatcactttgacggcagggttgcgttcgtcaaacgattcggataccaagccgctgtcgcggtcgagaccgagggtcagttgggtcatgtcgttcgagccgatggagaagccgtcgaagtattgcaggaattgttccgccaataccgcgttgctcggcagctcgcacatcataatcaggcgcaggccgtttttgccgcgttccaagccgttttctttcagggctttgacaacggcttcggcttcgcccaaagtgcggacgaacggaatcatgatttcaacgttggtcaaccccatttcatcgcggacgcgtttcaaggctttgcattccaaggcgaaacagtctttgaagttgtcggcgacataacgcgccgcaccacggaagcccaacatcgggttttcttcatgcggttcgtatacgttgccgccgaccaggttggcgtattcgttggatttgaagtcggacatacggacgatggttttacgcggataaaccgatgcggccaatgtcgccacgccttcggcgattttatcgacgtagaagtcgacaggggacgcgtaaccggcgatacggcgggtaatttccgcttttaattcgtcgtcttgtttgtcaaattccaacaaggctttggggtggataccgatttggcggttgatgataaattccatacgcgccaagccgatgccttcgctgggcaggttggcgaagctgaatgcgagttcgggattgccgacgttcatcatgacttttacaggtgctttaggcatattgtctaaggcgacatcggtaatctgtacgtccaacagaccggcatagataaagccggtatcgccttcggcacaggatacggtaacttcttgaccgtttttcagcaattcggttgcattgccgcagccgacaacggcaggaatgcccaattcacgcgcgatgatggcggcgtggcaggtacggccgccgcggttggtaacgatggcagaagcacgtttcatcacgggttcccaatccggatcggtcatgtcggtaacgagtacgtcgccggcttcgacggaatccatctcggaagcatctttaatcaggcgcaccttgccctgaccgactttctgaccgatggcgcggccttcgcataatacggttttgtcgccgttgatggcgaagcggcgcaggttgcggttgccctcttcttgggattttacggtttcgggacgggcttgcaggatgtagagtttgccgtccaagccgtcgcgtccccattcgatatccatcgggcggccgtagtgtttttcgatggtcagtgcgtaatgcgccaactcagtaatttcttcgtcggtaatggagaagcggttgcggtcttcctcggggacatcgacgttggttacggatttaccggcttctgctttgtcggtaaaaatcattttgatgtgttttgaacccatggttttacgcaggatggcgggcttgcccgctttgagcgtgggtttgaacacataaaattcgtccgggttgaccgcaccttgtacgacgttttcgcccagaccgtaagaggaggtaacaaagacgacttgatcgtagccggattcggtgtcgagggtgaacatcacacctgatgcgccgctgtcggaacgcaccatgcgttgaacgccggcggaaagggcgacgatgtcgtgttcgaagcctttgtggacacggtaagaaatggcacggtcgttatacagggaagcgaatacatggtgcatcgcttctttaacgttatccaagccgttgatgttcaagaaggtttcctgttgtccagcgaatgatgcgtccggcaggtcttcggcagttgcggaagaacgtacggcaacggaaatgtccgcaccgccggcatcggcaaccattttgttccatgccgcttcgatttcggcatcgagctgttcggggaaaggcgtatccaaaatccattggcggatttctttgccgacgcgtgccagttcggcaacgtcttcgacatccaattttgccagtgcggcggaaatgcgttcgctcagaccgttgtgtgcgaggaatgcgcggtaggcttcggccgtggtggcaaagccgccggggacgcgaacgcctttttcggtcagctgactgatcatttcgcccagcgaggcgtttttaccgcccacgcgttcaacatctgtcatacgcaggttttcaaaccagattacgtagttgtcggccatttgtgtgtccaatccaaaatatgttaaaaaagaaacaaatccgcgtgcttattttaagcgattcgttcctctgctgtcatgtgttttatccgttttaaaatcatgatgccgtctgaaaaattgcggtttcggcgtgtgtagcggtttgaaacttacagccggtatacttctttttttgggtattttctttgtaaaacaggtggtttgaataggttaatgttttttctgtttgatttttttgtttattttttaaaattttctgccaaaaaatactttatataaataattttatttcaaaattatattgtgtctgtttgggtgtaatccgaggtaggtgtgctgcgggtgctttccttgtgtctgctgctgctgttatgatgggattttaaacctgtgttttaaggatggaagatgagcagtccgcgccatgtgttttacatttccgaccgtaccggtctgactgctgagaatatcggcgaggcgttgctgaaccagtttggcaatctgtcgttcaaacgccatacgcatccgtttgtcgatacgccggaaaaggcgcgcgcggtggtggagaaggtcaatcggagccggcaggaaaacggtcagcgtccgattgcgtttgtcagtgtggttgatgacgaaatccgtcggattatcaaaggggcggatgcttttcagattaatttctttgagacttttttgggactgttggagaaggaactcaataccgaagccacggcatccgggcaggggcatcacagtatcggtaatacgaagcgttatgatgcgcgtatggaagcggtcaatttttctttgaaccacgacgacggggtcagcgataagaaccttcaggaagcggatgtaatcttgatgggtgtatcgcgttcgggcaaaacgccgacctgcctttacctcgccctgcaatacggcatccgtgcggcaaactatccgctgattcccgacgatttggaatcggccgatctgccgcgtatggtcaagccttatagggataagctgttcgggttgaccatccagccggaacgtttgcaggccatccgccaagagcgccgcccgaattcaacttatgccaaaatcgatacatgccgcagcgaggtggcggacgcgcagagtatgttcagacggcatgggattccgtttgcgaatacgacggataagtcggttgaggaattggcggtacacatccttcaggcgtgcaagctcaaacgcaggttttgacgggctttgattcggtttgaaggcggaactgccgtctgaaatcaggtttcagacggcagttttatagtggattaacaaaaatcaggacaaggcgacgaagccgcagacagtacaaatagtacggagccgattcacttggtgcttcagcaccttagagaatcgttctctttgagctaaggcgaggcaacgccgtactggtttttgttaatccactatatgtttgtggggcggatatttttcagggctgtattttgtccagacattcgagcagatcgagtggcgtgcggatgtggaaatccgcctgccatgagccggtatcgtcttcgggagcgatgtagccccattcggcgaggacggtcgtcataccggcgttgcgccccgcctgtatatcgcgttccgcgtcgccgacgtagagtgtgtgttgcgggtcggcgtggatttgtccgcacgcatacagcatgggtttgacgctgggcttgggctcgccgcaggtgtcgccgctgacgacgacggcgggtgggatgatgaagccgagtttggggacgagtttgtcggtgaagcgcatgggtttgttggtgatgatgccccatttgatgccgcgttttccgagttcggcgatgagttcgtttacgccgtcgaagagggtggtgtcttgggcgtagcggctgtcgtattcgtcaaggtattcggtgcgccatcgggcatagtcgggatggtcgggggtgatgcctgcgccgagcttgatcagtcctgccgcgccgtggctggcttgggtgcggatttcgtccatgctttttgcaggtagtccgtggcgggcgagcagggtgttgagtgcgccgccgaggtctagggcggtgtcggcgagcgtgccatcgaggtcgaacaatacggcttgtatcatgtgtgttccttttttataaagtgcgggacgaagggtttcagacggcatgtttattttgtttcaaaccctgctcgaaatcttccaacatatccaattcaaagcggctgaagcctgctttttcgcgcgcttcgatgttcacatagccccggaagataaacatatcgtaacgggcaatcaggctgcggaacagggcgacaggctccaaaccgcgttcgcggcaaaggtgttgataccaccggttgccgatggcgacgtgtcccacttcgtcgcggtaaatgatgtccaacacgccgcaggtttccgaatcaccgcgctgcgccaccttcgcgcgtatgccgggcgtaacgtccagcccgcgcgcttccaaaacgcgcggcactaaagccatacgcaacaaaggatcgtaggcggttttgtatgccatatcccataaatgattgtgtgcttcaaaatcgccgtaatcgaagccgaaagcgcgcagcctttcgcgcatcaggcggaaatggtacacctcttccttcgccactttcacccagtcgcggacaaactgaaacggcagcgtgcggaaacggtatgccgcgtccaaagccagattgatggcgttgaattcgatatgcgcaatcgcgtgcagcatcgccgcatagccttcggttgtgttcattttgcgtggcgtcagctgcgacggcgcgaccaaaacaggcttgtccggtcgtcccgcgcgggggaagtccgccggcggtgcgtttgtttccgccccgtccgcattttgaacggcggcaaacgcctcatccgtcagccgtcctttttcatctgggtcgcccgaaagcagggcgcgttccagcaaagcataaatatcgggtttcatctcaagtccgccgtgttcggaaaacaaatattatagcgtttaaaaaaaacaagatgaggcatataatctccgcgattcggcattccgcgcccaaaccgtcaaatatagtggattaacaaaaaccagtacggtgttgcctcgccttagctcaaagagaacgattctctaaggtgctgaagcaccaagtgaatcggctccgtactatttgtactgtctgcggcttcgtcgccttgtcctgatttttgttaatccactataacgcggcacacattaaagggcagcgtggcgcgccgccttttccggtgggcaaaaaatcagccctcggaaaacgcggtttgcaaaatgcaaaccgcccgtaacgccgcccgtatgattgttttgctgcgccgatactttacgccacactcatcccgacaaggaaaaataatgatgaaaccgcacaacctgttccaattcctcgccgtttgctccctgaccgtcgccgtcgcttccgcacaggcgggcgcggtagacgcgcttaagcaattcaacaacgatgccgacggtatcagcggcagcttcacccaaaccgtccaaagcaaaaagaaaacccaaaccgcgcacggcacgttcaaaatcctgcgaccgggccttttcaaatgggaatacaccaaaccttacaggcaaaccatcgtcggcgacggtcaaaccgtttggctctacgatgttgatctggcacaagtgaccaagtcgtcccaagaccaggccataggcggcagccccgccgccatcctgtcgaacaaaaccgccctcgaaagcagctacacgctgaaagaggacggttcgtccaacggcatcgattatgtgctggcaacgcccaaacgcaacaacgccggctaccaatacatccgcatcggcttcaaaggcggcaacctcgccgccatgcagcttaaagacagcttcggcaaccaaacctccatcagtttcggcggtttgaataccaatccccaactctcgcgcggcgcgttcaagtttaccccgcccaaaggcgtggacgtgttgagcaactgatgccgtccgccccgatgccgtctgaaagccgccgaggcttcagacggcatttttacgcaggcggaacaatgtcccgcattaccgcccgatcgggcaccggaacggcaaaccggtgaaaattaacggttgcgccccggctgtttttgccgtttaatgcaaaccttgctgcaccaagggccaagaaagccgaccggccgcccccacagcttccgatgcaggcggcccgtccgtccctgcaatgttttttatttttgaacgaaaggtcgaaaaccatgaaaaaaacactggtggcggcggcaatcctgagcctcgccttgactgcgtgcggcggcggaagcgataccgccgcccaaaccccctccgccaagcccgaagccgaacaatcgggcaaactcaacatctacaactggtcggattatgtcgatcccgaaaccgttgccgcctttgaaaaagaaaccggcatcaagacgcgttccgattattacgacagcaacgaaacactggaggcaaaagtcctgaccggcaaatccggctacgacctgaccgcgccgtccatcgccaacgtcggccggcaaatcaaagcgggcgcgtatcagaaaatcgacaaggcgcaaatcccccattacggcaacatcgataaagatttgctgaaaatgatggaagccgtcgatccgggcaacgaatacgccgtcccctatttctggggcatcaataccttggcaatcaatacccagcaggtgaaaaaagcattgggtacggacaagctgcccgaaaacgaatgggatttggtgttcaaacccgaatacaccgccaaactcaaatcctgcggcatcagctatttcgacagcgcaatcgaacagattcccttggcgttgcactatttgggcaaagaccccaacagtgagaatcccgaagacatcaaagccgccgtcgatatgatgaaagccgtccggggcgacgtgaaacgcttcagctcttccggctatatcgacgatatggcggcgggcaacctgtgtgccgccatcggttacggcggcgatttgaacattgccaaaacccgtgccgaagaagccgcaaacggcgtggaaatcaaagtattgaccccgaaaaccggcgtgggcgtgtgggtggattcctttatgattccgcgcgacgcgcaaaacgttgccaatgcccaccgctatatcgactacacgctccggcccgaggtggcggcgaaaaacggcagcttcgttacctacgcgcccgccagccgtcccgcgcgcgagctgatggatgaaaaatacacctccgacgcatcgattttcccgaacaaagaactgatggaaaaaagtttcatcgtatcgcccaaatccgcagaatccgtcaaactgggcgtgaagctgtggcaagggctcaaagcgggcaaataaccggaatccctgccgtctgaaacctttcgggcggcaggaaacggcgcgtccgttatcaaacaggggggcgtttcccctcctgccggttatgattgggttaagattaaaatgatttagtaaaatgagaaagatatggatttaagtatcgtagttcctatttataatgtcgaaagttatttggaagcgtgtttaagttccatagaatctatattaagtaatgaaaatgtcgaacttatccttgtgaatgacgggtcaaaagacggaagtgaagatatatgttacaaatatatagataaaatatcaaacagcaaacaacaaacaacaaacaacaaacaacaaacaacaaacaacaaacaacaaacaacaaacaacaaacaacaaacaacaaacaacaaacaacaaacaacaaacaacaaacaacaaacaacaaacaacaaacaacaaacaacaaacaacaaacaacaaacaacaaacaacaaacaacaaacaacaaacaacaaacaacaaacaacaaacaacaaacaacaaacaacaaacaacaaacaacaaacaccggacaccaaatatcaaatatatatatcaggataaccaagggttgtcggaggcgagaaataccggaataaaaaattcaaacggaaaatatatagtctttattgattcggatgattttattaactgtcagattttgctggattttcttagtaaagatgatactgatatgccggatgtggtgtttttaaatgcggttaaatatgataagggaagtgtttcatattttggcgaagattatcagcctgaaaaaatactcaatcaatccaaagtcgaagttttgaaaggattatgccgatttagaaaatttccgggttcggcgtggaataagattataaaaagagaattgattattagagaaaaactgttttttgaaaggggaatttattctgaagatatcgaatggtcaatgaggttatttaatgcggcaacaactttttcttatttggacggttgttattactattatcggcagggaagaaaagattctattacgggaactgtttcggaaaaaagtataaagtcattattatatattttggagaaaaatgcggaaatggaatttaatagggatatatcgagttatctttattcttttctttcctacgaatatctcgttttgctttttataatgacgagtaaaaatatagagtgtgatgctgatataaaaagaagggcgtatcatttaaggtttatgctgttaaagtccaataaattgatatataagctgatattcccgataatcacattactcggggtcgatattacaggcaggattttaaaagcaatcagggggaatatttaataaatcctttaacaatatataccttaccgaaggaggaaaaatgaacgcaatccgaactttccaaaaccgcacgcccgaaatccacgaaacctgtatgatagacgaagcctgcgtcgtcattggcgaagtgtcgcttgccgaagatgtttccgtgtggccgtgcgccgtgttgcgcggcgatgtgaacagcatcaccgtcggcgcgcgcagcaatatacaggacggcagcgtcttgcacgtttcccacaaaaccgccgccaaacccgaaggatcgccgctggttatcggcgaagacgttaccgtggggcacaaagtgatgctgcacggctgccgtatcggcaaccgcgtcctggtcggcatggggacgacggttctggacgatgccgtgattgaggacgaagtgatgatcggcgcgggcagcctcgttccgccgcgcaaacgcttggcgggcggctatctttatgtcggttcgccggtcagacaggtgcgcgtgctgaccgatgaggaaaaagcctttttgaaatattccgccgcgcattatgtgaagctgtcgaaacagtacgggatgtgaaatcacatcggcgttcttgcgtcagccccaaattcatgcggatgggacgcatccgataacggtatccgatgcgccttgattttgaccgtctgcgtttgaattgcaggcaaaaatgccgtctgaaagccttttttcgggttcagacggcattttattgccgattgttttttaaagtttgaccgaatgttcgcgcgtttcgtggaacacgatgtccggccagcgttcttgcgtcagccctaaattcatgaggacgggatgcccgataacggtatccgatgcgtcttgattttgatcggtgcatttgagttgcaggcaaaaatgccgtctgaaagccttttttcgggttcagacggcattttatcgccgattgctttttacagtttgaccgaatgttcgcgtgtttcgtggaacacgatgtccggccaacgttcttgcgtgagtcccaaattcacgcggttgggggcgaggtaggcgaggttgccgcctgcgtcgatggcgaggttgcccgcgttggctttttcaaattcagccagttttttcttgtcgtcgcacgatacccagcgcgccgaccagatggatgcgctgtcgaacacggcttctacgccgtattcgttggcgaggcgcgaggtaacgacttcaaactgcaacacgccgaccgcgcccaaaatcaaatccgcgccgctcatcggtttgaacacctgcaccgcgccttcttcgccgagctgttgcaagcctttttgcagttgtttgattttcagcgggtttttgatgcgtacgctgcggaacagttcgggtgcgaagaatgggatgccggtgaacgccagttgttcgccttcggagaagctgtcgccgatttggatgttgccgtggttcgggatgccgataatgtcgccggcgtaggcttcttcaaccagctcgcggtcgtgcgacatgaaggtaaccacgctggaggcggcgatttcgcggttgatacgcaggtgtttcatcttcatgccgcgctcgaatttgccggagcagacgcgcaagaaggcaatacggtcgcggtgtttcgggtccatattggcttggattttgaagataaatccggaaaacttcggctcgtccggctcgaccatacgtacggtcgcgtcgcgcggtttcggcgcgggcgcccagtcaatcaatgaattgaggatttcctgaataccgaagttgttaatcgcagagccgaagaatacgggcgtgagttcgccggcgaggaattcgtcgagattaaactcgttggaagccgcctgcaccaattcgatttcgtcgcgcaactgctggatttccaacggaaagcgttgttccaattcaggattatcgatgcctttgatgatgtcgaactcgtgcggcaggcgttcgccgccagcttcaaagagataaatttcatcgttcaggatgtggtacacgcccttgaagtttttgcccataccgatcggccaggtaacgggcgcgcagcggatttttaaaatgttttccacttcgtccaaaagttccagggaatcgcgcacttcgcggtcgtatttgttcataaacgtaacaatcggtgtatcgcgcaggcggcagacgtttaagagcttgatggtttgcgcttccacgccttttgccgcgtcgatgaccattaatgcgctgtccacggcggttaaaacgcggtaggtgtcttcggagaagtcttggtgtcccggcgtgtccaagaggttgacggtgtggtctttgtaatcgaactgcatcacacttgatgccacggaaatgccgcgctgcttctcgatttccatccagtcggaagtggcgaatttgccggttttcttgccttttaccgtacccgcgctctgaatcgcgcccgaaaacagcaagagtttttcagtcaacgtggttttacctgcgtcagggtgggagatgatggcaaacgtgcggcggcggcgcacttggtcgaggatttcttgggacatggttttctttgcaaaaaggttcaggccgcttttcagacggcccggacagtgtttgagacggcgaaattgtacaaaaaaatgcctgataattcaatgttggaggcggtcagtgcgtgctgccgtaaatctctttttcgtctttcaggacggcatcggcggtttcccacgcgctgccacgccagactttgtaaaagcagctttctcgcccggtgtggcaggcgatgccgccgttttgggcgatgagcatcacaatggcgtcgccgtcgcagtcgaggcgcagtgcgcggactttttgcgtgtgtcccgactcttcgcccttcatccattgtttttggcgcgaacggctgtaatagtgggcaaagccggtttcgacggttttttgcagggcttcggcgttcatccacgccaccattaaaatacgtttggtttcggcatcttgggcgatggcgcaaaccaaacctttttcgtcaaatttgacggcttcaagcaggtttttatccatatttcctttcagacggcatagtcgaggcggtcagaggcgcacttcgatgccggcttcgcgcatagcgcgtttggcttcgcggatggcgatttccccgaaatggaaaatgccggcggcaagtacggcatcggctttgccttcggttatgccttcaatcaggtgccggacattgccgaccccgccggaggcgatgacggggatgtcgacggcttcggcaacggcgcgggtcagcggcaggttgaaaccctgtttcgtaccgtccctgtccataccggtgagcaggatttcgcccgcgccgcgtttttgcatttcgaccgcccattccaccgcatccaaaccggtcggatttcgcccgccgtgggtaaagatttcccagcgtgtgttttcggggttggcggctttggcatcgacggcggcgacgatggcttgcgaaccgaaaaatccggcggcttcgtcaattaaatcgggacgggtaacggcggcggtgttgatgctgactttgtccgcgccggcattgagcaggcggcggatgtcggcaacggtgcgtacgccgccgccgacggtcagggggatgaagacttgtccggcaacctcttcgatgatgtgcaggatggtgtcgcggttgtcggatgaggcggtgatgtcgaggaaggtcaattcgtccgcgccttcgccgttgtagcgtttggcggcttcgacggggtcgcccgcgtcgcgcaaaccgatgaagttcacgcctttgacgacgcgcccgtcttttacgtcgagacaggggatgatgcgttttgccagtgccataatcggatgcctttagtcgagggaatctgccagttgctgcgcttgggcaaaatcgatgctaccctcgtaaatcgcgcggccggtaatcgcgcctgctacgccatgtttttcggcggcacacagggcgcggatgtcgtccaagccggtcagtccgccggaggagatgacgggaatgcggacggtttgggcgagtttgaccgtcgcgtcgatgttcacgccgctcatcataccgtcgcgcccgatgtcggtgtagatgatgctgttgacgccgtcgtcttcaaagcgttttgccaaatcaattacatgatgcccggttacggttgcccagccgtcgatggcggccataccgtctttggcatccagcccgacaataatcctgccggggaaggctttgcacgcctcgcgcacgaagtcggggtttttgaccgccgccgtgccgataatcacgtcgtttaagcccaaatccaaatattgtccgatggttttcaaatcgcgtatgccgccgccgagctgtacggggatgtctttggcgacagcggcaaggatgtctttgatggcgggcaggttttgcggaacgccggcaaacgcgccgttcaaatctaccagatgcaggcggcgcgcgccttgtttgaaccagtgcagcgcggtttcggcgggcgaatcggaaaagacggtcgcctcttccatcagcccttgtttcaggcggacgcagcgtccttctttcaaatcgatggcgggtatcagcagcataatttttctccttgtgcggggccgtgtccggcttaccagtttaaaaagtttttcaacatcgtcagcccggcatcgtggcttttttcggtgtgaaattgcgtggcgaatacgttgtctttgccgacgatgcaggcaaacggggacgggtagtcgctttcgcccaatatggtttcgggattttcgggggcgaaatagtagctgtggacgaagtaaaaacgcgtgtcttggggaatatctttaaacagcgggtggttttgggtttggcgcacggtgttccagcccatatgcgggactttcagacggcatccctgcgggtcgcggaggtcgcgctcaaagcgtctgactttgccgccgaaccagcccaagccgtcggtgtttccttcttcactgtggtcgaataaaagttgcgcgccgacgcagattccgaaaaacggtttgttttttaaggcatctttgactgcctcgtccaaaccgtctcgttttaatgccgccatacagtcgggcatcgcgccctgaccgggaaaaatgactttgtcggcgcgggacacgcggtcggggtcgccgcttaaaaagatttcggtattttttccggcaagctgccccgccgtccggacggatttcaatacggaatgcaggttgcccataccgtaatcgataatggcggtttgcatggcttcctcctctttttttgcaatatggctgcgattttaacaaacaaatgtgccgtgctgataaaaatgccgtctgaaaacgggagtctgtcttcagacggcatagggtttaaacccggaaagccgtttgtcagccttccatttgttttgcctgaacggcagtcagggcgatggtaaacacgatatcttctaccagtgcgccgcgggagaggtcgttgaccggtttacgcaggccttgcagcagcgggccgacgcttaagacgttggcgttgcgttggacggctttataggtgcagttgccggtgttcaggtcggggaagaccaaaacggttgcctgtcctgccaccgggctgcccggagctttggatttgcccacacccggcacggttgccgcatcatattgcagcgggccgtcgatggcgaggtcggggcgtttttcccgggcaagtttggttgcttcgatgacggtatcgacatcggggccgctgccggagttgacggtggagtaggaaatcatcgccactttcgggtcgatgccgaaggcttttgcggaatcggcagactggatggcgatgtcggcaagctgttgcgcggtcgggttcggattaaccgcgcagtcgccgaagacgaggacttggttgggcagcagcataaagaatacgctggacacgaggcttgcgcccggtgcggttttaatcagttgcaaagcggggcggatggtgttggcggtggtgtgaaccgcaccggataccaaaccgtccacatcattttgcgccatcatcatcgtaccgagtaccacggtgtcttgcagttgcttgcgcgcgtcttcgggtgtcaggcctttggatttgcgcagttcgcacatcggctcgacgtattgttcgaccaatgaggcgggatcgatgatttccaaagagtcgggcaggctgatgccgcgttctttggcaacggcttcgacttcttcgcgtttggcaagcaggacgcagcgggcaatgcctttttcgtggcagatggcggcggcttggacggtgcggggttctgcgccctcaggcaggacgatgcgtttgtcggcttggcgggcgaagtcgatcaggttgtagcggaattgcgccggcgacaggcgttttgcttcgcggcctgccaatacggatacgtctttcagcgcgtcgctcgaaccgaagaaggtcaggccggttttttcggctgccgcttcggcaacggaggctgccgcgccgtccacgacaaaaccttccaatacgcccggcgcggcggcgaagaactgtttggcaaggttcacccgatttgccagttcgtcggcatcggcgttgtcggaacggacggcgaagacggctgccgcgtcaagggacaatgccagttcgacgtttttgcctgcgaggtagattttgtcggcatcgggcgcgatgccttcgatgacgaggttggcggcatcgagtgcggcaactttgccgaccagtgcgtcgaaccagtcgtcgcttttgccttgcgcgagcagggtttcggcggttgcgtcaacggcttggaaaatttgtgcgtccagtgcttttgcaaaggcttgtgcggcggcggaggcgtccagtccggcagatacgggtacgatgagtacttttgccatgatatatcctttcgtatgctgcggtgtgcggcatatgtggttggaaggggcggcatataggcagaaacggctgcctgcgtgccgtgcgtgccgtgtttggcttgaggcgcgcaggttgaatatagcaaacaaattctgtttccaacaagataaatatccgcaggcttgtggatgctgccgcctttcagagggtatttccggggaagaacagggcgggaccgtccaaatggaggacggcggaaatgccgtctgacagggtgggggcggaagggaggttgagcgtgaggacggtttgtccgacccggaggctgatttcggtatgccgcgctttgggcgtggttttgagaaccacggcgtgaatggaggcggtgggtgcggaatgggggtgaaggctgaactgttccggacggatgagcagtgtgccgcgtgtgcctgcgggtgcgccgctttgaacgggcaggcggcccaatccgcaatcggcggtgccgtcggcgttgagcgcggcggggaacacgatgccttcgccgataaacagggcggcatcaaggtcggcaggttgtcggtacaattcgtgagggcttgcagtttggaggatgcgcccctgtttcatcacggcaatccggtcggcgtattgcagggcttcttcgcggtcgtggctgacgaaaacggcagatttgccgttggcgcgcagggcggcaatcatgtcttcgcgaatctggcggcgcaactgttcgtccagcgcgctgaagggttcgtccaacaaaatcagttcgggatcgggtgcgagggcgcgggcgagggcgacgcgctgttgctgtccgcccgaaagttcgtgcggatagcgtccggcaagttcggaaatgccggtcaattccaacatagcttcgatgcgctgccgctcttgcgccgtcttgcctttgccgttgcccagcccgtaggcggtgttgcggtaaacggtcaggtgggggaacagcacaccttcctgtacgacataacccaaacggcgttcgcggacggggaggttggtatttttcgagaagatggttctgccggaaagcgaaatttcgccaaaatcgggttgttcaaaaccggcaaggcagcgtaaaagggtggttttgccgcagccggacgcgccgacgataaagaggatttcgcccgggtcgaggctgagcgaaatgtcgtttaaaactggggtgttttgaaaacttttggacaggtgtccgatgtgcagggcggcggtcatggcggtacttcctcaagctgttatttgaaggcgtatttcttcagcaggaatacggggatgccggaaaataataccagcatcagcgcgtaaggggtggcggcggcgtattgtgcgtccgatgtgtattcccaaacggcggtggagagtgtgtggacatcgtcggtggtcagcagcagggtggcggtcagctctttcatcagtttgaggaagacgagtgcgaatgcggcggtaatgccgggcaggatggacggcagtaccaacgtcctgaaaataaagaagtgtccgcgccccaatgttgcgccgacctgttccatcccttttgggagttgttccaaggaagtcctcagggtggtttgcgccatcggcaggtaaagcatgaaataggcaaggatgacgacgataaaggtttggtaaacggcaggggtgtagttgatgctgaaataaaccaaggatagggcgataaccaaaccggggacggcgtgcagtaaaaacggcagcctgtctatccaaacggttaaaaaattgcgatagcgaaccgatgcccaaacaaggggcaaggcacataatatagtcaaaatcgcacctaaagccgatacgcttaaggaacggataaaggcatcaaatacggatacgagcgcgaatgtgccggaagtgccgaccatcatccaatgtatcaatacgccaaaggggataataatgcccaaagtcaacaagctgcttaaaaaaacaatcgcgccaatctgaccgggcagtttgagggttttgacgggataaggacgggcaacgcctttgccgctgtggtaaatcttggctttgccgcgaaatatgctttctccaaatacgacgatgccgcacaccgccattaaaacagcggaaagcagggcggcggtattgttgttgtaggacatttcgtattcttggaaaatggcggtggtaaaagtggggtagttcaaaatggataccgcgccaaattcgaccagcatatgcagggcaatcagtaacacgctgctgccgatggcgggtttgagctgggggaggatggcggaaaaaaaggtttgcaggcggcttttgcccaaggacaggctgacttcttcgtaagacaggctgatgcgtttgagtgccgcctcgacgggcaggtaggcgagcgggaacgaggacaggctcataatcatcactgtcccccaaaagccttcgacacggaaggtcaggctgatccaggtgaaacagctgacaaatgcggggatgcacaaaggcagggtgattgccgtctgaaaaaaggttttgccgaagaagcggtaacgttggaacaaaagggcgcaggcaatgcccaaaacaatggaaatcagggtaacgcccgccatcatcgtcaaggtgttggagagcaaatcccacatacgcgggcggaacaacagttcgacggcgcggttgatgccgacctgccacgaacgcatagcgacatataaaaaaggcagggtaagcggtagggcaatcagtaggatgaggccggtaagccaaatgggtatttttttaggagacatagtgttttttatcggcaaaacgggcggacagtataaatgtccacccgtttgacaatccgaaaacggcttatttcataccggcttgctcaagcagccgggtggcgtgttctttttcggaaacagtggtggcggacacttggggtgcttccaacttggcgatgggttccaaattgaaagtggataccacgtgcggattcaaaggatattcggcacggacggcggtcagggcgcgctgtccttccttgctggcgaggaaggcgacgaattttttcgcctcatccttgttttgggaggattttaacacggctgcgccggaataggtaacgagtgcgccgggatctctgtggcggacgaaattcaggcgggtgtggacattttgtacgcctttttcacgcgcaaaagcgtgccagtagtagttgttgatgagggcggcatcgatttcgccgttttcaaccgcttgaagggcgacggagtttttagcgtaaggcttgccgtattctttcagacctttgagccatttcaatgcggccgcttcgcctttcagtttgacgatggcgacaacctgttccaagaacgcgccggaagtgggggcgtaaccgatgcggtttttccatttcggcgtggcgtaattcaggacggatttttccaaatctttttcagacagtttgcgggtgtcgtaaacgacgacgcgcgaacgtccgctcagtgccacccagtcttttttggcggcaaccggcacgcccttgccgcgtgtttcgttgatggtggaggcgggcaggggctctaggaggttggcggcggaaagggtggcgagtgccgggatttgttcggaatagaatacgtcggcggggcttcggctgccttcttctttgatttgaccggcaagctggtcgcctttggcgctgttgagtttgactttgatgccggtagcccgggtaaaggcatctgcaacggcttgtgctgcttctttgtgttggccgttgtacacggtaatgtctgccagcgcgggggttgcggcggtcagggctgcggcaagcagtgcgtatcggatagatgttttcatatcgattttctcctaatgaatgagagtgtataccttgttaagacataacggtgtgtagtgtattccttcttttttataaatgcaaataattattttttaaatttgttgttgtccgatccggttattgtttgttctgacttgtattttttccgtgagtctcgcccgtaaggcggaagtggcgggcaatgcgtggcggaatgtgggtaaaggcggcattttgatttgtcggaatgcttgagaacccctctctttaaaacacccttggattcggatttcaagtgcaacactagtgtattagtggttggaacagattcaagaataaaacacttggcgtttcgtagccaagtgtttttcttggtcggtggttcaactcatcttgaaccctgcgtatctcccgatcactgatgttacggaaatcggtttgtttggggaagtattgccggatgagtccgttggtgttctcattcagccctttctcccaagaatggtaaggacgacaaaaataagtctccgctttcaatgctttggttattttggtgtgttggtagaactctttgccgttatccatggtaatggtgtgcaccctgtctttatgtgcctttaatgccctaacagctgcccgggcagtgtcttcggctttgaggctatccaatttgcagatgatggtgtagcgggtaacgcgttcgaccaaggtcaataatgcgcttttctgtcctttgccgacaatggtgtcggcttcccaatcgccgatacgggatttctggtcgacgatagcgggtcggttttctatgccgacacggttgggtactttgcctctggtccatgtgctgccgtagcgtttgcggtagggtttgctgcatattctgagatgttgccacaacgtgctgccgttgcttttgtcttggcgaaggtagcggtaaatggtgctgtggtggagcgtgatctggtggtgtttgcacaggtaggcgcatacttgttcgggactgagtttgcggcggataagggggtcgatgtgctgaatcagctgcgaatcgagcttatagggttgtcgcttacgctgtttgatagtccggctttgccgctgggctttttcggcgctgtattgctgcccttgggtgcggtgccgtctgatttcgcggctgatggtgcttttgtggcggttcagctgtttggcgatttcggtgacggtgcagtggcgggacaggtattggatgtggtatcgttcgccttgggtcagttgcgtgtagctcatggcaatctttcttgcaggaaaggccgtatgctaccgcatactggcctttttctgttagggaaagttgcacttcaaatgcgaatccgccaccgtctgaacagggttgctggaatagtattgccatcccagcagatacagtttgtcggggtcttgccaatattgttcatccagactgttcagcagtgaggcggttttgttgtcgagatgttatatcccacatttctttcaggtttttaccttccgattggaggcggcggatttctttgtccaatgcgtctgccgcccgatggatcagcattgcgctgtgtaccgcgccgatttttttcagaacggaacaagtcttttcggcggcggggaaaccccagttgcagacaaattgcagtatgctgccgttaccgatatcggcttctgtccgccaaatcaaaaccagctcctgttcccgcccgtccatgctttcgagtttgccgtcatgctgttcaaaaagtttgtccaccgcctgccacatcatctgttcgaagcggtcggcttgggtatccgtatcggtcatcgtgttcttgccttttaaaaatgccgtctgaacatttcttcagacggcatttgggggttaagccaacatttcccgccagcgtttcacttggaagcggacttgttccggcgcggtaccgcccaagtggttgcgggcgtttaagctgccttcgggtgtcagcacgccgtaaacgtcgtcggcaatcaaatcgctgaaaccttgtaagacttcgagcggcagttcgctcaaatcgacgcccgcttggtcggcgtggcgcacggcttgggcgacgacttcgtgggcatcgcggaaaggcatgccttttttgaccagataatccgccaagtcggtggcggtagcgaagccctgcatcacggcggcgcgcatattgtcgggtttgacggttacgccgcgcatcatatcggcgtaaatccgcaacgtgtcgataagcgtgtcggcggtgtcgaacaagggttctttgtcttcctgattgtctttgttgtacgccaagggttgggatttcatcagggtaatcagaccgataaggtgtccgatgacgcggccggatttgccgcgcacgagttcgggcacgtcggggtttttcttctgcggcatgatggacgaacctgtgcagaaacggtcggcgatgtcgataaagccgaaacgcgggctcatccacaaaatcaattcttcagacaggcggctcaggtgaaccataaccagcgaggcggcggctgtgaactcaatggcgaaatcgcggtcggatacggcatcgagcgagttctggcagatttgttcaaagcccaatagctcggcggtgatttcgcgctgaatcgggtaggtcgtcccggcaagggcggctgcgccgagcggcatacggttgacgcggcagcggcagtccgccatccgttcgttatcgcgtccgagcatttcgacgtaggcgagcatatggtgtccgaagctgacgggctgggcgacttgcaggtgggtaaagcctggcatgacggtttcggcgttttgttccgccaaatccagcaatgccgtctgaaggctttgaatcaggctttgtataacggtaatctggtcgcgcagccacaggcggatgtcggtggcgacttggtcgttgcggctgcggccggtgtgcaggcgtttgcccgcgtcgccgattttgtcggtcaggcggcgttcgatgttcatatggacatcttccaaatcggacgaccattcgattttgccgctgcggatttcttcgaggatttccgccataccccggcggatgtccgccaaatcgccttcgtccaacacgccggtttctttcagcatttgcgcgtgtgccagcgagccttggatgtcccattcggcaagccgtcggtcgaaaccgatggaggcggtgtattgtttgacgagttcggaaacgggttcgttgaaacgtccggaccaggttttgtcgtgcataaggattccttgatggggttattcggtgcggtatttttccaaaagccggcggaagggttcgccggtttcgggatgtttcagaccgtaggcgacggtggcttcgaggtagcccagtttgctgccgcagtcgtagcgcgtaccttcaaaggggtgcgccaggacaaattcgtgatcgagcagcttggcgatgccgtctgtaagctggatttcgttgcccgcgccgcgcggaagattggttaagaggtcgaaaatgcgcggggtgaggatgtagcgtccaacaacggcaaggttggagggcgcgtcttcgggcttgggtttttcgacaatgccggtaatgcgttggaactgtttgagctgttcggtttcgacgatgccgtatgagccggtttgcgatgcttcaacggtttctacgcccaaaatgctgttgccgctgcgcccgtacacttcgaccatttgtttgagcgcgcctttgggggcatcaatcaggtcgtcggcaaggataacggcaaagggttcgtctccgatggcggcgcgggcgcacaagacggcgtgtcccaagcccagtgcttccgcctgacggatgtagaggcaggtaatgttcggcggcaggatgttgcggacgtgttccaacaatttgtctttatggcgcatttccaactcggtttcgagttcgtatgccttgtcgaaatggtcttcgatgctgcgtttgttgcgtccggtaacaaacaccatttccgtgcagccggcttccacggcttcttctacggcgtattggatcagcggcttgtcgacgatgggcagcatttctttcgggctggccttggtggcgggcaggaagcgggttcccatccctgcgacggggaaaacggctttccgtatgggtttcattctttttcctttgtattgttttgatgtttaaagggcgagtttgcgtaagagttcggcaagtgcctgcgcgcggtggctttcgcggtttttgacctccgtatccaattcggcggcggttttgccgtgttcgggcagataaaaatacgggtcgtaaccgaaaccgttttgcccgagcggcgtgtcgttccactgcccgtgccatacgccctcggcgataatcgggcgcgggtcgtctttatggcggacaaaaaccaatacgcagacatagcagcagcttttgtctgccttgccgacaagttcggcggcaagtttcaggttgttggcggtatcggatttgggattgtcgcccgcgtaacgtgcggaatggatgcccggcgcgccgtttaaggcggcggcacagatgccgctgtcgtcggcgagtgcgggcagcccgctgtatttggcggcatggcgtgcttttgccagcgcgttttcgacaaaggtgggatagggttcggggcattcgggtatgccgaatgcggattgcggcaatacggtgatgctgtaaggtttgaataagttgccgaactcttcgagcttgccggcattgccgcttgccaaaacgattttttccggtttttcagacatagcggttttcctttgtggcggattgggcggcgcgtagggatttgtgccgcaggtagagggcgaggctgccgatttgtccgaacagtgcgccgaatgcgaaaagaaaggaggcgacggcgaaggctttgctgccgacggtcagcagataagcacccaagaggacgagcagcataaatgccagtgtgaagagggcaacagacaacagatagatttttcggcggttcatggcgttcggtcggaaacggtatgttcggattatagccgattgggacggtattccctagagcttggaaaaatgccgtctgaaacggcgttcagacggcatggcgggcgttatgcctgtttgttccaacgttcgatggattctttgatgacttttttcgcttcttccgcatcgccccacgattcgactttggtcgtacctgcttttttcaggtctttgtaatggttgaagtggaactcgatttgtttgatgagctgttgcggcaaatcggacaaagttttgtaggcgttgccgttgttgcggtcgtcggcaggaacgcagacgattttgtcgtccacttcgccgtcgtcaacgaatttcatcacgccgataacgcgcgcttccaagaatacgccggttgccaaaggttgttcggtaacgagcagcacgtccaattcgtcgccgtcttcgtccaaagtttggggaatgaagccgtagttggtcggtttggcgaagatggcgggttcgacgcggtcgagttggaatgcggccagtttgcggttccattcgattttgtggttgctgccggcggggatttcgttgacaacgttgatgatgccgccgtccacgtcgccgggggtcaggatttggttgaagtctgccatttggtttcctttgtttgggaaagtgtgaagtttgaaagtatagcacaaacgtccggctgaaaatgcgcccgatgcctctgaaagggtgtacgggcgcgtgttaccgtttgcccaaaaacctgcccagttccaaaatcgcgcgcctgttggacggggaaaatactttttccgctgcttcttccatatcgaaccaaccgtaggagacgtgttcttcgggttgcagggcgatgggcgtatcacgcgggatttcggcagagaagaggtgttcgcggttttcaaacacgccttttggatagcggtgccgccagtggtggtagatttcgtaaaccgtgctgtcgtgccagtcttgaagctgcccgtccgccagcaggatgccggtttcttcccaaacttcgcgccttgccgtttgggcgacggtttcgcccggttcgaggctgccggttaccgactgccaaaatccttccggatgcgtgcgttcgatgagcaggatgccgccgtccccgctataaaggacgaccagtgcggaaacggggtatttgagcggttttgccatcggcatctttcggcgggctgcggtaatgaaggggcggattatagcaaacgccgcacgttatggcgtttatccttttccgtatccttttttctgcacggatgggacgcgccggtgtttgccggtaaattttccgttgtgtcaaaaagataagggcggttgtgattttaatgcttgccaaagcgtcgggcggaaactataatccgaaacttatcgagtcggagtgtggcgcagtctggtagcgcacttgcatggggtgcaaggggtcgaaggttcgaatcctttcactccgaccaaaaattccgaaagccgctttcaaaagcggcttttttgccgtccgtatgattatgatgtagagtacgcggcgacagacattcaaatgccgtctgaaaaccgttcagatggcatctctttatcttagtttcattccgtaccatcttaaggaacatcaaattgggcatttcccgcaaaatatcccttattctgtccatactggcagtgtgcctgccgatgcatgcacacgcctcagatttggcaaacgattcttttatccggcaggttctcgaccgtcagcatttcgaacccgacgggaaataccacctattcggcagcaggggggaacttgccgagcgcagcggccatatcggattgggaaaaatacaaagccatcagttgggcaacctgatgattcaacaggcggccattaaaggaaatatcggctacattgtccgcttttccgatcacgggcacgaagtccattcccccttcgacaaccatgcctcacattccgattctgatgaagccggtagtcccgttgacggatttagcctttaccgcatccattgggacggatacgaacaccatcccgccgacggctatgacgggccacagggcggcggctatcccgctcccaaaggcgcgagggatatatacagctacgacataaaaggcgttgcccaaaatatccgcctcaacctgaccgacaaccgcagcaccggacaacggcttgccgaccgtttccacaatgccggtagtatgctgacgcaaggagtaggcgacggattcaaacgcgccacccgatacagccccgagctggacagatcgggcaatgccgccgaagccttcaacggcactgcagatatcgttaaaaacatcatcggcgcggcaggagaaattgtcggcgcaggcgatgccgtgcagggcataagcgaaggctcaaacattgctgtcatgcacggcttgggtctgctttccaccgaaaacaagatggcgcgcatcaacgatttggcagatatggcgcaactcaaagactatgccgcagcagccatccgcgattgggcagtccaaaaccccaatgccgcacaaggcatagaagccgtcagcaatatctttatggcagccatccccatcaaagggattggagctgttcggggaaaatacggcttgggcggcatcacggcacatcctatcaagcggtcgcagatgggcgcgatcgcattgccgaaagggaaatccgccgtcagcgacaattttgccgatgcggcatacgccaaatacccgtccccttaccattcccgaaatatccgttcaaacttggagcagcgttacggcaaagaaaacatcacctcctcaaccgtgccgccgtcaaacggcaaaaatgtcaaactggcagaccaacgccacccgaagacaggcgtaccgtttgacggtaaagggtttccgaattttgagaagcacgtgaaatatgatacgaagctcgatattcaagaattatcggggggcggtatacctaaggctaagcctgtgtttgatgcgaaaccgagatgggaggttgataggaagcttaataaattgacaactcgtgagcaggtggagaaaaatgttcaggaaataaggaacggtaatataaacagtaactttagccaacatgctcaactagagagggaaattaataaactaaaatctgccgatgaaattaattttgcagatggaatgggaaaatttaccgatagcatgaatgacaaggcttttagtaggcttgtgaaatcagttaaagagaatggcttcacaaatccagttgtggagtacgttgaaataaatggaaaagcatatatcgtaagaggaaataatrgggtttttgctgcagaataccttggcaggatacatgaattaaaatttaaaaaagttgactttcctgttcctaatactagttggaaaaatcctactgatgtcttgaatgaatcaggtaatgttaagagacctcgttataggagtaaataaaaatggcaatttggaattatcggtactaccttatcccatcagctgctatcagaaataaatttaatgcaaataaagatatcatacttgatgagtatcgatctaatggttttcagaattttaatgagaataaaagttttgaaaattactttatcgataatgatgttatattattatcaataataaatgaagcaaaaaaacagcttaaattgaaagaatcttgggataaagacgcaatcatgttttgtgataattttggtaatagtcttaccgtttggccagatgatatagagtgcgaacttgatttaagatttgattatactaaatttattcagaaaaccattgattgggcaataaaatataattgtctacttgtaatagaaaaaacaggaaatgtagtttcccctaatataaataatctgatgtatgaaataaaagcatatttggaaagcaagccgtggcccatatgaaacctaaactcaacaagtaggatgtgtgcggaacgcacgtatgcggttctcaaggtttgagctaagaggccgtctgaaaacagaaaaactgtttcagacgacctttcttttaaccagttgccacagcaaccggacaaaagcagcctacctccacatccatataggcaatacaggggagatattttgtaaattctacgaatattttacctgctaaacagggtaggatatggtatgaagcgaacattggcttaataaacactatgtcaagatcgaatcaggctggtactagattgttgtattccaattatggattgctatatataacaactgatcattatatctctgcaacacggtttgtagcttggaaataggagtataacttatgcaattagagattatcggtagtaaaatttatacggaacaagattttcataatcaaatttcaaaaatattttctatacaagattattatgggaacaatcttgatgctttatgggatttattaagcacaaatgtagaacgaccgattactttggtatggaaagatgctatgttctcaaaaaatcaattagaaaatatatttattgaaatcgtaaatgttctagaaagagttaagaaacaagatgaggattatggattcgaagaaaaatttaattatattttagagtaagtaaaccctaattacattacgtacacaggcttaaaactccccagagccaattaagcaagccgtaacccatataaaacttaaactcaacaagtagcatgtgtgcggaacgtacgcatgcggttcttaaagtttgagctaagaggccgtctaaaaacagaaaaaccgtttcagacggtctttgtttaacgccaccgatccagcgggttacaaagcgcagtcaatgccgctgcgccttatgcctccgaagcaataggcagaacatttggacacggtgaaaacaaaaacgaaaccgcccaagccgtcggacatttccttttaggagcagctattgcccgcgtcaacggtggtaattttgctgccggcggctcggcagcagttgcagctgaaaaggcggcggaacatcttgcccaacagtataacgacggtaaaaccgcaatcgatccgcaaacaggcgagttcaatgccaacctgctgccggaacatatcaaagaggaaatcaaatcaaagagcggggtgattgcatcgctgacgggcgcggccgtgggcggcacgccggtagatgcgcaaaccggaggtgcggtcggacagaatgcggtggaaaacaacctctatctgacatcggaagccttaaagaaggacaagcagacagctcgtaaaatttattccgtcataaaagagcaagtcaagcatgaatgcagttccacaggaagaattaccgaatgtcgtcaaaatataggacgcattatcgaatttacccaagacaaacgctttgacagtaggtttaaggacttaaaaaaagaatccttatattacctaaataaacatcctgatttagtagcctcttatttgaaggctgaatacgaaaagctggatagggaagacaaaagtatcctgcaccgctacatctcacccggggctgaaatcgtttcgggcagtttgggggttgttctttcaggagtagccggaggcggatcttgtgccgagactttcggcttaggctgtgccgccgctttggttggtgtaacgtcttcctacgatcatgtcattactgggacgaaaaacttcggaaaaaaagccagcgagcaacgaccgacgattgcggttcaggccttgaagcagttggggctgtcggagcaggctgcggaatatgttcagttctctatagatttgttcagtgtgggtaaatcggggggcggtatacctaaggctaagcctgtgtttgatgcgaaaccgagatgggaggttgataggaagcttaataaattgacaactcgtgagcaggtggagaaaaatgttcaggaaacgagaagaaggagtcagagtagtcagtttaaagcccatgcgcaacgagaatgggaaaataaaacagggttagattttaatcattttataggtggtgatatcaataagaaaggcacagtaacaggagggcatagtctaacccgtggtgatgtacgggtgatacaacaaacctcggcacctgataaacatggggtttatcaagcgacagtggaaattaaaaagcctgatggaagttgggaggtgaaaacgaaaaaaggtgggaaagtgatgaccaagcacaccatgttcccaaaagattgggatgaggctagaattagggctgaagttacttcggcttgggaaagtagaataatgcttaaggataataaatggcagggtacaagtaaatcgggtattaaaatagaaggatttaccgaacctaatagaacagcatatcccatttatgaatagtaatatttatgaaaaattaggagattaatgatgaaaagaattaagtgcttttgtgataaatttccatcaggagatacatttagaatgtgtatcattctggatgactatgataatagggttgattattatgtaggaatatatgattacattacgtctaccttaatgagcgatatttactatcgatccacgattgatgagcatttcaagattatagaattaatagaaaataatccaaatgaaatttatgatgatggcggtggtcaacaattttgcctagaatttcatcatgataaggtcattttttaccacaatgaatttgatgaagaagatggttatccagtattaagctgttcgctgcatacttttaaaactgctttaattgcttggaatgcttttttgcaattgcctaaaagtattcattcggtggtggagactgtgattgaggaataagcataattagcttaatgaatagaatcagcgatatagattggactgcaaatccacgcttatacgctgtgccatgattaagatgttagaacttgtattgaatacaagttctcataaacgaatggcagtaagcatttgatttagataaaatccttgaattagaataatcaggtctaagagctcgacaggacaaatgaggctggcaaccaaggatttggcggaagccattaggaaaggacaggttcgcaaatcaagctttaacacagaacaattaagggcaattgaaaaaggagaatctaaaataccggattacacttggcatcatcatcaagatacaggaaggatgcaattgattcgtgaaggcttgcatcatgataccggccatattggttgggaagcaatgaacaaaggaaggtaactatgtggaaaatcataaaagaggatagtgatgatttagaatttgcaattaaatgcttattctctcagtctattgatttaaatgaattcaagttatggattgaacaagtaatacgcgatatgcccatcgaggacatccctttttatatttttgatttggcggattttgatgggggaattgccgatattgacaatattgtaggttttgtttcaagttgcagactatcaaaatcgaaaaaaaatgccttgaccggcattgccttcttaagggggatagatgtctatgatccgcctatttcaaaagaaaaagcattaaaagccttagagaaacatcctgaaatttatcagaaatttcagcatttctttccgtttgtagaactgcccccgctttaaacagtcaaaatgccgtctgaaacgatattcggctttcagacggtatttttgatataaagcgggtaactaaaagagcgtttgacggcaaaggaagataattatgtggaaaatcataaaagaggatagtgatgatttaggatttgcaattaaatgcttattctctcagtctattgatttaaatgaattcaagttatggattgaacaagtaatacgcgatatgcccatcgaggacatccctttttatatttttgatttggcggattttgatgggggaattgccgatattgacaatattgtaggttttgtttcaagttgcagactatcaaaatcgaaaaaaaatgccttgaccggcattgccttcttaagggggatagatgtctatgatccgcctatttcaaaagaaaaagcattaaaagccttagagaaacatcctgaaatttatcagaaatttcagcatttctttccgtttgtagaactgcccccgctttaaacagtcaaaatgccgtctgaaagccatttccgccgctcagacggcattttcgccccttttgtttacaaacccttaaaatccctttacactcaaaatccgttcaacatcaaacaaaccccgctatgaaaaccctgctcctcctcatccccctcgtcctcacagcctgcggcacactgaccggcatacccgcccacggcggcggcaaacgctttgccgtcgaacaagaactcgtcgccgcatcgtcccgcgccgccgtcaaagaaatggatttgtccgccctaaaaggacgcaaagccgccctttacgtctccgttatgggcgaccaaggttcgggcaacataagcggcggacgctactctatcgacgcactgatacgcggcggctaccacaacaaccccgaaagtgccacccaatacagctaccccgcctacgacactaccgccaccaccaaatccgacgcgctctccagcgtaaccacttccacatcgcttttgaacgcccccgccgccgccctgacgaaaaacagcggacgcaaaggcgaacgctccgccggactgtccgtcaacggcacgggcgactaccgcaacgaaaccctgctcgccaacccccgcgacgtttccttcctgaccaacctcatccaaaccgtcttctacctgcgcggcatcgaagtcgtaccgcccgaatacgccgacaccgacgtattcgtaaccgtcgacgtattcggcaccgtccgcagccgtaccgaactgcacctctacaacgccgaaacccttaaagcccaaaccaagctcgaatatttcgccgttgaccgcgacagccggaaactgctgattacccctaaaaccgccgcctacgaatcccaataccaagaacaatacgccctttggaccggcccttacaaagtcagcaaaaccgtcaaagcctcagaccgcctgatggtcgatttctccgacattaccccctacggcgacacaaccgcccaaaaccgtcccgacttcaaacaaaacaacggtaaaaaacccgatgtcggcaacgaagtcatccgccgccgcaaaggaggataaaccgtgaaaccgctgcgcagactgacaaacctccttgccgcctgcgccgtagcggcggccgcactcatacagcccgccctcgcggcggacttggcgcaagacccgttcattaccgataacgcccaacggcagcactacgaacccggcggcaaataccacctcttcggcgacccgcgcggcagcgtttccgaccgcaccggcaaaatcaacgtcatccaagactatacccaccagatgggcaacctgctcatccaacaggcaaacatcaacggcacaatcggctaccacacccgcttttccggacacggacacgaagaacacgcccccttcgacaaccacgccgccgacagcgcgagcgaagaaaaaggcaacgttgacgaaggctttaccgtataccggctcaactgggaaggacacgaacatcatcccgccgatgcctacgacggcccgaagggcggcaattaccccaaacctacgggcgcacgagacgaatacacctatcacgtcaacggcacagcccgcagtatcaaactcaatccgaccgacacccgcagcatccggcaacgcatatccgacaattacagcaacctcggcagcaatttctccgaccgcgccgatgaagccaacagaaaaatgttcgagcacaatgccaagctcgaccgctggggcaacagcatggagtttatcaacggcgtcgccgccggcgcgctcaacccctttatcagcgcgggcgaagccgttgaccagtggatgcaggaaaaccccaatgccgccgaaaccgtcgaagccctggtcaacgtcctgccgtttgccaaagtcaaaaacctgacaaaggcggcaaaaccggggaaggctgcggttagtggggatttctcagactcctacaagcataacactgcttcaagattatctcagtctgtagatggagaaatgtttcaaacccgcaatgttgattttaaagcaaaatctattgggactaaaattcatgatggagctcaagggaaacatatttcaggacatagaaactacattgaaggtaagagtactttaaatcaaaacattaatcctcaagaattgttgaacggaatacattcaggtgcttatccagttatttctaaaggagcaagaggaaatcctgttgttgattttgggtatcctataggcagcgatgggaaatcaggattaagtaccaattttggtacgattcattcaggtaaaaatggagttcacattgttccggctaaccctaaaaccattaaaaaggtgcaatagttatgaatatattaccaagctggctgcgagtcggtatgaatatagcaatgctgggcatgatacactcagatatcaggttaattaccgtagattacgaggaaggaagaaggtttttaaaaatcaaaaattatttatcaagagaagccatcacagaagaccatgaagatatggaatatttgattacagagttatggtctatgtgtggagaatattttgatgaagctgactttgaatgtatttattctaatcattcttctatggagttaaaccaaataaatggtgcagtattcaggagaaaggaattaatttcgcaagcgtaggttaaaaaaaccaacaatcacaatgtcttctgaaaccgtgtttaattttcagacggcatttccttcatttgaaataggatattgagaactgagttcttcaaaaatcctacacctgctccttccacggcagcaccttggtcaaaacggcagacggctacaaagccattgcccgtatccgaaccggcgaccgcgtcttcgccaaggacgaggcaagcggaaaaacgggatacaaacccgttaccgcccgatacggcaatccgtatcaagaaaccgtttacattgaaatttcagacggcatcggcaacaaccaaaccctgatttccaataaaatccacccgttttacagtcaaggaaaatggatacaggcaggtcgtctgaaaaaaggcgacaccctgctttccgaaagcggcgcaaaacagacggttcaaaacattaccttcaaacagcagccgctcaaagcctacaatctgaccgtcgccgattggcatacctacttcgtcaagggcagtcaggcggaaacggaaggggtttgggttcataatgattgtccgtatgataaaggcaaccaacgatataaagacgcttcttatcatggcaaaaatgataattctgtgaaaagtagagcaccaacaaacggacaagcagctcttgataattccgttcaagttaaatcaacttctcctcgaagagttggggttgataaagccaataatgaaatcgttgtattaaacaaaactcaaacttttaataacggttctgcggaatatcacgggcatgtcagaagttggcaagatttgcataccgatcagaaaaatgctttaaaaaaagcaggattggattagttaattcaaaaggaaaaattaaaaaatgactgataaaagtaaaacagaaaagttgatttcttctgatgataaacaaagtgttatagatggcattcttgatatggtatttaattccaaagcatatgaagtaccgtggatttctgagaaattgatggaattatcgaaaaataaagacttggatattgccggattatcgctaacctgtttcggacatctcgccaggctacattcaaatatcggtgattacgataaagttattcctttactacattcaaagcaagatgatccagagcttcaaggtagggctgaagatgcgttagaagatatttctttatttttatctgaaaatcattaggaaccgtaggtcgggttgaaaacccaacaatcaaaatgccgtctgaaaccgtgtttaattttcagacggcatttctttcatttgaaataggatattgagaactgagttcttcaaaaatcctacacttgctccttccacggcagcaccttggtcaaaacggcagacggctgaaaagcaaacaccgtccgtcgtgttgccgtttgcggatgagtacgggtcaaccccaatgccgccgaaaccgtcgaagccgccttcaacattgccgccgccaaagccgcaaagttggcaaaaacggtaaaaccggggagataaaagccgatggcaggaaagtaaatgtgaggatagacagtacggaggcagacctgctttatccggcagggcaataagaaaacaaaaattagatatggaaaacgattgtgaagattaaaccattacaattttctaacaataatcacagattttatgtggacaaaatttgtgttaccgaacaagatgtgaacattttggcatccgaccgaaattatgaattaaatattgaaatatttattgacaatataattcattttcaaataacggatgaatcttataaagtaaaattttcagaatatttatttgaaaataaagaaaaaaatgattgggatagaaatcctgctataaattattttttcgagataatagatgatagttatatggactggttgaaagaagaaagttttgatttttttgaaaagaaatattataaggcttatattttcttttttagcgattctgtaatagaagttatcagctcgacagaacctgtattttattcaaaataacaaattatcaaacaaagctctgattaaaaacccaacaatcaaaataccgtctgaaacgatattcggctttcagacggtatttttgacacaaagcaggtaaccaaaggagtgtttgacggaaaaggagaagctaaaataccggatgtatcggttgggaagcaatggataaaggtaaataattatgtggaaaattagtaaagaaaattgtgaagatttaggatttgcaatagtctgtatgttctatgatgctattaatctttctgaatttaaattatggttggatatagttgtcagagatattcctattgatacaattccattgtatatttttgatttgattgattttgataagagtataggggaaatttatgatgtaattggagtcgttaattatggttacatttcaaatgatcaaaaaaatgcattaacgggcattgccttcttaagggggatagatgtctatgatccgcctatttcaaaagaaaaagcattaaaagccttagagaaatatcctgaaatttatcagaggtttcagcatttctttccttttgtagagcttccgcttttttaaaagacaatatgccgtctgaaaagttttcagacggcattttttatttcttccagtaggcgggggtgaagaggatgaagacggtgaagatttccagcctgcccaagagcatggcggtaacgcagatccatttctgcatcacgtccaaaccggcgtaattgccggcgggcccgacttcgcccaggccggggccggcgttggtgatgcaggcgatgacggcggtgaaggcggtggtaaattccataccgctcgccatcagcaggaagctgaagaggacgacggtcataaagtagatgaagatgaaggacataacggtcagcgcgaggcggtcgggtatggccttgccgctgattttgacggtgcggacggctttggggtgcagcagcaccatcatttcgcgcaggctgaatttgaacaggacgagggcgcgtatggttttgatgccgccgccggtcgagccggagttggcgaggatgttggcgaggaaaaacatccacagggaaatcaggagcggccattgtgcgaagtcggtgttggccagcccgtttgccagtccgatggagacgaagttgaaggcggtgtagcgcagggattcggtaaaaccggcgtaatagccggtgtgccacaggtacagggcggcggcaaggatgctgccggagagcagcagcagcatcgtccggcattcttcgtctttccaataggttttgaggctgcggctgttgagggcggcgaaatggttggcaaaattgatgccgccgacaatggtgaaaacgatgatgaccgcttcgatgaggggggagttgtaataagctatgctggcatcgtgggtggaaaacccgcccagcgagagggtagccatcgcgtgacagacggcatcgaaccagcccatcccggcaaaatgcaggcaggctgccgcgaggatggtgatcagggtgtagccgaaccaaagttttttcgccacttgggaaatgcgcggcgacattttgctttctttgtcaatgccggggatttcggctttgaataactgcgtgccgcctacgccgagcataggcaggatggcgacggcaaggacgatgatgcccatcccgcccagccagttgagcatatgccgccaaaagttgacggagggggcgagcccgtcgacgtgggggatgacggtcgcgccggtggtggtcagtcccgacatcgattcaaaaaatgcgtcggtaaagcccatattcgggaaatacaggtacatcggcatcgcagccatagcggcaaacgccagccacaacatcaggacgagggtaaagccgtcgcgcgggcgcagttcgcgcctgaaccggagggtggcgagccggacgatgcacgagccggaaagggtaacggtcgcggtggtggcgaaggcggtgtacgcgccgtccgaaaaggcgtaggagagggcggcgggtatcagcaggataaaggaaaacagcatacccagtcgggagaggacgtgggcgatgggcaggattttgtgcatagtggggcggtccgttattttgcgaagcttttccagtctatgccgccggcggcttggacttgggtaatttcttccgtttcgaggttgacggcggtcagctgtccgccccacagcgcgccggtgtccagcgagatgacgttgtcggcattcgtgtagcccagcgaggaccagtgtccgaagatgatgtgcgtcgaggttttgccggtcgggggctttgaaccacgggcgcaggtaaggcggcatttttttcactgtggatttgtagtcgaaatccagttcgtttttaaaggtcagggcgcgcatccgcgtgaaggcgttgacgatgaagcgcaggcgggcatagcctttcaaaccttcgtcccacgcggccggtttgttgccgtacattttggagaagaatttgacgtattttttgccgcgcagttcggcttcggcttctctagcgagcgattcggctttggttatgcgccattgcggcaggatgccggcgtgtaccatcacgcggctgccctcgcgtatcaacagcggttgcgcacgcagccagtcgagcattttttttccgtcggggtgtttgagtatgggttcgattgtgtcgctgcgtttgggcgcaccttcgccgcagccgacagcgagcaggtgcaggtcgtggttgccgaggacgatttgcacgctgttttcgtgccggatgcagaattgcagcgtttcgagggatttcgggccgcggttgacgatgtcgcccgtcagccagagggtgtccgtgccgtggttgaaaccgattttgccgagcagcgcggtcagttcgtcgaaacagccttgtatgtcgccgattgcgtaatgtgccattgcagatgttgtgaagtgggaaagtgttgcggttcggacggcatggttttgaaatatcatgcagtccgaacgtggaattatgcgttcaaaacgaggacggcttcggcttcgacctgcacgcctttgggcagcgaggcaacgccgacggcggcgcgggcggggaagggctcggcgataaattccgccatgacttcgttgaagacggcaaaattgcccaagtcggtcaggtaggcgttgagtttgacgatgtcggccagcgtgccgcctgccgcttcggcgacggcttgcaggttttggaacacttggcgcgcttcggcgcggaaatcgccgttgccgacgacggtcatcgtggcgggatcgagggggatttgaccgctcatgtaaacggtgtcgcctgctcggacggcttggctgtacgcgccgatggcggcgggggctttgtcggtgtggatgatggttttggacatttcggattcctcaaaaaatagggcggcagaagccgcagcattcgggattatcgtacaaaaccgccggcttgtgtagttgcggtggcagaaaacaaaaccgccgaaggctcggcggtttgcagaataaggcgcatatcagaatttgacgcgcacaccggcggacagttcgccggaacggacgtttttgacagtgttgactttgccgatgtagttgtagcggtagccggcatccaaatcgacattcggggtaacggcatagcttacgcccgtcaatacgccgaggccgatggaggtttggctgaagctgtcgctgccgcccaagtcgacggaggcgcggttgaggctcaagcgcgcgccgagatacggtttgacgggcgattgggtgtcgaagtcgtaaatggcggacgcgccgatgctgtaaagtttgaaatcggtggatggggctttatagtttttgtagcgcgtgtaatcgacggcgaagcggaggtcgttgatgcggtagcctgcggagatgcgcgggctgaagcctttggcagaacctaaagagcttgaggcttttgcgtgtgcggcatcggcttggacgtaaaagccggatgcgccttccgccagtgcggcggccgggagagcgagggcaatcagtgtggcaagtgcttttttcatattttggttcctttatggtcagttagaaaaattgttaagaatccgttaaagaatcctgctgtattatacttaaattttctttttgcatcgtaatattttcaatacttcaagatacgtagcggtatccggctgctttgccgacggcaaagccgttaacccgcgcgttgcctttaaatggtggcggcggcatcacgcggcggatgggtgaaacttgcaaacggtttggaaaaaacagcggtatctgtcggattgttgcaggtgcaggcatacggttttgtgtgcgtctgtgccttaagcgtcggacatttccggcggcggctgtgccgtctgaaacgcccggcgggggatgcggctgcgttttccatcgataagcatattttccggacgcgttcggggcgggttttcccgggcggccgccgatttgtttgcgcttatatagtggattaacaaaaatcaggacaaggcgacgaagccgcagacagtacaaatagtacggaaccgattcacttggtgcttcagcaccttagagaatcgttctctttgagctaaggcgaggcaacgccgtactggtttttgttaatccactataaaaaacactgcagcaaatcgtttaaaaacaagcgtcctttttcggtcgggcggaatacggcagggtcggtttccagcaggcctttttgccttgccgtttcgatttgcgccatgattttggcactcggtacgcccgtgcgctcctgcaacatcgcggcgggtacgccgtcggtcaggcgcagggcgttcatcatgaattcgaacggcaaatcttcggcagcgacggttttgcgttcgacggcttcactcggttggctttgcattaaggcgaggtagtcgttggggtggcggcggcggacggtgcgctcgatgcggtcgggataggaaattttgccgtgcgcgcccgcgcctatgcctaaataatcgccgaactgccagtagttcaaattgtggcggcactgcatggctggtttcgcaaaagccgatgtttcgtagtggacaaaacccgcgccttccagcgcgccgtgtaccgcgtcttcgatgtcgagggcggcttcgtcttgcggcaaacctttcggcggcgtatgaccgaacggcgtgttcggttccatcgtcaggtgatacgcgctgatgtgggttgcgcccgtagcgatagcggtttgtacgtcgtccaatgccgtctgaacggtttggttcggcagggcatacatcaagtcgatattgactttatcaaataatttcaaggcggtatcgatagcggttaaggcttccttaccgttgtggacgcgccccagccttgagagcatatcgtcgttgaaactctgtacgccgatagaaagccgcgtaatacccgcgtctttaaatccttgaaacttctcgatttcaaatgtccccggattggcttccaaggtaatttccgcttccggctgcaagcgcaacagcgaacgcacgccgcttaacaaacggtcaatcgattccgcctgaaacaggctgggcgtaccgccgccgaaaaagatcgtttccaccggcctgccccaaatattgggcaattcaagctgcaaatcggtcagcagcgcgtcgatataggcggcttcgggcaatccgtttttcaggctgtgggaattgaagtcgcaatacgggcattttttgatgcaccacgggatgtggatgtaaagcgacaggggcggcagggcggtgagtcgggtgcggtttggaaaggaaatggtgtgcatggtgtggttcggaaaagtgggcaatgccgtctgaaggcggttcagacggcatgggttcagccgagcagggtaagcagttcggcttcgctgaggacggaaacgcccaaggcattggctttttccagcttgctgcccgcggcttctccggcgacgacgtaatcggtttttttggacacgctgccggaaactttgccgcctgcggcttcgattagggattgggcttggtcgcgtttgagggtgggcagggtgccggttaacacgaaggttttgcccgccacggctttattgatgccgtctgaaccttgcgccgcctcgtcttcagacggcatttgcgcgaagaaggttttcaggttttcgagcagggcggcgttttgtggttcgctgcgccacgcctgccagtcggtggggagggctttgtcggtttgcagcccttctatgtttttgccggcgagttcccataaggcttgggctttgttttcgctgattttgaaaccgggcaggcgggcgatccagcgttgcggttcggcgtggcgggcgggcgggatggtaacggcttgggtttgcggggcaacgcctgcggcgagcagttcgtctatcatcgcctgctgttcggcttgggcgaagaagtgggcaatggaacgcgccactaccgtaccgatgtcgggcaggcaggcgaggacgggttcgggggcgcggcggacgcgttccaatgtgccgaatgcctgtgccagcgttttggcggtgcgttcgccgacgtggcggatgccgagcgcgaacaggaagcgggcgagttcgggcgttttgctggcttctatgcctgcgaggatgttttccgcccacttgactggttgttttttatgtttgcccgacgcgccgaccgaactgccttcagacggcatttgatccgattcggcaacggttttgtccgctgtttccttcattttttgcaaggtcgggatgtcgaggcggtagagatcggcgaagtggcggacgaggtcttgcgcgacaagctgttcgatttgtttttcacccaagccgtcgatgtccatcgctttgcgcgaggcgaagtggattaagccttgcgcgcgttgtgcctgacaaagcataccgccgctgcatcgggcgacggcttcgccttcttcgcgttcgatttcgctgcggcagatggggcagtgggtcggcaggcggtagggcttgtggagcggaacggattgggtttgattggcggacggtgtttcggcaaacaaatcgtcctgccgatgcccgatgccgtctgaaacggcaacggcggtttcccgcatcgggcggcgttcaaaaatcacgcgcacaacttcgggaatcacgtctccggcacggcgtacgacgacggtatcgccgacgcgaacgtctttgcgcgatacttcgtcctgattgtgcagggtggcgttggtaacagttacgccaccgacgaatacgggctgtaatcgggcaaccggcgttaccgcacccgtcctgccgatttgcacgtcaatcgcttcgacaatggtcagggcttcttcggcagggaatttgtgggcaaccgcccaacgcggcgcgcgggagatgaagccgagttcgtgctgttgcgccaagctgttgactttgacgaccatgccgtcgatttcgtagggcagttcggggcgtttttgctgcatgtgttcgtaaaacgccaatacttcgtcgatatttttgaaacagccgaaattgccattgggcagactgaagccgagtgcttggaaataggcgagttcctggatgtgttcttccgcgacgaaaccatcttgctggcgggcgacggagtaggggaaaaagtgcagtttgcgttgcgcggtgatgcgcgaatcgagttggcgtaggctgccggcggcggcgttgcgcggattggcaaagggtttttgcccgttttcggcttgtcttttattgagggcgacaaaatcggctttgagcatcagcacttcgccgcgtacctcgatgagttcgggcgtattttcgccgtgcagccgcaaggggatgttggatacggttttgatgttttgggtaacgtcttcgcccgtcgtgccgtcgccgcgcgttgccgcctgcaccaatacgccgtcgcggtagagcaggctgatggcgaggccgtcgaatttgggttcgataacgtattcgggattgccgccgtccaagccgtcgcgcacgcgttggtcgaaggcgtacatttcggcatggtcgaacacgccgttttcatcttgcggggaaaaagcgttggtcagcgacagcatcggcacttcgtggcgtacttcggcaaatcccgccaaaggctcgccgccgacgcgctgggtcgggctgtcgggcagtttgagctcgggatggtttaactccaacgcttcgagttcgcggaacaatttgtcgtattcggcatcgggtacgctgggcgcgtcgagggtgtagtattcgtaggcgtagcggttgaggaggtcggtgaggcggcagatgtgttgtgcggcaaattgttttatatcactatcagacggtttaagaagattggtaaagttagtgttatgttttgagtttggattcatgagagaaggttttcagacgacctttgtctgatacgggatgaaacgggcaaaggtcgtctgaaaaatgataggttgaaaacagctgaattttacccgaaaaaaagcggatatgccgtaacgacatatccgctttgattgcattcgattttaggagaacaggcgcaatgcggttttgccgcccggttcgataccgactttgagcatctcggactgacgcgccaatacataagtgcgcacgtctttgagccattgggtcgaaacttcttccattttgtcgttgaccagattcaggttcaactggccggacaggcgtaccgccaaatccataaacaaatcgtcgaaggttttttcgcctgccggagagtgcgggatgtcgagcagcatactgaagcctttgtaggactggttgtccaaaagggcgttggtaaacggctcgttgttgagcgagcagatggagaacatggtcgagcccgacgtgtcggtatagtggaacgcgccgtcgtcttccaaaacgaaacccacgcccgttacggcggaacgcagttctacgccgctgatgctggtcggggaaaccaaatggatggcgatggtctggtcgacgcgcgcgcagaatgcgtccagtgcggaagccacttcgataaaggcggcaaggtcggtgtgcagcgtctgaccgcccatgctttgtgcgaatgcgtccacctggcggttgaatgcggagagttcttcctgcgaggcaagtccgttgcggctgactgcctgaatacccacgataaatgcctgatagcggatgcccgggatgggttcggcaatctggaaatggtcgtccatggtgcagccgacaatctggtagcggcagcggttggaaaggcgcggcagtgcgtgcagttctttggcttcggtcagcgcgatataggagatgaagtcgaagcgcacgtcaaaccagggtaattcgacttttgacagttctttgagcgtaatcagcggttttgcaggtgtttgcggaacgggtgcaggttttgccggcgcgtcggcaggtttcggtgcggaatgtccggtttggggttcggaaacggtgtgggcggagttgccgataatgccgctttcttccaaggcggtttcgatttcggttttgaacggggaggcttttgcctgtttctgcttggcgatgtagacggcatcctgttcttgcaggttgcgcatggcggggtcttggggttttgccgtttttttgaccgccggttggggtttcggcatcatgactgacccgccggacggtttgccgtcgcggacatggctggttttgctgttgagcagggcatctttgtcggagtgtccgaactggtcgcgcacttttttgcggtattggttttcctgatacatgttgtaggcgacaacggcgaggacgacagctagaaacagtacgatgtaaatcatggcaatcacttgttaaatttcgggatgcaggatacgcaaagtgcgggtactgcggttaaatcgggcttgcactgcggttaaatcgggcttgcgtttccggcagtctgacggaacggccgattataacgtttgaattataacgaaaattgcagggtctgacagcagtgtgtcgaaataagcggaaattttccgaaatgccgtctgaaatctgtggttttcagacggcatttctgtccacgagaaaccctttctcccgtatccgccgccagtcgaaaaaatggccggggtcggttttgcggccgggcgcgatgtcttggtgccccgttaccgccgtgacggggtagtggcggcagattgcgtccaacaaggcttcgagcgaacggtattgcgcttcggcaaacggttcgaaatcgcagccttccagttcgatgccgattgaaaatgcgttgcatttttccctgccgccgaatgaagatacgccggcatggtatgccatattgtcgcaggaaacgaactgtaccgtttctccgtcgcgtttgattaagaaatggctggatacgcgcaaagtgtgtatcaggctgaagaacggatgtccgtcggggtcgagccggttggcaaacagcttttccaccgcatccgtgccgtattcgaacggcggcagcgaaatgttgtgcaacacgatcagggaaaccgtttcccccgtttccctcgggctgaaattgggcgacggggtatggcgtatgctttgaagccagccgttttgccagtgtgcttcggcgtgattgtccatgatgttcttcctgtccggcgggcaatttgggttatactgtcgcccgaattttaagacgtattccgaatgctgggaatcctaccatgttgagaaaattgttgaaatggtctgccgtttttttgaccgtgtcggcagccgttttcgccgcgctgctttttgttcctaaggataacggcagggcataccgaatcaaaattgccaaaaaccagggtatttcgtcggtcggcaggaaacttgccgaagaccgcatcgtgttcagcaggcatgttttgacggcggcggcctacgttttgggtgtgcacaacaggctgcatacggggacgtacagattgccttcggaagtgtctgcttgggatatcttgcagaaaatgcgcggcggcaggccggattccgttaccgtgcagattatcgaaggttcgcgtttttcgcatatgaggaaagtcatcgacgcaacgcccgacatcggacacgacaccaaaggctggagcaatgaaaaactgatggcggaagttgcgcccgatgccttcagcggcaatcctgaagggcagtttttccccgacagctacgaaatcgatgcgggcggcagtgatttgcagatttaccaaaccgcctacaaggcgatgcaacgccgcctgaatgaggcatgggaaagcaggcaggacgggctgccttataaaaacccttatgaaatgctgattatggcgagcctggtcgaaaaggaaacagggcatgaagccgaccgcgaccatgtcgcttccgtcttcgtcaaccgcctgaaaatcggtatgcgcctgcaaaccgacccgtccgtgatttacggcatgggtgcggcatacaagggcaaaatccgtaaagccgacctgcgccgcgacacgccgtacaacacctacacgcgcggcggtctgccgccaaccccgattgcgctgcccggcaaggcggcactcgatgccgccgcccatccgtccggcgaaaaatacctgtatttcgtgtccaaaatggacggcacgggcttgagccagttcagccatgatttgaccgaacacaatgccgccgtccgcaaatatattttgaaaaaataaaccatgccgtctgaaaagtttgtgttttcggacggcatacccttaccggaactgcaagcatgaaaccgcaattcatcactttggacggcatagacggtgccggcaaatccaccaaccttgccgtcatcaaggcatggtttgaacggagggggctgcccgtgctgttcacgcgcgagccgggcggaacgccggtcggtgaggccttgcgcgaaatcctgctcaaccctgaaaccaaagccggtttgcgtgcggaaaccctgatgatgttcgccgcgcgtatgcagcacatcgaggaagtcatcctgcccgcgctttcagacggcatacacgtcgtgtctgaccgttttaccgacgcgaccttcgcctatcagggcggcgggcgggggatgccgtctgaagacattgaaattttggaacattgggtgcagggcggtttgaagccggatttgaccctgctgctggatgtgccgctcgaagtgtcgatggcgcgtatcgggcagacgcgcgagaaagaccgtttcgagcaggagcaggcggatttctttatgcgtgtgcgcggcgtttatctcgaccgagccgccgcctgtcccgaacggtacgccgttatcgacagtaaccgcaacttggatgaagtcagaaacagcatagaaaaagtgttggacggacatttcggctgctgatgcggcaaatattgaaacaagcgcatccgcccgcgccgaaaatcaaacggcagtgccgcaggtgaaaatggcggtatgcgccaaactttcggcatgatagaattacgctcggttacaaggcaggatgcgtcggcaatattaacgaaccgcccgtaacatgatgacccgaaagcgtttcggacagtccgattcaaatctttttctcgcaacaggattgacacatggaaaactcattgaaagaagccgccctcaagttccacgaattccccgtgccgggcaaaatttccgttaccccgaccaaatctctggcgaccgacaaagatttggcgttggcgtactctccgggcgtagccgctccttgtatggaaatccatgccgatccgcaaaatgcctacaaatacaccgccaaaggcaacttggtcgctgtcatttccaacggtacggccgttttgggcttgggcgacatcggcgcgctggcgggcaaacccgtgatggaaggcaaaggcgtattgttcaaaaaattcgccggtgtggacgtgttcgacatcgaaatcgatgaaaaagacccgcaaaaactcgtggacatcatcgccgctttagagccgaccttcggcggcatcaacctcgaagacatcaaagcacccgagtgtttctacatcgaacgcgaattacgcaaacgctgcaaaatccccgtattccacgacgaccagcacggcacggccatcattaccgccgccgccgtattgaacgccctgcgttttaccggccgtaaaatcgaagaagcgactttggtgtgttccggcgcaggtgcggccgcgattgcctgcttgaaccaattgctggatttgggcttgaaacgcgaaaacgtgaccgtttgcgactccaaaggcgtgatttaccaaacccgcgaagacaaagaccgtatggacgagtccaaacagttctacgccattgaagacaacggccagcgcgtgcttgccgatgccgtcaaaggcaaagacatcttcttgggcctctccggcgcgaacctgctgacgcctgaaatactgaacaccatgaacgaaaaacccatcgtgttcgctatggccaacccgaatccggaaatcctgccgccgctggcgaaagaaacccgtccggacgtggttatcggtaccggccgctccgacttcccgaaccaagtgaacaatgtattgtgcttcccgttcatcttccgcggtgcgttggatgtcggcgcgacgaccatcaacgaagaaatgaaacgcgcctgcgtgtatgctttggcggatttggcgatggaagaagtaaccgaagaagtggttgccgcttacggtaagaaatttgaattcggcgcggaatacctgattccgactccgttcgattcccgcctgctgccgcgcgttgctacggctgccgccaaagcagcgatggaaagcggtgtggcaacccgtccgattgcagatttggaagcttacgctgccaagctgagcgaatggaagctgtaagccgtttgcggtttaaaatgccgtctgaactgttttcaggcggcattttgctgtcagattgatatagtggattaacaaaaatcaggacaaagcgacgaagccgcagacagtacaaatagtacggaaccgattcacttggtgtttcagcaccttagagaatcgttctctttgagctaaggcgaggcaacgccgtactggtttttgttaatccactataaatgaaagatactgaaaaatgaaagagatgaaacctgtccgttatcatattggcgatatgcccgagacttcaaaacaaaccgcctcccgtcatgacgacagggcagtgggtgttgacgatgattgttttcatgattcctttggtcaatttttgtttgggtgttcggcagaggcaacccgaaccgcgccaatttctgtaaagcgcagttgcttatttacctgattggttcgcttatcggtttggtcttcgcgttgtttataggtgggtctgtatcaggtacgcatgattaatgccccgggctgattttgcttcgaggatttgtatcgaatatgccgaattgtttcaaatttcataccgttatcgaacggcattggcaaaaaccttatccggttttgtcttttctgcttaagccgctctccgggctgtttgccaaaattgcggcaaaacggcggacggattttttatcgggaaaacggcaaagcgaaaagctgcccgtgcctgtggtcgtggtcggcaatattcacgcgggtgggacggggaaaacgccgattgttgccgcgctggtgtcgggtttgcaggaaaagggcgtcaaggtcggcatcatcagccggggctacgggcgcaagagcaaggcggttcatgtattgaatgctgagagccgagcggaagatgcgggcgatgagcctttgctgctgttccgcaaaaccggtgcgccgacggcggtgggcagcagccgtgcagaggcaggcagggcgttgctggcggcgcatcccgacatcggactgattgtggcggacgacggtttgcagcattacgccctgcggcgagatgtggaaatcgcggtgtttccggcggcggatacggggcgcacggatttggatttactgcccaacggcagtttgcgcgaacctttgttgcggctggattcggtggatgcggtcgtcgtcagcggcggcaaggcggatgcgctgtttaggccgtctgaaaatatgtttcacagccgtatcgaagcgggacggatttaccgtttgaacaatccgtccgaaatactggacacaggccgtctgaaaaatcaaaccgtcgtcgccgtggcaggtattgccaagccggcgcggttttttgattcgttgcggaatatgggcattaccgtgaagcgaaccgtcgcgctgcccgaccacgccgacatttcggcggcagatttgcccgatgcggacgcggtcattattacggagaaagatgcggtcaaattttcagacggcatttgcaccgataatgtttgggtgttgcccgtttgtgcgataatcgaacctgatttggcggcgtttgtgttggagcggttggaagatgtaccgaaggccgtctgaaagcacggtttgggcggagtgattacggatttgaataagaacgcctcgcgccatcattcccgcgcaggcgggaatctaagtctcgaattttcaggaatgcctaggaggctccagaaatcccaaatctccggatttccacttggacaggaatgagaaaaccggtcgtattttttatctgcattaatcattcattaaaggattgaatattaaactgaaaaccttgttattgcccttcgccacgctggcattgtgcaccaatgcttttgccgccccgcccagcgacgcgtcgttggcgcgttggctggatacgcagaattttgaccgggatatagaaaaaaatatgattgagggctttaatgccggatttaaaccgtatgcggacaaagcccttgccgaaatgccggaagcgaaaaaagatcaggcggcagaagcctttaaccgttatcgtgagaatgttttgaaagatttgattacgcccgaagtgaaacaggctgtccgcaatactttattgaagaatgcccgtgagatatacacgcaagaagaaattgacggcatgattgccttttacggttcgcctgtcggtcagtccgtcgttgccaaaaatccgcgcttaatcaagaaatcgatgagtgaaatagcggtatcttggactgcattgtcagggaaaatcgcgcaacatcatctgcccgagtttacggaagagttgcggcgcatcatctgcggcggtaaaaatcccgatgcgggctgtaaacaagccggacaggttgggaaaaggcatcagaaataaatgatagccgtctgaaatattgaagagggcatccgattgattgaaccatcaaacccgaaagcaaccctatggaaaaaaaattcttagacatcctcgtctgccccgttaccaaaggcaggctggaatatcatcaggacaaacaggaattgtggagccgtcaggcgaagcttgcctatccgattaaagacggcattccctatatgctggaaaacgaagcgcgagcgttgagcgaagaggaactcaaagcatgaccgaattcgtcgtattgattccggcgcggctggattcgtcgcgcctgcccggaaaagccttggcggacatccacggcaaaccgatggtcgtgcgcgttgccgaacaggcggcaaaaagtaaagccgcgcgcgtcgtcgttgccaccgaccatcccgatattcagacggcctgtcaggcgcacggtatcgaagtcgtcatgacttcaaaccggcacgaaagcggcacgacgcgccttgccgaagcctctgtcgcgctgaagctgccgccgcatttgattgttgtgaacgtacagggtgacgagccgctgattgcccccgaactcatcgaccgcaccgccgaagtactcgtcgaaaacaacgtccaaatggcgaccgccgcccacgaattgcacgatttcgacgaattgatgaatcccaacgccgtcaaagtcgtcctcgacaaaaaccgcaacgccatctacttcagccgcgccccgattccctatccgcgtgatgcgatacgtgccggaaaacgcgaaatgccgtctgaaaccgccgtcctgcgacatatcggcatctacgcttaccgcgccggcttcctgcaacgctatgccgaaatgagcgtttcgccgctggaaaccatcgaatcgctggaacagctgcgcgtcctgtggcacggttatcccattgccgtcgaaaccgccaaagaagcccccgccgccggtgtggatacgcaagaggacttggacagggttcgcgccgtatttcagaccgtataaaacaggttcaaagggaaaagatatgcagcaacatattgaaaagtggcaacacttgagccgggaagaacagaaaatccttgctgaagtatggggtctcgtgcaaaacgacgatcaggaggttcactatgaaatgctcaaattgaacgcacccgatgaagccagcggcgaattttggttcagaatggcagaaacactcagcaccctgccgcccaaccgttccctcggccttagaatgaacggcggcaggctggcgaccgccgtatccatcctttccgtcatgattgaagacaatcccgacataccgcagctttgggcgcaaaaaattaccgcgctcaattatagtggattaaatttaaaccagtacggcgttgcctcgccttgtcgtactatctgtactgtctgcggcttcgtcgccttgtcctgatttttgttaatccactatatttggcacacgggcacaaagcccgtgccgacggtttggcacaacagcccgacaaagcggcagaagccaacgaggaggaatacctgaccaaagccctgtcgcaaaacctgctgtcaacattggatgtcgcgcttgcacgttttcctgaagacgcgtggtttcaggaaatcaaacaggatgcacaaaagcattttgcttgaggatgtggcagtcaggaatatttccattcaggaagaaaagaagtgcctgattgggtataatcagggtaaatcttattttatttcaaaagattaatatttgctttctgtttttccttgacggtatcggaaaagttgattatagttacagcttccttaggagtaatggctgagaggctgaaggcacttccctgctaaggaagcatgtggggtcaacctgcatcgagggttcgaatccctcttactccgccagataaaaaatagacgctgtgttttacagcgtctattttttatgcaattttatagcgggttggtgcaaaaccagtatggtattgccctgtcttgattctgaattttgttatagtggatgaacaaaaaccagtacggcgttgcctcgccttagctcaaagagaacgattctctaaggtgctggagcaccaagtgaatcggctccgtactatttgtactgtctgcggcttcgtcgccttgtcctgatttttgttaatccactataatccgagatgcttgccgtttatttccgcctcgttcaaacggcggctctgatttgcgcggtttctgtttgccgtattcgcctatccgtaccgcaaatgttatactgggaaaaatttactgattgtgttttacggcatatttgccgataggatggaagagacaaatgagcagaatccggcaggcttttgccgctttggatggcggaaaggcattgattgcctatattacggtgggcgaccccgatattcggacaactttggcattgatgcacggcatggttgcaaacggtgcggatattttggagttgggtgtgccgttttccgatccgatggcggatgggccggttattcagcgtgcggcggagcgggcgttggcaaacgggatttcgctgcgcgatgtcttggatgtcgtcagaaaattccgtgaaaccgacacgcaaacgccggttgttttgatgggatatttgaaccctgtacataagatgggttatcgggagtttgctcaggaagccgcaaaggcgggtgtggacggcgtgttgacggtggattcccctgtcgaaaccatcgatccgctctatcgcgagctgaaggataacggggtcgactgtattttcctgattgcgccgacgacgacggaagaccgtattaaaaccattgccgagctggcaggcggatttgtctattatgtttcgctcaagggcgtaacgggcgcggcaagtttggatacggatgaggtttcgcgtaaaatagagtatttgcatcagtatatcgatattcccatcggtgtcggtttcggcatcagcaatgcggaaagtgcacgcaaaatcggccgggttgccgacgcagttattgtcggcagccggattgtgaaagaaatcgaaaacaatacaggcaacgaggctgccgccgtcggtgctttggtaaaagagttgaaggatgccgtgcgctgacggcggttcctcatcctgaatattttaggagttgtccatgagctggttagataaaatcctgccacccaaaatcaagaatcgcggaaaagacggttcttccaatgttcccgagggtctatggcacaaatgcccgtcttgttcggcaaccgtttattctaccgagttgcagcagaacaatcaggtttgtccgaaatgcaaccaccacaatccgttgtcggcacgacaacgcctgaacctgcttttggatgaggatggcagggaggaagttgccggaaatgtcaaaccgacagatcctttgaagtttaaagacggcaaaaaatatccggatcgtttgagtgcggcacgcaagctgaccggggaagatgatgctttggtggtgatgaaaggcaagatgaacggcctgcccgtcgtcgttgctgcgtttgagttccgctttatcggcggttcgatgggttcggttgtgggcgaacgattcgtacaaggtatccgtcgggcggttgccgacaattgtccgttcgtctgtgtggcggcttccggcggcgcgcgtatgcaggagggtgtaaactcgctgatgcagatgacgaaaaccagtgccgcgctgcatttgctgacggaaaaacgcctgccatttatatcggtgttgaccgatccgactatgggcggcgtatccgccagcttcgcatttttgggcgatgtcgtgcttgccgaaccgaacgcgctgatcggttttgccggtccgcgcgtgattgagcagacggtgcgcgaaacgctgccggaaggcttccaacgcgccgagttcctgctggaaaaaggcgcaatcgaccagattgtcgaccgccgcgatatgaagcggcgcatcagtgatttgattacgctgttgtgccgtcaggacaaagtttccgccgcctgatggctgatgaatcgagtaccgtctgaaaccgatgtttcagacggtatttttgtgtctggttatttgttgtgcggctttatcgatggggcatagcgtccggcacgttctttcaggcgttgtaccaaacctttcgtgtcggcgggtacaccgccctcgcagaatgcctgatacaggacggtgcgcagtgcgtcgttgcggcttaatgtaccgcctatcggtttccattcggcgtttcggggctgtatccagcggcggttgaccgtgtcgccgtagccgaacactttataggaggaaggtttgccgttgccgaacctgatggagaagcgggcgcagaatatgcctttggcagtcaggttgtcgtagcctttgtcggagcggatattgagaatgtagcggatgctgccgtcgggcgcgggcataatttgcaggctgtcgagcaggattttcggctgtttgccgtaattttcatccacataaatgtcgaaccagccgtccgagtgcgtatcgggcagcggcggcagtttggcggtatgttctttaaattcgcgggcggcggcctcttcgggcgtttcgcggtagcgggtgttgatcggcgtgtctttttggctgaagccggcagcgagggacgtgccggcggcgagtgcgagcagcaggagggcggtgcggcgcataagtttctccaaattgaaaacggcgttattttatgggttggcaaagggggctgcaagcaactggggtataatctccccccgattcccattttttaaacggtacaaacgatgaacagcgaaactttagacgtaaccggattgaaatgtcccctgccgattttgcgggcgaaaaaggctttggcgcaaatgcagcagggcgacgtgttgaccgttctggcaaccgacggcggcgcaccgggggattttgaggctttttgccgccaaaccggtcatgtgctgttggatgcttccgaacaggacggcgtgttcacgctggtcgtccaacacaaataaatgccgtctgaaatgcggatgtcccgcccgacggcgttgtttttgaatatcgtatgtgccgcgtgccgtttcaaaaacaaaccgtccggcgtgcagtgtcggcatttcgggcgtatcgccgccgatttgttccggaatggctgttaaccgccttgccgtcggcaaagaagcaaaacccaagcacaatcaaaatctaaaggctgtgtttgaagattccgttgatgcaacccaatcagtcggacaaaatgcctttcatccaatggaaccggtttccgaccggacggaataaccggctttcccccggcaaacggatggaatcgaccgggtattcaaacgcagccaaaacctaaaaaggaacaaccatgcaaaccctgaccattatccgccccgacgatatgcacctgcacctgcgcgacggcgacgcgctcaaagccgttgccccttataccgcccgccaaatggggcgcgccgtcattatgcccaacctcaaaccgcctgtcgtcagtgtagccgacgcgcttgcctacaaagcgcgcattatggcggcgttgcccgaaggtagcgcgtttgagccgttgatgacgctttatttgactgataacgccacgcccgaacttgtacgcgaagccaaagccgccggcatcgtcgccttcaaactctaccctgccggcgcgaccaccaattccgattccggcgtaaccgacctgttcaagctcatccccgtgttggaagaaatggcgaaacagggcattttgttcctcgttcacggcgaagtaaccgaccccgaaatcgacatcttcgaccgcgaagccgcctttatcgggcgcgtgatgaaacccgttttggcgcaagtgccgaatcttaaagtcgtgttcgaacacatcaccaccgccgaagccgcccgcctggttttggaagcaggcgacaacgtagccgccaccgttaccccgcaacacctcctgctcaaccgcaacgacctcttggtcggcggcgtgcgcccccatcatttctgcctgcccgtactcaaacgcgaaacccaccgtcaggcattggtcgccgccgttaccggcgagaaggcgcataaattcttcctcggcaccgactccgcgccgcacgccaaatccgccaaagaaaacgcctgcggctgcgccggtatgttcagtgcgatgaccgctatcgagctttacgccgaagtatttgaaaaagcaggcgcgttggacaaactcgaagccttcgcctcaaaaaacggcgcaaggttctacggcattcctgaaaataccgacacgatcaccctcgtcaaacaaagccaaaccgttcccgcaagtgttccctacggcgacggcgaacttgtcccgatgcgcgcgggcggcgaaatcggctggacggtgcagtattgatgggctggaaacaaaatgccgtctgaagggagggctttcagacggcatttgtgttgctgactgattgatacgtcaacggcgtttgagtttgttacgtttcggttatttccgataaattcccacaattttcaaatttcgccattcccacgaaggcaggaatccagaaattcgatgcgaccagagtttatcaaaaacggcagcaactcaaaaaaccggattcccgcctgcgcgggaatgacgagattgaagtttcagaatttatttgaaatacccaaaattcaaaaaaccaaattcccacctgcgtgggaatgacgaaacaaagaaagcagaaataaggacatagaactttctttaaatttgtgatgcatcaacggcgtttgggctcgtcggggcggatttgggcggcgagtttgtcgaggatgccgttgacgaatttgtgcccgtccgtgccgccgaaggttttggtaacttcgatggcttcgttgataatgacggggtagggcgtttcgggcatggcggacagctcgtggcaggcggtcagcaaaacggcgcgttcgatggggttgaggtctttttcgtccctgtcaagtagcgggcggatttgtcggatatactctgccgcattggtttgcgtgccgaagaaaagtttgttgaacaattcttcgtctgccttggcaaagtcggacatttcgcggatgtttttagcaatttcgggcgcggcggtgcggttgataagggattggtaaacggcttgtacggcaagctcgcgggaacggcggcgggctgttttcatgatttttccttgaaacggttgggcggcacggtatgccgtctgaaacggaaagggtgtattggtgtacgccctgtttgttattcttcgtcttcaaactgttcttcgagcagcaggttgacgaggttggcgcattcgacggcgactttggcggcatccgaggctttttcttcaatccgttcgattgcctgcgcgtcgttttcggtggttaggacggcattggcaatcgggatattgtagtcgagtgcgacgcggctgacgcctgctccggattcgttggaaaccagctcgaaatggtaggtttcgccacggatgacgacgccgatggcaatcagtgcgtcaaacttttcggaagaggcaaagttcatcagcgcgatggggatttcaagcgcgccgggtacggtggcgacggtaatgttttcgtctgccacgcccaattcttggagggtgcggcagcagactttgagcatttcgctgccgatttcgttggtgaagcgtgcctgtacgatgccgatgcggaggtgtttgccgtcgaggttgggggcgatggtgttcattgggtgtcctttggtattcggaggtttcggaatgccgtctgaaggtttcagtcttgcggctgccagtcggcgacggtttggaatgtgccgtcttcggcaagctcccatgcgctgccttcgggttgggagagcagtgcggcggtttcagggttggttttggcgatgtcggcgaggctgacgatgctgaagttgtccggatcgtcggtgtattcgtcggtctcgtcgccgctgaagaaacgccagccgctgtcgttttcaaaaacgggggcttcgcggtagaggaagccgacgggccggttttgtttggcgacggtgttggtggcgatacagcggtcgagtgccgaggaaagtgcttgtgcaaatgcgttcattacgggaatacgttgggggaaaacttacggattttaccacgattcgtgcgttgtcggcagacggcggcggtttggtggtacaatgtgcgccgtttgcagccttaaggtgtttctgtatttttggagtatggaaacgcattcgggctgttttttgcggaagacggtaatgaaagacgatgttttgaaacagcaggcacacgcggcgatacagaagaaactgggctacgcgttccgcgatatttcgcttttgcggcaggctttgacgcacaggagccatcatgcgaagcacaacgagcggttcgagtttgtcggtgattcgattttgaattatacggtggcgcggatgctgtttgacgcgtttccgaagttgaccgagggcgagttgtcgcggttgcgggcaagtctggtcaatgagggcgtgctggcggaaatggcggcggaaatgaatgtcggcgacggcctgtacttgggggcgggcgagttgaagagcggcggcttcagacggccttcgatactggcagacgcgatggaggcgatgtttgctgccgtcagcttcgatgccgatttcaacacggcggaaaaggtggtgcgccatttgtttgccgatcgcgtccggcgcgccgattttcaaaatcaggcaaaagacggcaaaactgctttgcaggaggcgttgcaggcgcgccgtttcgccttgccgaaataccgtatcgaagagcaaatcggttatgccaacgacagtatgtttgtcatttcctgcgatttgggcgaactgggtttcgtgtgccgtgccaaagggacgagccgcaaggcggcggagcaggaagcggcgaaagaggctttgaaatggctggaagagaagctgccgctgaagaggaaaaagaaatgaggcggcgcgtgaatatgccgtctgaacatatggatacgaaagcaaatatggatattgaaaccttccttgcaggggaacgcgccgccggcggataccgttgcggcttcgtagcgattgtcggccgtccgaacgtgggcaaatcaacgctgatgaaccatctcatcggtcagaaaatcagtattaccagcaaaaaggcgcagacgacgcgcaaccgcgtaacggggatttataccgacgataccgcgcagttcgtgtttgtcgatacgcccggctttcaaaccgaccaccgcaacgcgctcaacgacaggctgaatcaaaatgttaccgaggcgctcggcggcgtggatgtggtggttttcgtcgtggaggcgatgcgctttaccgatgccgaccgcgtcgtgttgaaacaactgcccaagcacacgccggtcattttagtggtcaacaaaatcgacaaggacaaggcgaaagaccgttacgcgctggaggcgtttgttgcccaagtgcgcgccgaatttgaatttgcggcggcggaggcggtcagcgcgaaacacggattgcggattgccaacctgttggagctgattaagccgtatctgcccgaaagcgtgccgatgtatcccgaagatatggttacggacaaatcggcgcgttttttggcgatggaaatcgtgcgtgaaaaattgttccgctatttgggcgaggaattgccttatgcgatgaacgtcgaagtggagcagtttgaagaggaagacggtttgaaccgcatctatatcgccgttttggtcgataaggaaagccaaaaggcaattttaatcggtaaaggcggagaacgtttgaagaaaatttccaccgaagcgcggttggatatggaaaaactgtttgataccaaagtatttttgaaggtctgggtcaaagtcaaatccggttgggcggacgacatccgcttcctgcgcgagctgggtttgtagtttttcttgctgaactttacgcaaatgccgtccgaacaggtttcagacggcattttgtttcaatcgggaatatctttgttaaaaacgggttgatattatctgtgcatattatagtggattaacaaaaaccagtacggcgttgcctcgccttagctcaaagagaacgattctctaaggtgctgaagcaccaagtgaatcggttccgtactatttgtactgtctgcggcttcgtcgccttgtcctgatttttgttaatccgagacctttgcaaaaatagtctgttaacgaaatttgacgcataaaaatgcgccaaaaaattttcaattgcctaaaaccttcctaatattgagcaaaaagtaggaaaaatcagaaaagttttgcattttgaaaatgagattgagcataaaattttagtaacctatgttattgcaaaggtctcaatccactataaagaccgtcgggcatctgcagccgtcattcccgcgcaggcgggaatctagtccgttcggtttcggtttttttggctagtgccgcaacattaaatttctagattcccactttcgtgggaatgacgcgattagagtttcaaaatttattctaaatagctgaaactcaacgcattggattcccgcctgcgcgggaatgacgaatttcaggttgctgtttttggttttctgctttttccaataaatgcccccaacctaaaatccgtcattcccgcgtaggcgggaatctagacattcaatgctaaggcaatttatcggaaatgactgaaactcaaaaaactggattcccactttcgtgggaatgacgaagtggaagttacccgaaacttaaaacaagcgaaaccgaacgaaccggattcccactttcgtgggaatgacgggatgcaggtttccgtatggatggattcgtcattcccgcgcaggcgggaatctaggtctgtcagtgcggaaacttatcaggtaaaacggtttcttgagattttgcgtcctggattcccactttcgtgggaatgacgcgattagagtttcaaaatttattctaaatagctgaaactcaacgcactggattcccgcctgcgcgggaatgacgaatttcaggtttctgctttttccaataaatgcccccaacctaaaatccgtcattcccgcgtaggcgggaatctagacattcaatgctaaggcaatttatcggaaatgactgaaactcaaaaaactggattcccactttcgtgggaatgacgaagtggaagttacccgaaacttaaaacaagcgaaaccgaacgaaccggattcccactttcgtgggaatgacgggatgcaggtttccgtatggatggattcgtcattcccgcgcaggcgggaatctaggtctgtcagtgcggaaacttatcaggtaaaacggtttcttgagattttgcgtcctggattcccactttcgtgggaatgacgcgattagagtttcaaaatttattctaaatagctgaaattcaatgaaccggattcccgcctgcgcgggaatgacgaagtggaagttacccgaaacttaaaacaagcgaaaccgaacgagccggattcccgcttgcgcgggaatgacgggattaagttttcaaaattcatcagaaattactgatttaatagcataaattttttagattatagtggattaacaaaaatcaggacaaggcgacgaagccgcagacagtacaaatagtacggaaccgattcacttggtgcttcagcaccttagagaatcgttctctttgagctaaggcgaggcaacgccgtactggtttttgttaatccactataagtcattccggcggcaatttttgttgctttaacgggataggcggttggcggttgcgataaaggcggcgactttggcggcatcttttttgcctttagacgcttccacaccgccggatacatcgaccgattccgctccggtgatgcggacggcttcgccgacgttttcaggggtcagcccgccggcaagcacccacggtttgcccgaatattccgccagcagcgtccagtcgaagcggtttccggtgccgccgtattccgaaggatggtaggcatcgaacagcagtgcctgagcgtcggggaagcgcgtggcggcgtttcggatgtctgatgccgtctgaacacgaatggctttgatataggggcggtggaactggcggcagaatgcgtcgtcttcgtcgccgtggaattggatgatgtgtatcggcacttcggcaaggatgcggcggatgttttgcgcgctttcgttgacgaaaagggcgacaacgctgacaaacggcggcagtgcggcggtgatttttttggcgcgggcaatatcgacggcccggctgctgccttggaaaaagaccagcccgacggcatccgcacctgccgctgcggcggcagctgcgtcttccggtgtggtgatgccgcagattttggtgcggattttcctcattcggtattcctttatttgggaaacggcgcgcttttgccgtttcagacggcattcccgatcagtcgattttgatgtattcgacagaaaggatttcaatttcctcacgcccttccggcgtgttcaaaaccacttcgtcgccttcgcgcgctttaatcagacaacgagccagcggcgaaatccaagaaattttgttttgcgcggtatcgatttcatcgatgccgacgattttgacggtttgctcgcgcccgtcgtcgcgcaacagtccgaccgtcgcgccgaaaaacacttggtcggtcgcttcgcgcaattcgggatcgacgacgacggcagcctccaaacgtttggtcaggaaacggatgcggcggtcgatttcgcgcatacggcgtttgccgtaaagatagtcgccgttttcgctgcggtcgccgttgcctgccgcccagttgacgatttggacgatttcggggcgttctttgttgaccagttgataaagctcgtctttcaatgcctgccatccggcgggcgtaatgtagtttttggtttcggtactcatattgtgtgcggatgaaacgggaaatgtgatgccgatatgggaaatgccgtctgaaaacccggcgttcggatttcagacggcatcgcggtttgggaagccttattcttcgtcgcccgcatcgctgatgctgatgctgtgttccatcctgctcgggtggattttcagaccgccgcagccggatttctcggcagacaggcggtcgaggtaggcatcatcgatgtcgccggtctgataaatgccgttgaaacaggacgaatcgaaggattcgattttcggattgagtgctttgacgacggcttccaaatcgcccaagtcttgaaatacgatgccgtccgcgccgatttcggcggcgatttccgccgcgctgcgcccgttggcaatcaactcttcgcgcgtgggcatatcaatgccgtacacattgggatagcgcacttcgggcgcggcggaggcgatatagactttgcgcgcgcccgccgcgcgtaccatttcgacgatttcgcggctggtcgtcccgcgcacgatggagtcgtccaccagcaacacgcttttgcctgcaaattcggtttccatcgggctgagtttttggcgcacggattttttgcgcgtcgcctgtccgggcataataaaggtgcggccgatatagcggtttttaatcaaaccctcgcggtagggtttgtcgagatggacggcaagctccatcgcgctggggcggctggtgtcgggaatgggcatcacgacatcgatgccgtccacgggcagctcgcgtttgattttttccgccagcgacacgcccatatccaagcgcgattggtaaacggatacgccgtcaatcacagagtcggggcgggcaaaataaacatattcaaaaaggcaggggctgagtttggcacggtcgctgcattggcgggcaatcattgtgccgtcaaagccgacaaataccgcttcgcccggccggatgtcgcgttccaaatcgtaggtaagcgcgttgaaggcgacggattcggaggcgacggcataggattttctgccttcgctgtcggtttgcgaacccaataccagcgggcggatgccgtaagggtcgcggaaggcgagcataccgtagcccgcaatcatggcaatcacaccgtatgcgccgcgcaccaggcggtggacttgggcaacggcgttgaaaatattgtcggcattgagccggtgcgggtcggcgtttttagagacttcgcggcgtaattcgtgcgcgaatacgttgagcaagacttcggaatcggagctggtgttgacgtggcgcaggtgtttgttacacacgttttcatacagttcggcagtgttggtgaggttgccgttgtgcgccaaaacgatgccgaacggcgagctgacgtagaaaggctgcgcctccgcgctgctgcctgcgttgcccgcagtaggataacggacgtgggcgatgccggcgttgccggtcaaatcgcgcatattgcgtgtgcggaacacttcgcgcaccatgcctttgcctttgtgcatatggaaggtaccgccttccgccgttgcaatgcccgccgcatcctgccccctgtgctgcaacatctgcaagccgtcgtacagaagctggttcacgggttcatgactgaccaaacctaatacgccgcacatatcgtcttctccgattcgaggtttaagggtaaaacggaattataaagtaaacggtggttttttgcctgaattgttgacaatatttgagcgaaggacagataggtgggtttatggagaataagatttatagtggattaaatttaaatcaggacaaggcgacgaagccgcagacagtacaaatagtacggcaaggcgaggcaacgccgtactggtttaaatttaatccactataatctgtgatatggctgaggaaaggaaaaaacatttcagacggcataaaagaggatgccgtctgaaatatccgtatggcaatcaatcgtcttccggagtttccgccgtgccgccgctatggttcaacacggcttcggaaagcgatacgaaaaacggcagtgtgtaagattgccgccattcttcggtatcgggcaggtcggtttttgaagcaagcatgaccagcagggtaacaatcaaaacgcctttcaatgcaccgaatacgccgcccaaaatgcggttggcaaagcccaaaccgaccgccgaaactgcgctggtcagcagcgaacggagcattttctggatcagacaggcaatgacgaacagggaaatgaacgacagagccaatgcaaacaggcggggttggaacgaggcaaaggcgaggtcggcgaaggaggcggcaaagagtttggcgaaaaagaaggaaaccacccatgccgccattgagcctgcctccgcaatcacgccgcgcatcgcggatagcacgatgcaggcggcgatgacggcggagacgaggaggtcggcaatggggaggctattcattcgttacctgaccggcgataccgtgtacgcgcaatttgttcaaatcgcgttcggcatcccttgcgtttttatagttgcttgatttgacgcggtaaactttgccgttgtcggtcataatttcggtgatggtcgaatcgatacccgccgccttcattttgcgctggaggcttaaggcgcgttctttttcggcataacctgcctgaatggcggcttttttaccggatttttccttctcggcggttttggtcttgtccgctttgtcggttttttgtgccgtttcgtgttttttgccgtccgaacggtctttttcggctgtttttttgctttcagccttgtcggcttttttcgcttcttttaccgcgctgtcggattttgccgtatccggtttggttttttcggcggcagttttcggtttgtcggcaactttttcggcggttttggtttctttggctttgggcttggctttggcagtgcgttccgctttttgcggttttgtttcggcagtgcgtttcggtttttcaaccgctaccgtatccgtactgtcggcagttgccggcactttttcggcagcgcgttgttttgcctgcttcggtgcggttttggcggtttctgcctgttgcagtttctcggatgcttccaaacctttgatgttgctgtcttcgaggcgctcgttaatcagcaccagcggcgcgcctacgttttcaggctcgctgatttcgctgtcggcggcagaaggcttgtcttcgcctgccaagtcctgcggtttgtcggcggcggatttcaaggcaggggtttgtgccgcacctgccgctttgttttctacgccgcttgtttcgccggcagtctgttcggcagggccggaactgagggcggctgccagcaggatgcaggaggcggcaaccaggcaacttgccgttacgaggcggcggcggttgcgccgtttgagttgttcgtaaccgctcaggacttcgttttgtttgttttcggacatagaagtttccttttaaagtaccgacatgacatcggcaacggtatgaaatgagccgaaaacgacgattctgtcgttctcgcccgcttttgaggctgccgcccggtatgcttcgcggacggcggcgaatgtttgtatgttttcgatgctgtgttcgtgcagtttgttttgcaggctctcgagcgtcatgccgcgcggtacatccaacggtgcgatataccactcgtcaaactggtctttaacggtttccaacacgccgtctatgtctttgtcggacaacatgctgaacacggcggtgcgtttttgcgcaaacgccaaattaatcaggctgcggcgcagggcgcgggcggcgtggggattgtgtccgacatccaaaacggtcagcggccggccgggcaggacttggaagcgtccgggattttcaaccagcaacaaaccgcgcttgatggcaccgatgtccaccggcaatttgtcgttcaagcattccaatacggtcagcgcgcaggcggcattggaaagctggtatgtgccgcgcaatgcggggaagggcagggcattgcggttgcgcgcggggtcgtctgaatgttgcggccggaagcggtagttccattggatgttttccatcgcgtgaaactcgaaatcgcgctgcaccatcagcagtttcgcgcctatggcttcggcgtgtgaaagcaacgatttgggcgcggggttttgaccgcagatggcgggtttgccgctacggaacacgcctgctttttcaaagccgacctgctcgaccgtatcgcccaaaaatgcctgatggtccaaatccacgctggtaaccaccgcgcaatcgccgtcaaacgcgttgaccgcgtccaagcggccgcccaagccgacttccaatatcatcacgtcaacctgttcgcgcatgaagatgtcgacagccgccaaggcattgaattcaaaataagtcagtgatatttcgccgcgcgcggcttcgatgcgctcgaaagaggcaataatcgtatcgtccgaaacgggttcggcgttgatggcgatgcgttcgttgtaacgcaataaatgcgggctggtcagcgtaccgattttgtagcccgcctgtttgtaaatctgtgtcaggtaggcacagaccgaacctttgccgttggttcccgcgacaacgacgacggggcattgcggctcgagcttcatgcgttttttcacttcgctcgtgcgctccaaacccatgtcgatcaaaccgccgctgtgggcggtttccaaatgcgagagccagtcttgtagtgttttcatgagtgtttcgttttcaaatgccgtctgaaatcagtctgatgtatcggtttcggcggtttttttcggctgccgccaaagtacccaaactttcagcttgcggtaggattctttgtccgtcatgtcgggcatgatgcattggcggacggttttgccgccggtgtcccattgtaagaataaggcataaggcgtaaccatactgctgcccgacagtgccgccgcctttgccgttttgtctttgccggatacgatttccgcctgtccgtcgcggtctatggtaatggcggttatggcatggcggtgtttcagattcgttatcctgagcgagtatgcgtaacttgccaccaaagccgccaaaccgaaccacatcatccggccgtaaaaccaagtcaggcagacggcaagggaggcggcgtgaagcgatacagtcaggatgttcaggatgcgggacggcctcaatgccgtctgaaaggcgcgcacagccttacatcatgttgtcgaacacgggggtaatgttcaattccgcttcttccatgttcaacactatatcgtggatttcgatgtcgaaaaattcccaaaacgccttcagccccatatcttgcggccatttatccttatcgatgtcccaacctgccagctccgcctcgaaaatctgccggtagcgttcgtcgaagtaggaaacgacggcttccggttcgtcgaactgcggaacgaggaagacggaacagttggcacgaagctgctctatggtcaggtcgggcatattttcgtcggtgcttttgagccattccaaaaagcgcgcggtcggcttgaggacgacggcggtgcggtcaacaaaatacatggttttctttctcaatcatcttgcggtgtcgggatatgctgtctgaacgttcggttttcagacggtatagcatcagtgggtcatgacctgttgcaggaactgcttggcgcgttcgtgtttcgggttggtaaaaaacgcttcgggcgtttcgtcttcgaggatttgccctttatcgacgaaaatcacgcggtcggcaacttcgcgggcaaaccccatttcgtgggttacgcacatcatcgtcatgccgctttctgccaagtctttcatcactttcaacacttcgccgaccatttcggggtcgagtgcggaggtcggttcgtcaaacaacattacgcgcggttccatcgccaaaccgcgtgcaatcgccacgcgttgctgctggccgccggaaagttgggaagggaaggcgtcttttttgtgtgccagtccgacgcgttccaaaagctccattgcctttttctccgcctgttccgcattttgcccttaaccttcatcggtgcgagggtaatgttttccaacacggtcaggtgcgggtagaggttgaagccttggaatacgaagccgacttcttcgcggattttgttcaaatcggttttggggtcggcaacgttgacaccgtccacccaaatctcgccgctttcgatgctttcaagctggttgacagtgcggatgagtgtggatttgccgctgcccgaaggcccgcagacgacgaccacttcgccttttttgatttccaagtttacgccgttgatgacgtgcaggtctttgaaatgtttgtgtacgtttttgaatttgatcatgtcttttctttcagacggcatttgccgttgcaggttgtcgttacgggagctccatatgatgaagcgtgtagcgtctgccgtcaaaaaaacggtcgttcggattggtcaggcaggctgcaagcggcagtatcaggggtaaaagcaggtatttcgtcatcggcttactcccttttcagacgaccttgcccgccagataattgctcaacgccacgtatttctctggcgcgatatgttcggcgcggtcttgcggattgatgccgactgcctgcaaatcatcgtcgcctgcaagctctttcagattgttgcgtatggttttgcggcgttggtggaaggcgagtttcacgagtttggcaaaatgctcgaaatcgtccgccttgccgatgcggtgtttcaccggaatcatacggacgacggcggaatccactttcggcgcagggtcgaacgattcgggcggtacgtcaatcagcatttccatatcgaaaaaatattgcagcatcacgcccaagcggccgtagtcgttgcttttcggcgcggcaaccatacgctcgaccacttctttttgcagcataaagtgcatatcgacgacatcgtccgccacctccgccagcttgaacaaaagcggtgtggaaatgttgtacgggaggttgccgacgattttctttttgcctgcgatgccgttgaaatcaaactgcaatacatcgccttcgtgaatcaccagtttatccgcaaacggcagcgttttcagacggcatacgatgtcgcggtcgatttcgacaacgtgcaggcggttcagctttttcgccaaaggttcggtaatcgccgccaaacccgggccgatttcaatcacgacatcatccgcctgcgggcgcacggcgttgacaatatcgctgataatccgcgtgtcctgcaaaaaattctgcccgaaacgcttgcgggctttgtgttctttcatcgtgtttccttttcggttgaaaccccgccctttagggcggtagaatcagactctatttgggaggggcgtaactctttccaaatcaggatggcacatagggcggtgctttatgtgtcgtcctgtgtgttgaaacataaatgtgtttacagtatccgtttgatgtcggcattgtaaccgaaaacggcagggcgtgataatgctgtttgaaggcttgccgtgtttggcggtttggtgcaaaaaccggctgtctgccgttttgcctgttggaggattgaacgtgtctgaaaatctgcttgaaatcgaaacccatcccttcgatcccgtgttgccgccgaaggctgctgtcatgatgatggggacgtttccgcccaaggaagacaaacgcgcgatgcagtttcattatccgaatttccaaaacgatatgtggcgcgtttatgggctggtgttttttaatgatgcggcgcatttccaaaggttgtctgaaaaagcgtttgatgccgagaaaatcaaggcgtttttgcacgaacgggggattgcgtcctgtccgaccgttttgaaggcggtacgtcagcacggcaatgcgtccgacaagtttttaaaggtagttgaaaccgtcgatttggcggcggtgttggcaaaaatacccgagtgccgccatatttgtacgacaggcggcaaggcgacggaaatcctgctcgatattcagggcggcggtatcaaaatgccgaaaacgggcgaaaccgtgccgtttccgtttgccggacgggatttgacgctgacgcgcctgccttcgacttcgcgcgcctatcctttgagtttggcgaaaaaagcggcggcgtatcgggcgttttttgaaatggcgggcttgtgtgaaaaacagttataattgccgacaatttcccgttcagacggcatgtttgcaaaaacggaaatgccgtctgaaaatttgaagcacaaggaagaatccgatgaagaactaccacgcgcccgacgagaagggctttttcggcgaacacggcgggctttatgtctccgaaaccctgattcccgccttgcaagagctggcggatgcctataaggcagcgaaaaacgatcctgaattttgggaagcgttccgccatgatttgaaacattatgtcggcaggcccagccccgtttaccacgccgcgcggttgtccgaacatctgggcggcgcgcaaatctggttgaagcgcgaagacttgaaccacaccggcgcgcacaaagtcaacaacaccatcggtcaggcactgttggcaaaacgcatgggtaaaaaacgcgtcatcgccgaaaccggcgcgggtcagcacggcgtggcgagtgccaccgttgccgcacgcttcggtatgacttgcgacgtgtatatgggcgcggacgacatccaacgccaaatgcccaacgtgttccgtatgaaattattgggtgcgaacgtggtcggtgtagaaagcggcagccgcacgctgaaagacgcgatgaacgaagccatgcgcgaatgggtcgcccgcgtggacgacacgttctacatcatcggtaccgccgccggccccgcgccgtatcccgaaatggtgcgcgatttccaatgcgtgattggcaacgaagctaaagcgcagatgcaggaagccatcggcagacagcccgacgttgccgttgcctgcgtgggcggcggatcgaacgccatcggtttgttccacccgtatatcggcgaagaaaacgtgcgcctcgtcggcgtggaggctggcggtttgggcgtgaacacccccgatcacgccgcgccgattacttcgggcgcaccgattggcgtattgcacggtttccgcagctatctgatgcaggacgaaaacggtcaggttttgggtacgcactctgtttccgcaggcttggattaccccggcatcggcccggaacacagccatctgcacgacatcaagcgcgtcgaatacactgttgccaaagacgacgaagcactcgaagcctttgacttgctctgccgcttcgagggcatcatccccgcgctcgaatccagccacgccgttgcttgggcggtgaaaaatgcgccgaaaatgggtaaagaccaagtgattttggtcaacctctcaggtcgtggcgacaaagacatcaataccgtcgcgaagctcaaagggattaaactgtaacctcgtccgtctgatatagtggattaacaaaaaccagtacggcgttgcctcgccttgccgtactatctgtactgtctgcggcttcgtcgccttgtcctgatttttgttaatccactataaaaatgccgtctgaagcctgagttcagacggcattttattttgctatgaatttagtattttagaaacgaatctgtattttaatttgtccggatttttgtttttccaattgttttccttttgtaatactgccatttacgtttaatgtaacattacggtacagtaacgcggcacctgctgaatattgctgttgattatctgctttatagacgaaggaattaccgcccacattcacgccgcctttgccataattggcaaagtaagctgcagataacaagggttttacggtaaggttgccgactttaaaccgataagcaaaatccagtccggccgttagtgttttcactgacatagaacttactttaacactgtcgttacccaacttgtaatctgcagatgacaggcggctgtaacggatccccgcactggggacaatctcgaattgattgattttcagcgtattgcccaaagtaaggccggtttggatgcttgctcggttaaagtttgctttttgctgcgtttgtaaccggcttctcaagctgcctgcaccaatatcgccggccacataccaagcatcatttaaataatacttaccataaaggttggcttgcacaaaagtatttttgccgctcgcctgatcaaaagtatgctgactgtcagagtaagtcaatacgccgcctatctgcatattttcggacaagctgcggtcaatgccgatttgtgtttgcgtgcgtttcgaactaaaccggcgatattgtgcggaagcataatcacgaccataaccggtgttcgacatccaaacactgtttttttcggcatcagcgcgtgatttttgtgcaatgtgccgtgttaatgaagcacctgtatccaacaagatagattgcgtgcttgccattgcgtcagataaagccgagttggtattggtgctgactgcatcggcttgcgcggcggcttgggcttgcagctgagtggcggcttgggctcgcggctgcgcggctcttggttgcaaactcactgtctcaactttttcatgaagttccgtattgtcttgaggctgtttgtctgatgtgtcaaccgattcggatacatcttcatcttccaacgcatccaaggggatttcttcataatcattttcatatttttcatgaagttccgtattgtcttgaggctgtttgtctgatgtgtcaactgattcagatacattttcatcttccaacgcatccaaggggatttcttcatagtcattttcataccagtccggattatgcaaggccctgggtgctgcgtaagctgacgaatcaaatgatggcgagggcggtgccggcagagtagatctgcgtccgcgacgtttcggacgattttgggaagctgccatataatcctgaggtgcggcacggcgttttcggcgttgcggctgggattgggctgcttgacggtgctcttcttcctcagcttttcgtttcgccgattctgccgcttctcgatctgtttcggctttttgttttgccgacaactctgctgcttggcgttccgcttcttgacgacgtgcaagttcggcggtctggcgagcttcttgctggcgttttgctgcttcggctgctgccctttgcttggcaagttcggcggttttgcgttcggtttccgctttttgtttgacggctaactctgcagcttttcgtgcttcttcctgttgacgcgcaagggctttttgttggcgtgccgccaatgcttgggcttcagctgcggctttttggtttgccgacaattctgccgctttgcgttctgcttcctggcgatgtgcaagttcggcagcttggcgttttgcctcttcggcttctgcttttcggcgcgcagccaatgcttgagcttcacgttcggcttctgccctttgttttgccaacaactctgccgctttgcgttcttcctgctgtcggcgcgcaagttctgcttgggcttgggcaatttccacattgttttgctgtaccgaacggtgtccgcggcgtttaggacggtcttgggaagctgccatataatcctgcggtgcggcacggcgtttgcggcgttgcggctgggattgggctgtttgacggcgttcctcttccccgaccctttgttttgccgacaactctgccgcttcgcgttctttttcatgccggcgtgcaagctctgcagcttggcgttttgcctcttcggcttctgcttttcggcgtaccgccaatgcttgagcctcacgttcggcttcgactttttgttttgccgacaactctgccgcttcgcgttctttttcatgtcgacgtgcaagttcggcgctgctgcgttcttgttctgctttttggcgggtcgccagctctcttgcttcgcgttcggcttctgctttttgttttgctaactctgccgatttacgctctgcttctgcttgctgacgcttcacttgctccgcttttgcttgctggcgttttgcttcttcggcttgatttgcctgcgggctaggcggtgcgacgacgatattttgaggcttggcaatttgtgcaccgtccgtttgtgttgccttttgtgcttgagaagccgtgtttgtggcaggagacggggccggtttgactcggcggcggttctcggcataaggattgtacaatcgggtaataccgttttctgttttgattgtataacgcaatgcccctaaatctacatggttattcgccaaggaaacagaaaggcgggagcggtcttgtacggatgatgcatcaaagagattcagcccttcctgattgggttcgcctgttttatcttgaacatggagctgataatgaccggatgcggattccttcacaagcactttatccccaagatttttcgccaggtgcgtcagataatgaaaatgcccgttaccggataaatgattgattttgagcgtgtggtatttatttgcactttgcgcatcggaggcattgttcaaatgaatatggctatccgccaatgacagattgtgtacttggctgtcgccggtcaaatgccatttgctatgttggtttaggctgacacggctgtttccttgcccttgaatttgcccccataatgcagccttgcccaagaccaatgccgcattctggttcagattcacattgccgttaatctgtgtcgctccaaagctgtttaaagccttatcggataagttgcctgtgttgcaggtaacgtaaccggtatagtccgagcgcacgcaaacctcatcgccgtttttgtaacccaaatttactttggcgttgtctgttgcggtgatgttggcggtgatgtcggatacatttctgccggaagagaatgatgcggattgattaaccgcaatttctgtggctttgaatgtgcggtttatccagtcgtcttcaaatacgacttcattgtttttggagaaatgtgcgtcttttcgggctgaagatttgttcacaaaatctcttgcgtgtggtgttggacgacctgataacaagacattgccttgagttacgcttatttttccgtttaaattagtgccgcctgttaacaagaaacggttttgcgcgcttttgccgttgaaattaaggtttaatgcaccgttatgtccttttccgttttcttcgccaaagaaaccgctaaaaccgctaatacgctgattgtttttgtggttcatcgcgtttttcttggcttcttcttgtgtgctgcccattaaaatccagtcgttattttccgtttgtccgttttcgggcatcggtgcgttcacgctgccgccggattttagggcgtaataacggtagtttttgaaataaagatctttgccttgtggaatcggtttcctagggcggtaatagtaataaccagcatcgtcatcatcattattttgaatataatgaatagagatggttttgggatcggtaatcaaagatttacccgttagcgtgattgtggaggcgtggcctgtgttgtggttgacaatgcgcgcgccttcatccacgttgcggatgtgttcaaaagtcaagtcattgccattggcatccaaacgaccgccacggaaaccgaaatataggttatcgggattaatctgatttgaactatttaataccaatgtaccgcgtccgctgacaatgccgacttgggagaaagcctggacttttttgtcggcatcggcttgttgattcagaataaccgtaccgtcgccgacttttaattgcccttggttaacgcctgtgccgtttatttctaatgtgcctttgccgatttttgccaatctgtcgccattcggatttttgacttgccaaacgacttttttgccgtcggcaacatcaatccccgcacctagccaagtgatgtcattatttatacctttgactgtgtaatcgcctttgaaaaacagaccgcccgcgccttggttgatgttttgatccaataccaaagtgccgttgttttcaaaggtaacattctgtccgttgtttgcatccctttcattgttggcaagccttaccgctgtcgaaccgatatggctgtttgtgcccgtggttttccaatgatgttctccattacctttgatggtgccggcgttatcgcgttgtttgatttcatctgcaaattcttttttatagatattccattcttgccaagagtttttttgatagcctgcccaataatcgtaagcacctaaaaagacccagcgtttttcttgtttatcataagcaaataatggtgaaccgctatcgcctaacacagcatagttagtcaatgcgttttgagataaaacttctttgagtttttctggggaatgatgttttgaattatcaccgaagccaatcaagccttcttgatttagattcgatgtgacattcacgtcttgataaggcgtacctgcaatggcataacgataagctcgtgaaagctctgtcatattgtagcggctgttatattcaaattgcgtacctgctccaactcgcacaaactcagaaaaacggtttttatctttataggtttcaacgccgccgcctgcactggttggtgcaataggtgcgacttctgttacgaatttattaaggcgtgccatgttgtagtcttcaagacgaccttgattaccgtgatgccaatttttatttggttcgtagtcattttgtgcaactgaacgatattcgttttcatcattgctaacatctaagtgcccattgtgatgcccgtaataagagatttcgtctccttttacatgtttgacgctgacggcatactggggatcgatgacggttaatgtacgtctgttgacatctgcaacgctaaaatcaatcatcggtacgttggataatgcgttgccgatgttttgaccttgtttgtttttcactgataaatcggttgcgccgacaaaaaatttgcctttgttttctgcaaagtcacggaatatttgataatcgacatcgtctctgaccaatgccgcttctgagtatggcgtaagggcataggcaagaaagatggataaggatatggcgttaattttaaaacgtttggttttcataaggttttaccgttttaagggtgataatgttttgtattttacgccggtttggtggtgttgactattttttgttgtgtaaatcattcattttggtgttttattgccaatttaaaaaaagaatcccgatgtttttatttccgcttcctttgttctgttattcaagcgaaggcgggaagccgattttcggggttcggttcttccgttaaatttctgcggctttttgtttttggattcccgcttttgcgggaatgacgggattttaggtttctgattttggttttctgtttttgagggaatgacgggatgtaggttttcttaaccctgagtcctagattcccgctttcgtggtaatgacgagatgggggttcgtgggaatgacgcggtgcaggtttccgtacggatggattcgtcattcccgcgcaggcgggaatctagaccttagaacaacagcaatattcaaagattatctgaaagtccgagattctggattcccactttcgtgggaatgacgggattttaggtttctgattttggttttctgtttttgtaggaatgatgaaattttgagttttaggaatttatcgggagcaacagaaaccgctctgccgtcattcccgcgcaggcgggaatctagaccttaaggcagcggcaatattcaaagattatctgaaagtccgagattctagattcccgctttcgcgggaatgacgaaaagtggtgggaatgacggttcagttgctacggttactgtcaggtttcggttatgttggaatttcgggaaacttatgaatcgtcattcccgcgcaggcgggaatctagaacgtggaatctaaagaaaccgttttacccgataagtttccgcaccgacagacctagattcccactttcgtgggaatgacgggattttaggtttctgattttggttttctgtttttgagggaatgacgggatgtaggttttcttaaccctgagtcctagattcccgctttcgtggtaataacgggatgtgggttcgtgggaatgacgatggaaagtttgccgttgtctcggataatactgaggcttttcgtttgcattcttatagtggtttaacaaaaaccagtacagcgttgcctcgccttgtcgtactgcttgtactgtctgcggcttcgtcgccttgtcctgatttaaatttaaaccactatatcattttcaaatcttgttatgacggtttttcggatttgctttattatccgtttatttttgaaatatctggggtggggagacgtgttccgtcgttggtttttgccgtgttgggttgtcggcgcggcggcttcgtttgcgctgccggtcgtgccgcattggctgttttggctggcggcttttgcggtttttgctgtgtttgcaaggcgttttgcgtttgccggtctgatgctgtgcgtgttggcgggcgcggcttacggcgtattcagaacggaagcggcactgtcttcgcaatggcgggcggaggcggtttcaggtgtgccgttgacggtggaagtggcggatatgccgaggtcggacgggcggcgcgtgcagtttgcggcaaaggctgtggacagcggtggtcggacgtttgatttgctgctgtcggactacaaacggcgcgaatgggcggtcgggagcagatggcggataacggcacgtgtgcaccccgtcgtcggcgaattgaacctgcgcggtttgaaccgtgaggcgtgggcattatccaacgggataggcggcgcggggacggtcggtgcggacagggttttgctgcatggcggaagcggttgggggattgcggtttggcgcagccgcatcagccgtaattggcagcaggcggatgcggacggcgggctttcagacggcatcgggctgatgcgcgcgttgagcgtgggcgaacagtcggcattgcgccccgaattgtggcaggcgttccgaccgttggggctgacgcatttggtcagtatttcgggtttgcacgttacgatggtggcggtgatgtttgcgtggctggcgaagcggctgcttgcctgttccccgcgccttcctgcccggccgcgcgtgtgggttttggcggcggggtgtgcaggcgcgctgttttacgcgctgcttgccggtttttccgtgccgacgcagcgcagcgttttgatgttggcggcgtttgcgtgggcttggcgcaggggaagattgtcggcgtgggcgacgtggtggcaggcgttggcggcagtgctgctgttcgaccctttggcggtcttgggtgtggggacttggctgtctttcggtttggtggcggccctgatatgggcgtgttcggggcgtttgcacgaagggaaacggcaaaccgccgtgcgcgggcagtgggcggcttcggtgttgtcgctggttttgctcggttatctgtttgcttcgctgcctttaatcagccctttggtcaatgcggtggcgattccgtggttttcttgggtattgacgccgctggcgttgctgggttcggtcgtgccgtttgcgcctttgcaacagttgggggcatttttggcggaatatactttgcggtttttggtgtggcttgccgatgtgtcgcccgagtttgccgttgccgccgcacctttgccgctgttggtgttggcggtgtgtgccgctttgctgttgctgctgccgcgcggcttgggtttgcgtccgtgggcggtgttgctgttggcagggtttgtgttttaccgttcacccggcgtgccggaaaatgaggttgcggttacggtttgggatgcggggcagggtttgtcggtgtcggttcagacggcaaatcatcatcttttgtttgacactggaactgcatcggcggcacagacggggattgtgccgagtttgaatgcggcgggtgtccgccgtttggacaagctggttctgtcgcatcacgacagcgaccacgacggcggttttcgggcggtgaggaatattcccgccggcgggatttatgccgggcagccggaattttatgagggggcgcggcattgtgcggaacagcgttggcaatgggacggcgtagatttcgagtttttgaggccgtctgaacgcaaaaacatcgatgataatgggaaaagttgtgttttgcgtgttgtggcgggcggtgcggcactgctggtaacgggcgatttggatacgaagggcgaggaaagcctggtcggcaagtatggaggcaacctgtacagccaggtgttggtgttggggcatcacggcagcaatacgtcctcgtcgggcgtgttcctcaatgccgtttcgcccgaatatgccgttgcttcaagcggttatgccaacgcctacaaacatccgaccgaagcggtgcagaaccgtgtccgcgcacacggcattaaactgctgcgtaccgatttgtcgggtgcgctgcaattcggcttgggacgcggcggcgtgaaggctcaacgtttgagagggtataaattctattggcagaaaaaaccgtttgagtgaggtttgaaacataaaatgccgtctgaaacggattcagacggcattttggcgttaacgccggttcgtgctggcaaggcatatcgtttgattttcagtgtgcgtcaaaaacagaaagggcgttgcggttaacggcagggagaaccgtttgaatgaacggaaaggtttgcgccagaaggggaaatgccgtctgaaagggcttcagacggcatccggacatcggtgcggaatcagtgccagtaacgccaccagggcatatcgtcagatcgccacggctgctttaagaacgggcttttcgggaagttggtttccaacacgcggcgcgtatcggcggcaagccggggcttgtccaacttcttgtaggcaagttccaatatggcgagcgattcttcgacatagcgtgtattttgatagctgccgataattttttgggcgcggttggcggcggcgatatatgcgccgcgtttcatgtagtaacgcgctaccgacatttcattgccgcccaaagcatcgaccagtttgaccatgcgtgcggtcgcatcggcggcgtatttgctgttcgggaagcgttggacgagttccgcaaaggcctgatacgcttcgcggttggctttcgggtcgcggtcggaccagtcttgcgaggccagcttgttcaagaaagattgatcttcgttgaacagtaccaaaccgcgcaggtatagcgcgtagtccatattcgggtgttgagggtgaaggcggcggaagcggtcaatggcggccagcgccttatccttctcatcatctttatagtaggcgtatgccgtatccagttgggattgctgggcatggcggctggtagggaagcgcgattccaagatttcgtataatttgacagctcgcgtataattgctgctgttcagctcgtcctgggcttcggcatagagtttttccacactccagtcttgggtaatctgggcatctttatctaccgtaccttgagtggcacaggcactcagtgccaaacctaatgaaaccgttaaaagaatttttttcatgcagaatacttcctttgataatgaatccgattatagcgacgattcagactttgcgtcagcttccgaaactgaaaaccgtatcggtctgaccgttccgctcgagcttgcaggcgggcggttggatgcggtattggcgaaacttctgcccgactactcgcgcagccgcctgacatcatggattaaagaaggcgcggttattgtaaacgataaaccttcgcaacccaaagacaaaatgataggcggcgagcaaatttgtgtaaccgtccgtccgagtgaggaaaatctggcgtttgttccagagcctatggctttggatattgtttacgaagacgataccgtcatcgtcgtcaacaaaccggccggactggtggtgcatccggcggcgggcaactggacggggacgctgctcaacggcctgttggcgcactgtcccgaattgagccaagtaccgcgcgcgggcatcgtacaccgtttggacaaggaaaccagcgggctgatggtggttgccaaaaccctgccggcgcaaaattccctcgtgaggcagcttcaagagcgcacggtcaaacgcatctaccgcgccgtcgccaacggcatcgtccccttcgacggtaaaatcgaaacccaaatcggacgcgatccgcacaaccgcctgaaaatggcagtcgtcaaattcggcggcaaaccagccgttacccacgtcaaagtgttggaacgctatcttacccacagctatatcgaatgctcgctcgaaacgggcaggacgcaccaaatccgcgtccatatgcgcgaggccaaccatccgcttgccgccgacccggtttacggcaacccgcgccatccgtgcggcgacacggtgaaagaagccgttaaaagtttgggtgcgcgtcaggcgttgcacgcctaccgcttgagtttcacccatccggaaagcggcgaaaccgtttcgtttgaagcaccgattccaaacgacatatatcatttgttatccgtcctccgtcttgaagccggtttggattcgtctttgagcaatgaagaagaatggcaggacaaattcggcgcggacgacgacgatgattggaacgaagacgactatgatgtcgaagtggtttatgtaagggagtgaggcggcttgaaaggcggggcgaacgcaggcagccgaatcggagcagccgggcaatcgtccccgccgatttcaaacaaaggccgtctgaagggaccgggcagaaaccgccggttttgtttgccccgttcagacggcattatgataaaaggcgtttagggttttttatgtttaccggctttggccgcccaataagttgccagcagcgagccggagatattgtgccacacgctgaacaatgcgcccggaacggcaacgaccggcgcggcggcaaagtgtgcggcggcaagcgcggcggccaggcccgagttttgcataccgacttcgatggtcagcgttttttgtgcatcataaggcaggccggtccatttggcggcaaagaagccgagcaggtagccgatgccgttgtggagtacgacaaccgcaaaaatcagcaggccgctttccataatcttgcctttgcttgccccaacaaccgcgccgataatcagcacgatggcggcaacggaaaccagcggcagcgcatcggtcagcttttcggttttactgcccaaaaccttatggacaatcaaacccaaaacaatggggagcaaaaccattttgacgatggacatcaacataccggccgcttggatttccagcatttcgccggcaagcatcaggaagatggcgggagtcagcaatggggaaatcagggtggaaacagacgtaacggcaaccgacaaagccacattgccacgcgccagataggtcatcacattggaagccgtaccgcccgggcagcagccgaccaaaatcacgccgaccgcgatttcggcaggcaggttcaacagtttggacagcagccaggcggttgccggcataatggcgaattgtgcgattacgccgatgatgacgactttgggatgtttgaacaaaatatcgaagtcggaaggtttgagcgtcaaacccataccgaacataataatgcccaacagccaaggaatataaggccccgcccatttgaaggtgtcgggcgcgaaaaaagcggcggcggcaaagagcgcggcccagagggaaaatgtttttccgataaagctgctgattttactgaggatattcataaataatgcgttgcgtgtttgtttttaagggaaggcaagcatacacgccttaaccttaatttgcaaaatgaccgtgcctaaacaatgccgtctgaaagtggagattggttttcagacggcatcgcccgagagatgtcggaaatggactttatccccattccttttcggttgaaacccgtctgtttatggcgatagaatctaatcggagggtagtctcgttcgggcaacacgcagtgcggtgcttgatgtgccgtcccctgttgaaacatataaagctcggagaaagtatagtggattaaatttaaaccagtacggcgttgcctcgccttgccgtactatttgtactgtctgcggcttcgtcgccttgtcctgatttaaatttaatccactatatataagggcatcattcctgcaccggcaagaatccgaacccgaacgtttgaaaacaatcccgaatctccgaattcccgcctgtgtgggaatgacgaaaaaacaagcattcatttgccccgaaggcagttaatcaaccctttccgccacacacctattccaatatccaatgaaaaccatcacagaaaccctaaatctcgccccgaaaggcaaaaacttcctgaccgccgattggcccgcgcccgccaatgtgaaaaccctgattaccacgcgcaacggcggcgtgagccaaggtgcgtatcagagtttgaacctcggtacgcacgtcggcgacaatcccgaagccgtgcgccgcaaccgcgaaatcgtgcaacagcaggtcggactgcccgttgcctacctcaatcaaatccacagcaccgtcgtcgtcaatgctgccgaagcgttgggaggcacacccgatgcggacgcttccgtagacgacacgggcaaggttgcctgtgccgtgatgaccgcagactgcctgcccgttctattttgcgacagggcgggtacggcggttgccgccgcacacgcgggctggcgcggtttggcgggcggcgtactgcaaaacaccatagccgcaatgaaggttccgcccgtcgaaatgatggcgtatctcggccccgccatcagtgcggatgcgtttgaagtcggacaggatgtgtttgatgcgttctgcacgcccatgcccgaagccgccaccgcatttgaaggcataggcagcggcaaattccttgccgacctttacgcgctcgcccgcctgattctgaagcgcgaaggcgtgggcggcgtatatggcggcacgcattgtacggttttggaacgggatactttcttttcctaccgccgcgacggagcgacagggcgtatggcgagcctgatttggctggacggcaatgccgtctgaacacgccgctgatataatctaccgactttgtgtttttgagaaaggcaagccatgaacaaactgtttcttactgccgcagtgctgatgctgggcgcgtgcggtttccacctgaaaggtgcagacggcatttctccgccgctgacctaccggagctggcacatcgaaggcggacaggcattgcggtttcctttggaaaccgcgctgtatcaggcttcgggcagggtggacgatgctgccggcgcgcagatgaccctgcgtatagacagcgtttcccaaaacaaggaaacctacaccgttacccgtgcggcagtcatcaacgaatatcttttgatattgacggttgaagcgcaggtattgaaacgcggcgagccggtcggtaaaccgatgaccgtgtccgtccgccgcgtccttgcttatgccgacaacgagatcttgggcaaacaggaagaggaagcggcattgtgggcggaaatgcggcaggatgccgccgaacagattgtccgccgcctgacctttctgaaggcggaatgacgtggcggcacatatcggacgcattgatacggacgcgcctttgaaacccctgtacgtcatccacggcgaggaagaactgttgcgtatcgaggcattggacgcattgagggcggcggcgaagaaacaaggttaccttaatcgggaagtttatacggcagacaatgccttcgattggaacgagctgctgcaaaccgcaggcagtgcgggtctgtttgccgatttgaagctgttggaactgcatatccctaacggcaagcccggcaaaaccggcggcgaggcgttgcaggattttgccgcccgattgccggaagatacggtaacgctggttttgctgcccaaactggagaaaacccagctccagtccaaatggtttgccgcattggcggcaaagggggaagtgtgggaagccaaaccggtcggcgcggcggctttgccccaatggatacgcggacggctggacaaaatcggtttgggtatcgaggcagacgcattggcactgtttgctgagcgcgtggaaggcaatctgttggcggcgcgtcaggaaatcgacaagctcgggctgctgtatccgaaagggcataccgtcaatatcgatgaggcgcaaaccgccgttgccaacgtcgcccgcttcgacgcgttccaactggcaggcgcgtggatgaagggcgatgtcctgcgcgtatgcaggcttttggacggattgcgggaagagggcgaagaaccggtgctgttgctgtgggcggttgccgaagacgtgcggacgctgatccggcttgctgccgccctgaagcaggggcagagcatccaatccgtccgcaacagcctcaggctttggggcgacaagcagacgctcgcaccgcttgcggtcaagcggatttccgtcgtccgcctgcttgacgcgctcaaaacctgcgcccaaatcgaccgaatcatcaaaggtgcggaagacggcgacgcatggacggtattcaaacggcttgtcgtgtcgctggcggaataaagcggtaatccccaaaatccgaaaatactgtaaaataccgttaatcctgaaaagtattcaccaatccgtccgaaaacatttcagacggcacgaccacctcaataaaggaacattaaccctatggacaataagaccaaactgcgcttgggcggcctgattttactgaccaccgccgttttaagcctcattatcgtattgattgtcgattcctggccgcttgccatcctgcttgcagccgtcattgtcgctgccgctgcgggcggttttgtttggacatcccgccgacagcaacgccagtttatcgaacgcctgaaaaaattcgacatcgatcccgaaaaaggcagaatcaacgaggcaaacctgcgccgtatgtaccacagcggcggacaacaccagaaagatgcgattaccctgatctgcctgtcgcaaaaatgttcggtggacgaggcgcacgctatgttcaaaaaacgcccgacacgtcaggaaatcaatcaaatggcggcaaaacagtcgcgcggtcagaaacgtccgcaccgttaaccgccgcaaggcatctttgcataaatgccgtctgaagcctgttggcgtttcagacggcatattctgattgaaaagatgatgacactgaaaaccgccccgctcaaacgccgctttgccgccatgctgtacgaaatgctgctggtcggtgcggcaacctgtttggcagcattgattgccggtattgccgccatttttctgaatcccgtttctatcgcggtttctgcattggtaacaagtatcctgataatgggagcatggtggctttatttccgcgccaactggcatggtcaggggcagaccttggcgatgaggacatggaaaatcggcttgtgcgaccttaacggcatacagccgtctttgcacctgctgcgcctgcgctttatttgggcgtgcatatttatcgtatttatccctatgttagcctatgccggattacgccacttcctcggcattccgcccaagggcgcggccggcgcggcattgatttggctgattttaccgtgggggttcgcactgctgaatcccgatcggcagtttctgtatgattttcttgcaggaacaagattggtggcggtcaaaggaaagccttaagcctttataccgcaaaggtttcaacctgaaaaaatgccgtctgaaagggctttcagacggaatttgcttatcggggaaaccgattattcgatattctgcacttgttcccgcatctgctcgattaagactttcagttcgaccgaggcttgggtgcattcggcggcaatggatttgctgcccaaagtgttggcttcgcggtttaattcctgcatcaggaagtccagccgtttgccgctgctgcctttgtgttcggtaacgatacggcgcacttcggcaatgtgggtgcgtagcggctgaactcttcgtcgatgtcggatttttggataaagagggcaaattcctgttgcaggcggtcgttgtcgatgctgccgaccgcttcgacgaggcgggcgcggattttttctttatgtgtttccaacagggtaggaaagagttcgcttaatgcatctatgatttcttccatagcctcaaggcgttgcagcaggtgctcgcctaatttcttaccttcccgcttgcgtgcggcagtaaagtcttttaacgctttttcggtcagttcggtaatgctttttgccaattcttccgtattttccctttggcttgccaatacgccggggaaacgcaggatgtcggcaacgcccagttttgccaaatcgtgatgcttgcggaggtctttgttgatttcggcaagctgtccgaccaagtcgcgattcagttccaaggactgactgccgttttccgcatcttgaatttggattttgcattcgactttgccgcgtgcgatatgggatgaaattttctcgcggataccgctttccaaatagcgcaaatcgtcgggcatcctgatttgaatatctagaaaacggtggttgaccgcacgcaggtcgagattgatgcgtttgctgccgcactctgccgccgcgttggcaaatccggtcatgctgtggatgtggatatttccgctgctcatgtcgttctccgaagcccgttaaaatggaatcaatatatcacatctgtatggcggcaagcgttttcgggtgtgaaaaattgaagattttgcagcggcagattggaatcacgcgcttttgttgctgcaaggaagggaaatgtatagtggattaaccaaaaccagtacggcgttgcctcgccttagctcaaagagaacgattctctaaggtgctgaagcaccaagtgaatcggttccgtacgatttgtactgtctgcggcttcgccgccttgtcctgatttttgttaatccactatatcaattccgccaatctgtcggaaaagcagctgatgcggcagtgtctggtgcatgtctgctttttgatttcggcaattgcaacggcgtggacggataaaatcgtgtacagcacgacgcacaaaccgcattgatgtttaccaaataaaatacccgacaaaacaatttgtcgggtattttattgcgtatatttcaaaccgcttcggcttcttcggtcaggaaaccacgcagtttctgcatggcttttgcttcgatttggcggatgcgttcggcagatacgccgtattcggcggcaagctggtgcagcgtcagcccgccgtcgtcttgaagccagcggctttccacaatacggcggctcctgtcatccagttgcgccaaagcgttttgtaaaccttctgtttgcagggcgtaatgcgcctgtttcgatagttgtcggctcggttcggaatcgtggtcggcaagccagtcgatgggggcgaaactatcctcgtcgtcgctgttgtctgccatgatggcgatgtcgtgtcccgtcattcgctgttccatttccagaacttcggaaagtttgacacccaaatcgtcggcgatgtcttgtgcctctttgggagacagggcgttgaggtttttacgcatgctgcgcaggttgaaaaacagcttgcgttgcggtttggtggtggcaacgcgaaccaaacgccagtttctcaaaataaactcgtggatttcggctttaatccagtgtacggcaaatgaaaacagacgcgcgcctctaccgggctcgtagcgtttgaccgccttcatcagtccgatattgccttcctgaatcaggtctgcctgattcagcccgtagccgtcatagccgcgcgcgatggaaacgacgacgcgcaggtgggacaggatgagttgtttggcggcgttgaggtcgcctttgtgttggcgttcggcaaggcgtgtttcttcctcttgggtcagcatgggaattctgttgacggtgtggatgtattgttcgaggctgccgttgccgctttggatggcgggtaatgcgaaagcgttattcatttgggacatttcctttcggctgaaactgcgtatcggcggtttgctgtgttgggatgcagtatatcactgcttggcttgtattttgtatatttggcaggagatatgcgctaaggtttgaaagacaggaaaaattttgtaaggcaagtttgattgattttgtaaacctgatggctcaattcgattttggaattatattacatacgtggttgtatgtaaatagccgttttgaaaaaagacagcccgtccggacgggctgtgcaggtatcagtgttctttgtttcggaagatgaaaagaatcagtgcggctagggccaatatgcccatcaaccaccatgaactgccggttttcatatagggcgtttcgccgacatagcctttgatgtgtccttccaatacggtttccgtatcgggttgggcttgggcgatgatgttgcctttgggggagatgatggcggttgcgccggtgttggtggcgcggaccatatagcgtccgagttccatagcccgcgcctgcgattgttggaggtgctggtacatggcgttggattttccgtaccacgccatattgctggcattggcaagcagggtggcatcttttgcggcggcaatcagttcgtcgccgaatccgtcttcgtaacagatgttgaaggcgattttttggtttttcatcagcagggcggattgcttgccgccgcctttgcggaagtcggaaaggggcatatccatcattttgtaaagcggcgtggtcaggaaaggcagcggtttgtattcgccgaaggggacgaggtggtttttggcgtagtaggggataccgtcctgattgttttcctgataaccggtcaggttgatgacggcgttttcgtaaccgttgccgtccgaagtgtattggctgatgccgacggcgagcgcgctgccgttgttttgcgcctgttcggcaaatttcgccagtatgttttccggcaggttttggcgcataacggggatggcggtttcgggcaggatgacgatgtcggcggtggttttgccgacttgttcgtaatatttctgtatggtcgggataacttggtcttcacgccatttgagggtttggtcgatgttgccttgaagcagggcgacggtgctgcggctgccgtcggggcgggtgaagtcggtttgtcgggcggtgtagcctgcggcaagcagggcggcaatcaggataatcggaagcaggcgtttgcccgaacgtgcggtgttattactcgccaaaaccagccagacaccgagaaaggcggttgccagtgtaaccatgtggatgccgcccaatggggcaaagccggcgagcgggctgtccggggtgatttgggagtagccgattgcgccccagccgaatccggtcaggaaacgttcgcgggcaaactcggtcagcgtccacaggatgggcagtaccaaaccgatttttatgccccgaggcagggtaaattttttccacagccagaaacacagtgccggataaagggcaaggtaggcggggagtaggaaggtcagcggtacggcatagaggtcgggcaggccggaaacgtcgtgcagggcggtgtgtatccagtagaactgtgtcgtgtatgcggtcaggccgaacaggtaggcggaagagacagcaaaacgcggacgcagttcgatgaggcggacgaaggcaccgaaaatcaagggcatcagccaaaagtggtagtagggtgcgaaggtaaagggggtggcggcggcaaaaaggatgagcaaaggccagtagagggcggggtgctgccagtatttgtccagtttggaaaccatattcatctgtctgttcggaagataccgtctgaacatctttcaaacggcatcggtatttgaaaaaggaatcaatgcctgccgaaacgattcatcagcggcaaggcgggggcgcaggcaatcgaaccggaaagcagcccgacaacgaggttggcgaagtactccgcccagccagcgtcccagtgttgcgcgtgcaggaaatcgtgcagaaggccgaggttgtgggcgaccagtacgccgccgataagaaacatggcaagcgtgccgaccacgctcaaaccgcgcataaagcaaggcataaaggcagtcagcatttgccccaaactgcgcgaaaaggtttgtgggcggcgcatcagcagcatgcctaagtcgtcgagtttgacgatgacggcaacgattccgtacaccaaaacagtcatgccgatgccgattgccgccattacgagcatgcgcgtcatgtcggtgcagaaacttgtgcagcagcttttctacgccttcaaagcacagataaatgccgcctgccgtcaaaagcggcgtaatgagttgcggcaggaaggcggaaagcagcagggccgcaggcaccaaaaccggcttgttggaaaaagaacctttcgccatcgaccaaacaatcggcaactcgcgttctgccgatacgcccgtaacccggttggcattgggtgccaaatcgtcgccgaccacgccggcggttttctttgcggcggctttggtcatcagggcaacatcgtccaaaacggcggtgatgtcgtccggcagggtaaatagtgaggcaaatgccattaaagaatcctgaaatgcggcgcaaagtccgacattatataggagaacgcggatttgggcggtttcaggcggcatgaaacaggaaaatgccgtctgaacgctgtggcggacgtgaagtaaagtttcgtgaaaagaaaataccgtgttacagtctttcgattttaatttcatgaattttaagggagaatcgttagcgtggattggatgggcagtctgttcctgccgggtggcgcactgttgtttctgagcgtggtttcgaccactttgtccgcacgtttgggaatgcctttgctgctggtttctcctgccaacgtgttggacagggcggcggaagccttggcgattgcggcgttcctgatgctggtcgcgcgtccgtcggcagtgttcggcggtttgtggaaattcaattacagcctgcgtgaaaaggcgtatagccgaatagaaatgcagtccgacaccgtgcttcaggcggggatttggcgtggtacatcctgcccgacggcaaggtcgatatagtgaattaacaaaaatcaggacaaggcggcgagccgcagacagtacaaatagtacggaaccgattcacttggtgcttcagcaccttagagaatcgttctctttgagctaaggcgaggcaacgccgtactggtttaaatttagttcactataaaatggcgaaatactttaccgagacgggtattagcgtccgtgagcattttgatttcttcggtgagtttgtcgtttcgccggcagcacgttcgggtgatttggcacttacttacggtttgaggctggaagcgggcgaagagggtttgagccttgccgagcttttcgataagcgttccgatagtcaggagccggtcgagggcggccgtattgacatcggcggctttatgctgaccgcaaaggaggttgacggtggcggcaatatcgggtctatggggctgaaagtgctgcgttagaaaggtttgatttgaatgccgtctgaagccggattgccggtttcagacggcattttgtctgtttagttttttttgctttttgcctgttttacgtctttttcggtaacgcttccgccgccgttgtcaaaggcgttcatgatataagtggcgacggcggcaatgtccgcatcgctgatggcggttgcgggcatgaatccgttgtaggttttgccgttgactttgattgtaccgttgatgcctttgaccatgctgtgcagcagcacctgcggttttttcatgatgaagtcggagcggtagagcggcggaaacatggttccgcggccttcgccctttttgccgtggcaggcgacgcagttggattcgtacactttttgcccttttgtcatgatgctgttgtcggcggcagaagcggcggcgcagaagcagcccaagacgagggcggtcggcagtcgggttgtgttcattggtgtttccttcatgtttgaaaccttgttgttgattttgcgtagcgggtgaaagatttttttgccgaatcagtagtatagtggattaacaaaaatcaggataaggcgacgaagccgcagacagtacaaatagtacggcaaggcgaggcaacgccgtactggtttaaatttaatccactataaggttgcacttgatgttgttgtccagcatagatgccatcatacgctaaagtagcgggaaaatgccgtctgaacacggcgttcagacggcattttagacatgggtcaaacagtttcaacgccagctgccaaggttttcttcggcaagtgcgacgagtgcatctatccagtcggggttgtcgttgaggcaggggatgtagcggtagcttttgccgcctgcttcataaaactgttcccgccccatcagggcgatttcttccatggtttccaaacagtctgccaaaaagcccgggcaaaatacgtccagctcggttaccccctgtttgggcagtttgccgaacaaatcctgcgtgctcggtgtaacccattttgccctgccgaattggctttggaacgatacgacatattggtcttcggtcagttccagtgcttcggcaagcagtttggcggtgtggcggcactcgtcgggataggggtcgccgaggtcgtggtgcttctgcggtacgccgtgaaaactcaacatcagttttttcccgcgcccgtgttccgcccaatatcggaggatgtggtttttcatcgcatcaatgtagccggtatcgtcataaaagcgcgaaacggtgcggacgctcatttggttccgttgcagcagtaattgttcgcacaccttatctactgccgctccgctgctggaagcggcatattgcgggtacatcgggatgaccagcagtctgcccgcgccttgcgccttcagttccgacaatacgtctgccaccgaaggattgccgtaggtcatggcgtggcggacgatgaggtcgggcatacgtttggcaagcgcggcagcttggcgtgctgtgtaaacttctaagggcgaaccttccttaaaccagattttttcataggcgtgcgcgctttttttggggcggagcgtcagtaccagaccatgcagaatgggataccacagccatttgggcagttcgacgacgcgccggtcggtcagaaaggacttcagataaggtcgtaccgcctgcgcggtcggcgcgtcgggcgtgccgaggttcaacagcaaaacggcggtacggttttgttgcgtataggaaagggagggttctggaaagaatggaagcatgatcggtttctgaaaaatagtgcgggtagggtaaagcggcaaaatgccgtctgaagcggcttcagacggcattgcagggaatcagtctgtgccgcgtgcgcggttttcgtggaatcgcgcctgccagtcggcaaatttgccttgttcgacggcttcgcgcatttccgccataatgacttggtagaaatgcagattgtggatggtgttcaactgtgcgcccaagatttcgccggtgcggtgcagatggtgcaggtaggcgcggctgaagttttggcaggcgtagcaggtgcagctttcgtctatcggacgcttgtcgagcttgtgtttggcgtttttgattttcaaatcgccgaaacgggtaaacagccagccgttgcgtgcattgcgggtgggcatcacgcagtcgaacatatcgatgccgtgtgccacgccgtacacgaggtcttccggcgtgcctacgcccatcaggtaatgcggcttgtgttccggcagaatcggaccgacggcgcgcagcatacggtacatttcgggcttgggttcgccgacggacaaaccgccgacggcaaggccgggaaaatcaaactgttccaaaccgcgcagcgattcttcgcgcaaatcctcatacatcgcgccttgcacgatgccgaacagcgcgttcgggtttttcaaatcttcaaaggcttttttgctccgttccgcccagcgcaggctcatttgcagcgattttcgcgcctgttcgcgcgtcgcctcgcccggcgtgcattcgtccaactgcatcgcgatatccgagttcaaaaccgtttggattttcatggaaatttcaggcgataaaaacagcttgtcgccgttaatcgggcttttgaacgtacagccttcttccgtcagcttgcgcatatccgacaaagaaaaaacctgaaaaccgcccgagtcggtcagaatcggtttgtcccagccgataaaaccgtgcaggccgccgaattgcccgataacttccaaacccggacgcagccacaaatgataagtgttgcccaaaataatttgtgccttgatatcgtgcaggttttgcgggttcatcgccttaaccgaaccgtaagtaccgacaggcataaataccggcgtttcaattttgccgtggttcaactccagcgtgccgcgtcgggcgagaccgtcttttttgtgtaaggtaaatttaagcataagattgaatgtcagttgggcgacaggggtcgaaatatattttaaaagacggcattataaatgatttcccacggtttttcagacgacatccccaaatcttgccgcaatgttgcataaagaaacgcacatacctcttgcaaaaattaaaacgacccgataaaatgcaaaaattctttgaaggcacgtagctcagttggttagagcaccaccttgacatggtgggggtcgttggttcgaatccaatcgtgcctaccaaattcccataacggcatttatgccgttattttttaatctttcggagcgtttgatgttgaatattaccttgccggacggctcagtccgccaatacgaatcccccgttaccgtggctcaaattgctgcgtctatcggtgccggtttggcgaaggcgacggtggcaggcagggtaaacggcaaattggtcgatgcgtgcgacccgattgttgaagattctgctgttcaaatcattactccgaaagatcaggaaggcatcgaaatcatccgccattcctgcgcgcatcttgtcgggcatgccgtcaagcaactctatcctaatgcaaaaatggttatcggccccgtcattgaagagggcttttattacgacatcgccacggaaaaaccgtttacaccggaagatgttgccgccattgaagcgcgtatgaaagaattgattgcccaagactatgatgtggtcaaaatcatgactccgcgtgcggaggcgattaaaatttttcaagagcgcggcgaagaatacaaactgcgcctgattgacgatatgcccgaagtggaagcgatggggatgtatcatcaccaggaatatgtcgatatgtgccgcggcccgcacgttccgaatacccgtttcctgaaaaacttcaaactgaccaagttggcgggcgcatactggcgcggcgacagcaataatgaaatgctgcaacgcatatacggtacggcttgggcgacaaaagacgaattaaaagcctatattcaacgtatcgaagaagccgaaaagcgcgaccaccgcaaacttggcaagcaattggatctgttccacctgcaagacgaagcgccgggcatggtgttttggcatcctaaaggctgggctttgtggcaagtgattgaacagcatatgcgtaaagagctgaacgccgccggttataaagaggtcaaaacgcctcaaatcatggataaaaccttttgggaaaaatccggccattgggacaactacaaagataatatgttcgtaaccagttcggaaaaacgcgaatatgcggttaaaccgatgaactgtccgggtcatgttcaaatttttaacaacggtttgcgttcgtatcgagatttgccgatgcgtttggcggaattcggttcttgccaccgcaatgagccgagcggtgcgctgcacggtctgatgcgggttcgcggttttgtgcaggatgatgcgcatattttctgtaccgaagatcaaatcgtcagcgaggctcgtgcgttcaatgaattgttgattcgcatctacaaacagttcggtttccatgatgtatccgtcaagctttctcttcgccctgaaaaacgcgcaggttcagatgacgtgtgggataaggcagagcagggtttgcgcgaggcattgactgcctgcggcgtggaatggggcgaattgccgggcgagggtgcgttttacgggcctaaaatcgaatatcatgtcagagatgccttgggtcgttcttggcaatgcggtacattacaactggatttcgtattgccggagcgtttgaatgccgaatatgtaactgaaaacaacgaccgtgcgcgtcctgttatgttgcatcgcgccattttaggttctttggagcggtttatcggcattctgattgagaaccatgcaggctcattcccgttatggttggctccggttcaattggtaattatgaatattaccgaaaatcaggcagattattgtcgggaagtggctgccaaattgcaggcggcaggattccgcgccgagttggatttgcgtaacgaaaaaatcggttacaaaatccgcgacaacagccaataccgtttcccttatcaaatcgttgtcggcgataaggagaagcaggaaaacaaagtggcggtacgccgcaaagcagaagatttgggttctttggatttggatgatttcattgcgcaattgcagcaagaaatcactgatgccctcgtcaatcattaatttttataggagtattcatcatcgctcaagaacgcgaagcacgaatcaacggcgaaattaccgccaaagaagtgcgtttaatcagtgagtcaggcgaacagcttggtgtcgtttcagttcgtgaagctttggctatggccgaagggcaggatgtcgatttggtagagatttccccaactgctaaaccgcctgtgtgcaaactgatggattacggtaaatacaaataccagcaggccaagaaacgcgacgaagccaagaaaaaccaaaagcaggtgcaaatcaaggaaatcaaattccgtccgggtacggatgagggcgattatcaaatcaagatgcgcaacattaaccgcttccttgccgacggcgataaagtcaaagtgacattgcgtttccgcggccgtgaaatggctcaccagcaactcggcgcgcaacttttggaacgtgtaaaagaagatttggctgaagtggcgcaaatcgagtcctttcccaaaatggaaggtcgccaaatggtgatgatgattgcgccgaagaaaaaataaagctataattctccgcttactccgattgccgcttcggagtaagttttcaattgcggcaaaaaaccgtgtcattgtgggttcaagtgtttgaaaccgatgttttaaaaccccctaatgccttatccgataacgaatggagttttcccatgcctaaaatgaaaaccaagtctagcgcgaaaaaacgctttaaagtactgggtaacggcggtgtgaaacgcgctcatgcgttcaaacgccacatcttgactaaaaagaccaccaaaaacaaacgccaactgcgcggtacctctatggtaaatgatcgcgatttggcttctgttgctaaaatgttaccctacgcttaaggagtttagaatatgccacgcgtaaaacgcggtgttaccgctcgtgcccgtcaccaaaaaatcttcgcgttagccaaaggctaccgcggccgtcgtaaaaacgtttaccgcgttgccaagcaggcggtaatgaaagccggtcaatacgcgtaccgtgaccgccgccaacgcaaacgccaattccgtcaattgtggattgtccgtatcaatgcaggtacgcgtgaaaacgggttgtcttacagcaaatttatgaacggtctgaaacgcgcctctattgaaatcgaccgcaaagtattggctgatttggccgtgttcgataaagccgcttttgcacaattggttgaaaaagccaaagctgctttggctgcttaatccaaaaaattgaaaaggaagctgcggcttccttttttctttgtttgcagaaattctatgtgattgattttctttctttaaagtctatttttttaaataaatttgcgttaaaatatagtggattaaatttaaatcaggacaaggcgacgaagccgcagacagtacagatagtacggcaaggcgaggcaacgccgtactggtttaaatttaatccactatacagaaaatttatccaatggattgaccgtgaagaaaataaggtcgtctgaagagtctgatatgtcaggctatacaggcggcctcgttgtttcaggtggtatatcattaattgacagacttgatattatggaaaatgtaaaccgcatcgttgcagaaggcattgccgcagtagaagctgcgcaagacttcaacgctctagaacaaatcaaagcccgttatcttggtaaaaccggcgagttgaccggacttctgaaaactttggggcaaatgtcgcctgaagagcgcaaaaccataggtgcgcatatcaatgaatgcaaaaaccggtttcagacggcttttaatgccaaacgcgaagccctcaacgaagtcaagctgcaagcccgacttgccgccgaagccctcgatattaccctgcccggacgcgctcaggaaggcggcagcctgcatcccgtaaccctgaccttgcaacgtgtggtcgaactctttcacggaatgggtttcgaagtggcggacgggcctgaaatcgaagacgattttcacaatttccaagccctgaacatccctgcaaaccatcctgcccgtgcgatgcaggatacgttttacgttgaaaacggcgatgttttgcgtacgcacacttccccgattcaaatccgctatatgctcgataaaaaagagccgcccatccgcattatcgcccccggccgcgtttaccgtgtggacagcgatgccacgcactcgcctatgttccatcaggcggaaggtttgtgggtagaagagggcgtaacttttgccgacttaaaagcagtgttcacggattttatccgtcgcttctttgaacgcgatgatttgcaagtacgtttccgcccgtctttcttcccgttcaccgaaccgtctgccgaaatcgacattatgggcgaaaacggcaaatggctggaagtaggcggttgcggtatggtacatcctaacgtgttgaaaaacgtcaatatcgaccctgaaaaatataccggtttcgcctttggtattggtctcgaccgcttcgctatgctgcgttacaacgtgaacgacttgcgcctgttcttcgataatgatttgaactttttgaagcagtttgcgaaatgatcgtgcagactgcctgaatatggaaaagcagcctactcttggttttcaggctgcttaggaaaattcaaatgtaagatataaaacatttgatattttgttgtgaaattacattcctaattttgtttaaagaggcataatttattgctttgtagagattatatagttaatttgggtttggttctatgatgataggggcttctttgttttcgagtgcagggattgcagaaacctacttgcataatgcgggtattaagattatagctgcaaatgaattggtgccagaacgtgctaatttatataaagctctatatcccgaaagtaaaatgattataggtgatatacttcatgaggaagtgtttcaaaatttaatacagagcgtgccgaatcgattagattttttaattgcttctcctccttgtcaaggcatgagtgttgcagggaaaaatcgtaacattcaagagatggctaatgataaacgtaatcatttaatattcagagtaatcgaatttattttattaaaacgcccaacttttgttttgattgaaaatgttccattttttttaaaaattaagttaccttataaggggacattacaaacagtagaagtaattttgcaagatttatttggttgcgaatattatattcaaactcatatttttgattctgccgattatggtgttgcacaacatcgtaaacgagctattattcgtatgaataaacattcaactatttggggaatgccggaaaaagttacaaaaaccatttctgttcgtgatgctattagttttttgcctagtattgagtctggacaaaagtctaatgtgaaatggcattttgcacgtacacatgctccggagcacattatatggctaaaaaatacgccaacaggacgatctgcttttgataatatagaacattatccaaagaaaaaaaatggtgaaaaaattaaaagttataatacaacttatcgccgtatggagtgggatgctcctgccccaactattactattcgtaatgacgctatcagttcacaattaaatgttcatcctggacggtctatgcctgatggaacatattcagatgcaagagttttaacaccattagagttaatgcttttaacatcattacctattgattggaatattcccgacgatacatcagaattattaattcggcaatgtattggtgaatctattcctccattgttaattaaaaaaattgtagagagaataggaaaatagatatgacaactgcgcgctgggtaatagataaacatttacagaattttcatattttatgtaaatttgcaggtattttgaaaacaaattcttttatatctgtagaggataaagctaagttatctgaaaaattggaaaaactagatttataccatagacgaaatacaggtaaatcattggatgctactactcataaaataaaagaattatcattctatatgtttggttatcgtgatgtgtgtgggcaagttacacagaaattcctgttcagtccattgggtaatttatttttgaaacacttggataataatgaatatattcaaaaaatttttcttactatgttgtgggcgataccatttcctcatccgtacattaagactgatgaaagtattcaattatatcccatgagactaatatttaagttgttatctgatgaaagattggattgtaaactattttcttatgaatatatctatttaatttcatttgtgaaatctgctgatcagaatagctatgaaaaattagtacaagacattttggtgttacgaacatgtgctgaagtaaaaattaaacatcaattaactgcggaaaatagtcgtagtcatgcttatgtaaatgcagcacatgagtgggaatcttatttttcaaaaacattgactgatgcaggtgttttgcaaaaaacagatggtaaaattatttgccgtctaaagcatggtaagaccgaaacatatcgtaaagtaacatcaagtgagttttcgattcctaagcaacttcaggaatttgtgaaaaaattgcaaagtgcttattcgttttcagaaatgccattaaatctgaacgatagtgatcgtttgaaaattgatgtcattaaggaaatttatagcttctatccaaaagagttattggaggaaattggtgagcttaaggatgaagcagcatatgaattattgcacttacctaggttgattgaacaatatgcagataataataatggaacagaggcatatctatttgaagatgttctagaaatggggttcaatatgttttataacgtagaagctaaaaaaattggtggaccaggtaatacggatttagagtgcttatatattacgcaaaagagaaaatttgcagtggaggcaaaatcaactaaaaataagttatcaggtattaattcaggaagattggaagatcataaaaataaaattaaggccatttacacaattgttgtcacaccacgttatgtccctgccgtattatccgatattcgtaattgcccaattgtaattattcgtgccaatacatttgctgaatttttatataattgtttgattaatcgctccagtattccagagattgattatcggtattttgatgaaattattattaaaaatcttggaaaagatattagttcagaaatttccaatttgactatgcaacagtttgcaagtaacaccacaatggaagcgtatagtacatgataactatttcaaatgaagataacatgatcttaatgtctcggtatcctgacaagtattttgatttggcaattgtagatcctccttatgggattttgaataaaactaaacgtggtggtgattataaattcaatatgaatgaatactcacaatgggatattaagccagaccaaacttactttaatgaattatttcgcgtgtcaaaaaatcaaattatttggggtgggaattattttggcgagttatggttgagaagtgaatataataaaggatttattatttgggataagaatcaaccagagacattaaataatttttctatggcggaaatggcttggtcgtcattcgataggccatctaaaattttccggtttagtgtgcggaaaaatcgtaataaaactcacccaacacaaaaaccagtcgaattatatcagtggttgttaaaaatgtatgcaaagcagggtgataagattttagatacacatttaggaagtggaactcttgctattgcatgctgcattgcacagtttgatttgacagcttgtgaaatcaattccgattattaccaacaatcgattgagaaaataaaaaataatttacctgaagctagaatcagttttgggcatccaggttattgtattattgaataacttaaaaatatagagaaattaaccatgcaattctcctactcatggctgaaaacccaagccgataccgaactttcctccgataagctggaacatctgttaacgatgtccggcttggaagtggaagaggctgaaactgccgcgcctgcgtttgcgggcgtggtgattgccgaagtgaaatccgttgaaaaacatccggatgcagaccgtttgaacgttacccgagttgatgcgggtacgggcgggttggtgcagattgtgtgcggtgcgccgaatgtgaaagcgggcatcaaagtgccgtgttcgctgccgggtgccgttttgccgggtaatttcaaaatcaagccgaccaaaatgcgcggcgaggtgtcggacgggatgttgtgttccaccgacgaactcggtctgcccgacgacggtgtgaacggcctgcacattctgcctgaagatgcgcccgtcggtaccaatatccgcgaatacttggatttggacgatacgctgtttacgttgaaaattacgcctaaccgcgccgactgcttgagcatcaaaggcattgcgcgcgaagtgtccgcattgacggggtgcgcgttcaggcagcccgaaatccataccgcgccgatcacgggcagtcgaaaacagcccgtgcagattaacgcgcctgccgattgcggccgttttatcagccgtgtgattgaaaacgtgaacgcgcgcgctactacgccggattggatgaaacaacgtttggagcgcagcggcatccgcagtatttccgcgctggtggacatcggcaattatgtgatgctggaaatcggtcagccgatgcacgtttttgatgccgacaaactttccggcagcctgcacatccgccgcgcgcgcgaaggggaaacgctggaatgcctgaacgagaaaaccgtttccctgtctgaaaacacgctggtcgtggcggacgaaaaaggcgtgttgagtttggcgggcttaatgggcggcgcggcgagcgcggtttcagacggcacgcaaaatatcgtgctggaagcggcttggtttgcgcccgaaatcatcgccggcaaatcgcgccaatacggtttcggttcggattcgtcgttccgcttcgagcgcggcgtggattaccgtttgcaggcggatgccattgaacgtgctaccgaattggtgttgcagatttgcggtggtgcggcaggcgagatggtggaagcgcaaggcgaattgcctgaagcgaagcaggttggattgcgtttggaccgtctgaaaaccgtgttgggcgtggacattcctgccgaacaggtggaaaccattttgcaacacttgggcctgcagcccgagaaaacggcggaaggcttccgcgttaccgcgccgagcttccgttttgacatcgaaattgaggctgatttgattgaagaaatcggacgcgtttacggctatgaaaacatccccgacgattacacgtcaggccgtctgaaaatgctggaactgcccgaaacacgccgcccgcgttttgccgtttacaacgaaatggcggctcgcggttaccgcgaagtggtcagctatgccttcgttgacgagcagtgggaacaagattttgccgccaacgccgaccccatccgcctgcaaaacccgctggcggcgcagtatgccgtgatgcgttccacgctcatcggcggcttggtggaaattctgcaaaacaatctgaaccgcaaacaaaaccgcgtgtgcgtgtttgaaatcgcccgcgtgttcagcaaaggttcagacggccagtttgtccaaaacgaacgcatcggcggattgtggtacggcgcggtcatgccggaacaatggggcgggaaaacgcgcaatgcggatttttacgacatcaaggcggacgtggaaaatctgttgaaaaacaaagcagtcgagttcgttaaaaccggacatcccgccctgcatcccggacgtgccgccaatatcgtttcagacggcaaagtcatcggctttgtcggcgaactgcatccgaaatggctgcaaaaatacgacctgccgcaagcgccgctggtatttgaaatcgatatggcggccgtgttggaatgcgggaaaacgcgctatcgggtcgtatcgaaattccagccggtgcgccgcgatttggcgtttgtgatgccggaagctatgagccatgatgatttgctgcttgtcttgaaaggcgcggcaaacaagttggtacaggaaatcagcgtgtttgacgtgtatcgcggcacgggactgcccgaagggatgaagagcgtggcggtcaaagtgattttgcaggatatggaaaacacgctgacggatgaggcagtcgagccgcttatcggaaaactgattggcgcggcaacggcggcaggggcgcggcttcgcagttaaaaaataaatattcgcttgaattttaaataaaaattggtaataatccacaactgttacaacagaaggtaatcatatgactctcactaaagcagaactggccgatattttggtagacaaagtcagcaacgtcaccaaaaacgatgccaaagaaatcgtcgaactcttttttgaagaaatccgcagcactttggcaagcggcgaagaaatcaaaatttccggtttcggaaatttccagttgcgcgacaagccgcaacgcccgggtcgtaatcctaaaaccggcgaggaagtgccgattaccgcccgccgcgtggtaactttccatgccagccagaaactcaaaagcatggtggaacactactatgacaaacaacgttgatttgaaggttcccgcaaaacgctatttcacgctggacgagttgtgcggactgttgcaaatcagcccctatggttttgcgcaatggcagcatgatcacggtgtggttgtcggttacggcggcgaacgctacacccgtttggatgtggtgaaactgttgaaattgcagagcacgtttgcaccgtatgcagaaggtgcggaatcgggttcggacggcaaccgtccggttacgcttcaggaaatcggagacgctctgaaagacctgttggcggatttggataaggaattgtgctgatttgaggccggttgcaggtatgcagccggttttgttttacacgctaaaaaataattatagtggattaacaaaaatcaggacaaggcgacgaagccgcagacagtacaaatagtacggaaccgattcacttggtgcttcagcaccttagagaatcgttctctttgagctaaggcgaggcaacgctgtactggtttttgttaatccactatattgcgtgatttcacattgtttcggcttgaagcacatggttttgtaatcatttacaggcagctcgcttggagtcctgttcgggcggtttgctgtttacttaaatataaggatgacggtcaatgagatttttcggtatcggttttttggtgctgctgtttttggagattatgtcgattgtgtgggttgccgattggctgggcggcggctggacgttgtttttgatggcggcaggttttgccgccggcgtgctgatgctcaggcatacggggctgtccggtcttttattggcgggcgcggcaatgagaagcggcgggagggtatccgtttatcagatgttgtggcctatccgttatacggtggcggctgtgtgtctgatgagtccgggattcgtatcctcggtgttggcggtattgctgctgctgccgtttaagggaggggcagtgttgcaggcaggaggtgcggaaaattttttcaacatgaaccaatcgggcagaaaagagggcttttcccgcgatgacgatattatcgagggagaatatacggttgaagagccttacggcggcaatcgttcccgaaacgccatcgaacacaaaaaagacgaataaatatgaatggaatgccgtctgaaggttcagacggcatttttccggtttgaaaatatagtagattaacaaaaaccagtacggcgttacctcgccttagctcaaagagaacgattctctaaggtgctgaagcaccaagtgaatcggttccgtactatttgtactgtctgcggcttcgttgccttgtcctgatttttgttaatccactataaaatagggctgtaaccttcaatcggaatttgttgcctgcgggatatacggtatgaatgtttggtatatatgggacaggatggtggaaatctatcataagtataagaagccgtgcctggttttggcggtggattttgtgatgggtatggtattcatagagccgaatgaggagccgtgcatcggtaggtgctatgcgcctatgtcggagtcccctgattttgctaacgctgttgcgatggctgttgctatgatctgtatcgtatggattgccgttttatagtggattaaatttaaaccagtacggcgttacctcgccttgccgtactatttgtactgtctgcggcttcgttgccttgtcctgatttttgttaatccactatatctatgactgattgaagcgttgggcggaggctgcgtgaaacggtattgggcgttgggccgtctgattccaatcgggcttggggaatgcgaaacggtgtgcgcttatactgcggacgatttgtttcgcggttttgcgcccgaaacggatggagaggtgtgggaaacggtctgtcggagtagaatacgcgttttgcgtttgaatacagtaagaagaaaagagagaaacttatgccgtctgaacatcaacacatatcatcattgcttgatttcgaccgtacccatctgcttcatccctatacttccatgaccgatccgctgcccgtttatcctgtcaaacgtgcagaaggggtgtttatcgaattggcggacggcacgcggctgattgacgggatgtcctcctggtggtgtgcgatacacggctacaatcatcctgttttgaatcaggcggttgagacgcagatgaaacaaatggcgcacgtgatgttcggtggtttgacgcacgagccagcggtggagctgggcaagttgttggtcgggattttgccgcaggggctgaaccgtattttttatgcggattcgggttcgatttcggtggaagttgcgctgaagatggcagtgcaataccagcaggcgcggggtttgacggcgaagcagaatatcgcgacggtgcgccgcgggtatcacggcgatacttggaacgcgatgtccgtctgcgatccggaaacggggatgcaccatattttcggcagcgcgttgccgcagcgttattttgtcgataatccgaaaagccgtttcgacgatgaatgggacggggcggatttgcagcctgtccgcgccttatttgaagtgcatcatgcggatattgccgcctttattttagagccggtcgtgcagggcgcgggcggcatgtatttttatcatccgcagtatcttcgcggattgcacgatttgtgcgacgaatttgatatcatgctgatttttgacgaaatcgccactggattcgggcgcacgggcaagatgtttgcctgcgaacacgcggaggtcgtgccggatattatgtgtattggcaagggtttgagcggcggctatatgacgctggcggcagcaatcacttcgcaaaaagttaccgaaacgatttcgcgcggcgaagcgggcgtgtttatgcacggcccgacgtttatggcaaacccgctggcgtgtgccgttgcctgcgcttcggtcaaactgcttttgtctcaagactggcaggcaaatatccgccgcattgaaagcatcttaaaaggccgtctgaaagccgcgtgggacattcgcggcgtgaaagacgtgcgcgttttaggtgccatcggggtgatcgagctggaaaaaggcgtggatatggcgcgttttcaagcggactgcgtggcgcagggcatttgggtgcgcccgttcggcaggctggtgtatctgatgccgccctatatcatttcagacggcgttttgaccaaacttgccgacaaaaccgtgcaaatcttgaaggaacacagcaaatgaaaggcgtttacttcgtcagcggcatagacacggacatcggcaaaaccgtcgccaccggcgtgttggcaaaacaattgttgcagcagggcaaaagcgtgattacgcaaaagcccgtgcaaaccggttgccaaaacattgccgacgacatcgccgtccaccgcaaaattatgggcataccgatgcaggaagccgacaaacggcggctgactatgcccgaaatcttcagctatcccgcttcgcctcacctcgccgcccgactggatggcagggctttggacttggacaaaatccgcaccgccacacaagaattggcggcgcagtacgaagtcgttttggtcgaaggcgcgggcggattgatggttccgctgacggaaaacctgttaaccattgattatatccgtcagcaaggctatcccgtcatcctcgttaccagcggacggctcggcagtatcaaccacactttactcagtttcgccgcgctcaaacaatacggcattcgcttgcacagcctcgtgttcaaccacatccacgacagccgcgacgcacacatcgcccaagacagcctgagctacttgaaatgccgtctgaaagccgatttttccgaagcggaatggatggagttggcaaaaacagacgcggtataaagattgggaaaaatatggaacacctatttgggaaatggctgcccgacttgcccgccgccatttcagacggcatcagcctgccgatggtgcggctgctgcacacccggtcgctgaccgccgcattgcgcgccttgccgcatacattttcggtggaactgctgaaactgggcgaattggagacggaatgcggagggaggctggtgcgcgaagttttgttgaagctggaccgtatccctgttgttgaggcaaggagcgaatgccgtatcggttcggcgttttggcaaaacattttggactgcggcacgcgtcctttgggcgagcgtctgtttcaagccgatttggaaggggcgcgttcggcgtttgagtttgccgttgccggcgaaggatgcggacggtactttgccgcgcggcgttctcggttttcccgtcacggcgaggaaatgctgctgaccgagtattttctgcccgaactgaaacgttttatcggataaaataccgttttttcaagctgcgcggcaatatgaatcctaaatcccctttatttttacgcctgtccgaccgtttggatgtgtacctgcgcctgatgcgggcggacaagcccattgggacgctgcttttactgtggccgacctactgggcattgtggctggcttcagacggcattcccgatttggcggtattggcggcgtttacaatcggcacgtttttaatgcgcagtgccggctgcgtcatcaacgactttgccgaccgcgattttgacggtgctgtcgagcgtacaaaaaaccgtccgttcgcacagggcagggtcaagaaaaaagaagcgctgctgctgacggcatttttgtgcctgcttgccgcattgtgcctgattccgctgaatcatctgacttggctgatgagcctgcccgcgctgtttcttgcgctgacttacccgtttaccaaacgtttttttccgattccccaactctatctcgggcttgccttttccttcggtatcccgatggcgtttgccgccgttgccggaaacgtgccgcctcaagcgtggatactctttgccgccaatgtgttatggactctggcgtatgacacggtttatgcaatggcggacaaagaagacgatttgaaaatcggcatcaaaacctccgccgtcacgttcgggcgttacgacatcgccgccgttatgctgtgtcacggaggctttaccctgctgatggcagtattgggtgcggttatcggtgcggcatgggcatattggacggcaatccccatcgtcctgctgctgcaataccgccaatatgccgccatcaaaagccgcgtccggcaaatctgttttgaaacgtttttggcaaacaacagaattggttgggtgtggtttaccgccatttttgcccatacgtttttcgcgaaataaggcagggcaatgccgtctgaagagccgtaaactgctttggacggcatttctatctgtgccgaaaagcgttaaaatatgtttttaaaacgctgtgttatgtcagcccgtaccgtatgcgggattgagatttgccccggcagtcggtacaatctttctgttttgcgatgtctgaaaagagaagcttatgagccttatcggcgaaattttgcctttgtcccatattgttttggatatggaggtaggcagtaaaaaaaggctgtttgaggaagcaggcctgcttttggaacgcgaatcctcattgtcccatgctgatgttttcgaatgtctttttgcccgtgaaaaactcggttcgaccggtttggggcagggcgttgccatcccgcacggccgtcatgccggcgtgaagcaggcgacgggcgcgttcatccgcacgcgcgaacccgtcggatttgacgcaccggacggcaagccggtttccctgatttttatcttgctggttccggaaaacgcaaccggcgagcatttggaagtcttatccaaactggccggcaagttttcccaaaaaagcatcagagaatcgctgatgacggtttcctctgcggaagaagtccgtgccatcctgactgaagaataatatgcccagtatctccgtccgccgcctgtttgatgacaaccaatacaaactgcaactcgcttgggccgccggcaattcgggtgcggacaaccgtatcggcgtagaggcggacaagcccgtcctcgccctagtcggacacctgaatttcattcatcccaaccaaatccaagtggtcggtttggcagagtcggaatatctgaaccgcctcgaatcgggggaaacgggttatcagtttggcgacctgttcgatatttctatgtctttggttattgtggcaaacggcttgccggtttccccgggactgcgcgactattgtcataaaaacgatattccactgctgacttccaaactcgaaagcccctatctgatggacgtgttgcggatttacctgcaacgcaccttggcggcatcgtccgtcaaacacggcgtatttctcgatgtgtttgaaatcggcgtgctgattaccgggcattccggcctgggtaagagcgaattggcattggaactgatttcgcgcggccacagcctgattgccgacgatgcggtcgagctgttccgcatcggcccggaaacgctggaagggcgttgttcgcctatgctgcgcgattttttggaagtgcgcggcttggggatactcaatatccgccatattttcggcgaaacttccatccgccccaaaaaaatcctgcaactcattatcaatttagtcgaggcggacgacgagtatatgaagcagcttgaccggttgagcatccgcaccgaaaccgaatccatcctcaacgtcaacgtccgttcggttacgctgcccgtcgccgtcggacgcaacctcgccgttttggttgaggcggcggtacgcaattacattttgcagttgcgcggtaaggacagtacgcgcgaatttttggaacgccatcagacgcaacttaaagaaaacgaacaacacaatgaagatcgtcctgattagcggcctgtccggttcgggcaagtccgtcgcactgcgccaaatggaagattcgggttatttctgcgtggacaatttgcctttggaaatgttgcccgcgctggtgtcgtatcatatcgaacgtgcggacgaaaccgaattggcggtcagcgtcgatgtgcgttccggcattgacatcggacaggcgcgggaacagattgcctctctgcgcagactggggcacagggttgaagttttgtttgtcgaggcggaagaaagcgtgttggtccgccggttttccgaaaccaggcgaggacatcctctgagcaatcaggatatgaccttgttggaaagcttaaagaaagaacgggaatggctgttcccgcttaaagaaatcgcctattgtatcgacacttccaagatgaatgcccaacagctccgccatgcagtccggcagtggctgaaggtcgaacgtaccgggctgctggtgattttggagtccttcgggttcaaatacggtgtgccgaacaacgcggattttatgttcgatatgcgcagcctgcccaacccgtattacgatcccgagttgaggccttacaccggtatggacaagcccgtttgggattatttggacggacagccgcttgtgcaggaaatggttgacgacatcgaaaggtttgttacgcattggttaccgcgtttggaggatgaaagcaggagctacgttaccgtcgccatcggttgcacgggaggacagcaccgttcggtctatattgtcgaaaaactcgcccgaaggttgaaagggcgttatgaattgctgatacggcacagacaggcgcaaaacctgtcagaccgctaattccgtcaaaccattatgccgtctgaaaccccgtcctccgtttcagacggcatttcaaatattgaaaagaaagaacagacatggcaatccaatggtttcccggccatatgaacaaggcgaaaaaagccatcgccgagcgtgcaaaaagcgttgatatggtgattgaaatgctggacgcgcgtatgcccgcctccagcgaaaaccccctgcttgcccagctttccaaaggtaaacccaaacttaaaatcctcaacaaacaagatcttgccgaccccgagcgcaccaaaatctggctcgaacactataacagccgccccgacacctgcgccatcgccctcgattcctccgaaacaggcgcacacggcaaaattacccaagcctgtcgtgccatgattccccaccgccaaggcatagataaacccctgcgcgtcctcatctgcggcatccccaacgttggcaagtccaccctcatcaacggcatgataggcaaaaaatccgccaaaaccggcaacgaacccggcatcaccaaagccgaacaacgcctcttcctcgccgatgacttctggctctacgacacccccggaatgctatggccgaaaatcatcgtcgaagaaggcggctacaaccttgccgccggcggcgcagtcggacgcaacgcgttggacgaagaagaagtcgccctcgaacttttagactacctccgccgccactacctccctatgttgcaagaacgctaccaagccgacaaagaccccagcagccactgggacgaaaacgtttggctcgaatggatagccaaaaaacgcggcgcagtcctcagcggcggacggatcaactaccaaaaagccgccgaaaacatcctcaccgacttccgtgaaggcaaaatcggcagaatcaccctcgaaacgccgaaccaatgggaaacttggctcaaaaaagcccgtcagaaagaagccgaactcaaagccatacgcgaagccagaaaagcagagcgtaaagggcagaagcttcggaagcataaagaatgccgtctgaaaaatatttttcaggcagcttctctctactccaaccgatttcagacggcatatccaaacccatgccgtttcagcacggatacccgtatgaccgacaaaatttctcccgacgcgctgattgaagccgcactgctgacccaaaccgaaccgctgaccgaaaaatctatgcgcgaactgtgtgtgccgccgttgtcgcaagacaaactgattgatgtgttggcgcagttgaaaacgcgttggcaggatagggcgttgcaactggtgcatacgcaagagggctggcgttttcagattgttcagacggcattcgagcggctgggcagcctgcaagaacagcgtgcgccgcgctactcccgcgccgtgatggaaacactggcgattatcgcctaccagcagcccgtaacgcgcggcgacatcgagggcatacgcggcgtggcggtgtcgcagaacgtgatgcagacttgcaggatcgggggtggattgaagtcatcggacatcgggacacattgggaaaacccgcattgtgggcgacaacggcaacgttcctcagcgatttgggtttgaacagcttggaagaactgccgccgctgaccgaactgggcgaactggttttgcccgatttgatagaaatgccgcctacggatgaagaagagccggaaaccgtaccgtccgataccctgcccaactgaaattccaaatgccgtctgaaacgcacattgcttcagacggcattgcaacaaataagcagataaaaacaagcactaagaaaaattaaggaaaaacttatttttaatttaaaaaatcttagttataattcgtatatctaaagttgatattgcttttgtcggtagaattgctaaggaatcctcacgatgcttctaacactttctttgcgtgattttgtcattgttgaaaatctgaatctggattttcaaagcggctttaccgtattgaccggagaaactggcgcgggcaagtccattactttggatgcgattggtctgctgttgggcgataaagccgattacagccaagtccgcagcggcgcaaaagaagcgcagttgtcggcgttgtttgatatttcccatttacctgttttaaaagcagaattgtatgaacaggggcttttaaacgacggagaagaagaactcagtatccgccgcattatcgatgccaaaggcaaaagccgcagctttatcaacaatcaggccgctaccttggcgcaactcaaagccgtcggtagccagcttatcgacatccacgggcaaaacgcccatcattcgcttaatcaggaagccgcccagcgcgaattgttggacgcatttgcgggtagcagggagcaggcggaaaccgtcaggcagctttatcaaaattgggccaatgcgaaaaaagccctccaagaggcgcaggaacacgccgatgccgtcattatcgagcgggagcgtctggaatggcagtttaacgaattgaatcagttggacattaaacaaggcgagtgggaagccctcagccaaagccacgacagccttgcccattctgccgagctgttgcaggctgccgaagaagtcggaagcaagattgacggcgacaacggcatccaacgccatatctatcaatgtcaaaaactattggccaatctgcaaaacatcgagccgcgctttgccgagagcctgaatatgttggcaagcatcgaagccgaattgggcgaaatcagtgccaatatgcgcgatgtggcaggtcgcagcgacatcaatcccaacgaacttgccgcacaagagcagcgcatgggcgagctgatggggatggcgcggaaataccggatcgagcctgaagagttgcctgccaagttggcagaaatcgaagaacgcctgcaaagcctgcaagctgccgccgatttggacgcgctcgagcataatgttgcccacaattttgccgaatatcaggaagctgcccacatcctttctgccatgcgccatcaggcggcagagcgtttgagcggcgaaacgaccgagcatatgcaacaccttgccatgaaaggcgcgcgtttcgacatcgtcctgttgccttcgtcgccgacggcacacggtttggagcaggttcaatttcaagttgccgccaacaaaggcaatccgccccgtctgctgaataaagttgcctccggcggcgaattggcgcgtatcagccttgccttacaggttgttgccagccaatatacccaagttcccaccctgatttttgatgaggtcgataccggtattggagggggagtggctgaaatggtcggcaaggcattacgtgcgttgggcagaaaacatcaggtgcttgccgttacccaccttccccaagtcgcatcctgcggagaaaaccactggcgggtgcgcaagcacagcgagggagagcaaaccgtcagcgaaatcagtatattggatgaaatccaacggatcgaagaggttgcccgtatgttgggcggagaagtcattaccgatacgacgcggcaacatgcggcagaattgctgcaacttgcgtcgaaaaatagtttattttaaaatcaatcagttaaaaaataactaaaaataaaagtctaaaacaatagacagaactcagataaatccgtattatcacgctttcttaatcacttgaacaagtgattgtgctgcacccgtagctcagttggatagagtatctggctacgaaccagagggtcgggcgttcgaatcgctccgggtgcgccagtaagaaaatacaatatgcgcccatcgtctagcggttaggacatcgccctttcacggcggtaaccggggttcgattccccgtgggcgtgccaattcaaaatgcctccgattatatcggaggcatttctcatttctcatttctcatttctcatactgagacctttgcaataacataggttactaaaattttatgctcaatctcattttcaaaatgcaaaacttttctgatttttcctactttttgctcaatattaggaaggttttaggcaattgaaaattttttggcgcatttttatgcgtcaaatttcgttaacagactatttttgcaaaggtctcggattaacaaaaatcaggacaaggcgatgaagccgcagacagtacaaatagtacggaaccgattcacttggtgcttcagcaccttagagaatcgttctctttgagctaaggcgaggcaacgccgtactggtttttgttaatccactatattgagtcctcgagaagggaaataaaaattaacatccttatatattgagttcctgagaagggaagattaacaaaaattaacgccctttacttcatacaatcaacagggctttttcattccttccttatctaacagggggtacagaaaccgaaacggctggcagggttaaggaagtcttcgaatgttacggaacattcatcttggacagcaaaggcaatttgttaggcattccttactccttattttgggaagaaaacgttatgggtgttttcgatattttaccgtcaggattggtatgtttatttgaatatgattttctgtggtcgggacggcatgcggcaaagacttaaggggttagatccttccttctgacgatggcgcggatgatggtgcggttggggtgtagggcgtggcgcaggcgttgtgaaaagggatggggcaagcctaggatttgggctgcaatggcggcggcgcagatgggggcggtggcgagtccgcgggtgccgtgcgcggtgttgacgtaggcattaggcaggtatgggcatggggtgtcgatgcggtagtttttgtccagcgcgagtttggtgtaggtctgccgcatggcggcaatgtcgccgagtgcgccgactaggggaaggtggtcggggctgtcgcagcgtatggcggcgtgcccttggtgtttttgggggtttgggttggcggcaaacaatgattcggaaagggcggggttaaggtgtgccaatgcttggcggtttgaggcttcttcggcttcgttccatccggtatggctgctgttgggaataaaactcgcgccgtagcagtgcagtccgtgccacgacgggctgatgtagctttcgcctgaaacggcgcaacgcagttgttcggaaaacggggtggacggtgtgaggccggtttgtccgcgtatttgcctgagaggcagggcggcgaggttggtttcgggtaggtaggggctgttcgcaccggtgcagtagatgatgtgtgtggcggtaaatgtgccgtttggcgtgcttgcaatccacttttccccgtcgtgggaaatgtcggtcaagggtgtgtcttcgtgtagtccaatgagcggatggttgaggagggtgcggacgaatgcgggtggattgagccatacgccgtgttgccagtagagtccgcatgaagggtggtcgtatgggacggacagtgggataccggcgattttttcggcttctgcagatgtgatgctgcggtagaggtggttatggtgtttttgcaaacccaattcgtgattgcgttgttgttcggtgcggctgtaattgaggtggatgatgccgttgccgccccaggtttcggattcgggcaggatgtgtccgagcaggcgtttggtgtagccgtagccggcaagcaaaagttcggtctgttcggtgtcgtgcggcgagattttggcgtagagcagcccttggcggttgccgctggcggcttgggcggcttttcgggcttccaatacggtaacggaaatgccgtgtgatgctaaggcgtgggcggttgccgcgccggatatgcccgcgccgataacgaggatgtgttccggtttttgccgttcggatgtttgtggaagtgcaaaccagggtttgtcgggcttgctttcggtttgcgggatggcttcggtctgccaggaaatgtggtggaaatgttcgtgcaggtggtgggtgcgtgaagggggaaccagccagaagcggacatcgggcaggatgtgttcgatgaggttgatgctgtcgaactggaggcactgcattgcctgatccaaacggtgcttcagacggcattccgcgtccgaagcatcttgtgcggtttgaaaatcgggaatctgattatcggggaggcagataatcaggttgagcgggggtgcgtgtttgcggatggcttggtcgagtgtgcggatgtcgggaatgccgtcccatacgagattgtccatatcaatgccgtttaaagtgtgggtttgaatatcggtatcgggataaagctgttaaaatacgcgccgtttgaaggcacgcctgcgcctgccggatattgtatgccgaaccgaggtgttttttgaataatattcctgttgaaatccgtttgttgaaaaaccgtaccgtgttggttttgacttatggggacgaacctaaaaatctgcctgccgaatttttacgcgtctattcgccgagtgcggaagtgcgcggacacggcgtgggacaggatgttttgcagaccggcaaggcggatgtccaaatcgcggatttgcagcctgtcggacagtacgcgctgaaaatcagtttttcagacgggcacgacagcggtctttacgattgggcgtatctgcacagactggcatacggatacgatgcgatgtggcaggaatatttggacaaattggcggcggcgggcgcgtcgcgttttgaagagaaataagaccggtcggatggtaatctgacgggcaaaggtatcagagaggtggttagaatatgggcggacagaaaacgcatttcggattcagtacggtcaacgaagatgaaaaagccggcaaagtggcggaagtgttccactccgtcgccaaaaactacgacattatgaacgatgtgatgtcggcagggctgcacagggtgtggaagcatttcaccatcaacacggcgcacctgaaaaaaggcgataaagtgttggacattgcgggcggtacgggcgatttgtcgcgcggttgggcgaaacgggtcggcaaggaaggcgaggtttggctgaccgatattaattcctctatgctgaccgtcgggcgcgaccgtctgttgaacgaaggcatgattttgcccgtatcgcttgccgatgcggaaaaactgcctttccccgacaattatttcaacttggtttccgtggcgttcggcttgcggaacatgacgcataaagatgccgcgctgaaagagatgtaccgtgttttgaaaccgggcggcacgttgctggtgttggagttttccaaaatctacaaacctttggaaggcgcgtatgatttctattcgttcaagctgctgccggtcatgggcaggctgattgcgaaagatgcggagagttaccagtatcttgccgaatccatccgtatgcaccccgatcaggaaactttgaaacagatgatgctggatgcgggcttcgacagcgtggattatcacaatatgagtgcgggcatcgtcgcgctgcataagggcgtgaaattttaaacggactggctgtgcagccaatgccgtctgaacacgtttcagacggcatttttgtgtttttttgagaaagagattttaaatcttaaaattaattcacatatccatcaataatttataaattttttaaaaaataggaacaattatcatttgcaagattgggagatgtctgtataatgcagtcaatccagtaaacaacgcagcagacgaaaggagggaaaaatgccggaaagtattttcaaacagatttcccttgatattttgaaactgcatcgggattctgtttattcgctgcttgccacttccggctgcaactgtcaggtgcatgaagcggcgtatgtcaacatcgacggcaaatattatattgcgctttcatgcgagcccgaggtgggggaagtcaaaacaggcattttgctgattgaggatgaaagccgcaaccttcgtttgagctgggtcggcagtgcgcgggagcttgactgcaaggataatgcctacaaacgcgccctgtccgcgttgtccagaaagctggggcggtgtaaggacaggctgcatacggcggttcaaccgtttctgttggagctggtaccggagaaaggcagattttctgtcggcgatgaagaagtttggatttctcgaaacgatttagtgagggctttatatcctgtcggatacagtatgcggcaggcagtgtttcagatttaaagttttggtagtggtttgtgttccttttgcgcccccttttccaaggggcgatttttttgcacgcgtgttggcggcaaaggaaaaatgccgtctgaaaggctttcagacggcatccgcgtgcggaattacctgtccggtaaaagacggataccttgattgcccagccgttttgacaattcggcaacctttccgtgttttcctaaaacaaaatcagggaggatttctgccaaagggcggatgacgaaactgcgttcgtgcgcgcgcggatgcggcagggtgagtcgggtgtcgtcgctggagatgccgtcaaagtcgataatgtccaaatccaatgtgcgcggcgcgttgcggaagctgcgttcgcgtccgaaatcagcctcgatacggttgagttcggcaagcagggcaatgccgtccagagtggtggaaacggtgcagacggcattgacaaaatcgggctgattgtcgtaaccgacgggcgcggtcatatacagtgaggaagcctgtttaagacggatgtcaggatgggacgacagcgtgtccaatgcggcgcgtacctgttgggcagggttttcaagattactgcccagggcgatgacggcaaaatgtctgttgttcataacggtgtttcagaaaggcaggactttggttttggcaaggtaaacgatgcaggcgacgcaacacatggcgagcaggtaaacggtgtagaacttggtcgaacgcggacgggcgcgcatcatcatcatacccaatgcgatataggcgagcagaagcaggatttttgtaccgagccaaggcgcgttgaacggggagaaatgggtaattttcatcagccacaatcccgtaaacagcagcatggtgtcgttaaggtggggcagtgccttccaaaagcccgccaagggcttttctggatttttccaaagtaggaaaaaacggatgttgaataccaaaatggtgatggtaacgaagatttggtggctgtatttgacaatcagatactgcatggtcggctcgtatcaaaataagggttagaatcggcttattttaccgcaaacagttatttttgacgcagtttttcaaataccaaaagatagggtgggctgtttttccggttggtaaagccgtaacgcaaaacggcaaactgttcttgaggcaggttttttgcccattgttcgattgcttctgcctcctgtttgccgttttcgtgtcccggatagaggacggcaataagcataccgttttctttcagtagggataaggtggcagaaagggcggcaatgctggtttccgtgcgggtggtaaggcttttgtccccgccgggcagccagccgaaattgaaaatggctgcatccagcggctttggaatatattgcttcaggttttcatgtccgtccaagatgagccgtacattgctgtaacctgcttcctgcagacggcatcgggtgttgttcagggcttgcggctggatgtcgaatgcccacactttcccccggatgcctgcggtttgtgcgaggaaaagggtgtcgtgtccgttgccggcggtgccgtccaaagcattgccaccttcgggaagtgccttccgcaaaaggcaatgggcgaatggaaggatgttttgcaataacatttttaaatgctgtctgaaaataaaaataccttaccgttgtccggtaaggtattgaaagatatgacacgtcatgcttcgtgcggattattcggcaggctgctggacggtttccacttggacgagggtcgaagtcggtgcggcttggggtctgttttcatgttgtaggttgacggagcgtgccggtacgatggtggaaatggcgtgtttgtaaaccatttgggtgacggaagtgtttctcaggagaacaacgtattgatcgaaagactcaacctgaccttgtaatttgataccgttaactaagtaaatcgaaaccggaacgtgctctttacgcagggcgttcaggaagggatcttgcaacatttgtcctttagctgtcatatttttaactccgttattatgattgtgaaatcgggcagacgccctgtgcgtgtcgaattgtagccttgaataggaaaaattaccaattttttttgtgtttgggcggttttccgccgggcatttgtatgtcaggagcgttgctgcagcatccacgattcgattttgcgggcgtcgttgacgcgtgtggcggatgtgggcgagttcagcaatacgatggtaacgggttggttttgaatgttggctttgacaaccatagacctgcctgcttcgcgtatgtagccggttttctgcaattcgatgttccacatgccttctctgaccagggcattggagtttttgtagttctgctgcccgtttttggtctgtaccgaggcgtagttggaagtcgagttggtgcggatttgcggatattgggcggcggcgttgaccataaggctcaggtctttggcggtagaaacgttttggaagttgagtccggtcggttcgtaaaagcggctgccgtacataccgaggctttgggctttgcggttcatggcggcgacaaatgcgcccatgccgccggggtaggttctgcccaatgcatgggtggcgcggttttcgctgctcatcaggctcaggtgcagcagttttttgcgtgtaagtgccgtacctatggcaagacggctgccggtccctttgatgcggtcgatttcgtcgggcgtaatggtaacggtttcgttcatgtccaagtttgcatccaaaacgaccatcgcgctcatcagtttggaaatggaggcgatgggcataatcctgtcggcgtttttctgatacagtatctgtccggttttgttgttgacgaccagggcagactgtgaggagagaatcagaccgcctgtaatggcttgggtgttggtggggtgtatcgtgctttcggcgaatatttctatcggatcggaggaggtaagcatgttctgttctaaaaattgccctaaaatgtcgttgtcggcaaaaaggtgggctgacggcagggaaaggcagagaccgagcagcagcgatgagggcaggcgtttcagagtatggatggacatttttgattccatatttttgagtattggcgttattttgttgaaaaaacagccatctgtaaagtatgtcgtctgacaggagactgcccgtaggcgggcggtcttgttgtgttttggggattgggttttataacattctgtttttaaatcggaacatattttgtggtttgacatggatatttttcatgccgtcgtgtgtcggtttggatgtttccggcggttgaatccttgtcctttggggcggtagaatcggggttggtttggcaattgcggcggtgcgtctgcgtgccgttttgaataatgggaatatcgggagtaggactatggatgtgaaatatgaatttaccctgccttcgagcagcggtgcggattttcattcggcagaacatctgcctttggtcgtgtatttttatccgaaagacagtacgctgggctgtacgacggaaggcttggatttcaatgcgcgtttggaacagtttgaggcattgggttataccgtggtcggtatttcccgcgacggcgtaaaggcgcatcagaatttttgcgccaagcagggtttccggttcgagctgttgagcgacaaggatgaaacagtgtgccgcctgtttgatgtcatcaaattgaagaaactgtacgggaaagagtcgttaggtatcgagcgcagtacgttcgtcttgaataaggatggagaaatcgcccatgaatggcggaaagtcaaagtggcgggtcacgcgcaggaagtattggaaacgctttcccgataatgtgaaccatgccgtctgaagaagattcagacggcatttgtttggaacggtatggaagaaggtttgatcgacaggctgcttgaaacgctgtggttggacaggcggctcagtcagaatactttaaacggttaccggcgcgatttggaaaaaatcgcccgccgcctgtcccaatcgggcagaatgctgaaggatgcggacgaagcggatttggcggcggcggtttatgttgacggagagcaacggagttcgcaggcgcgcgcattatcggcatgcaaacgcctgtatatatggatggagcgtgaaggcataaggacggacaatcccacccgtttgctgaaaccgcccaaaatcgacaagaatattccgaccctgatcaccgagcagcagatttcccgactgcttgccgccccggataccgacacgccgcacggtttgcgggacaaggctttgctcgaattgatgtacgcgaccggcttgcgcgtcagcgaggcggtcgggctgaacttcggcaatgtggatttggacaggggctgtattaccgcgctgggaaagggtgataagcagaggatggtcccgatggggcaggagtcggcgtattgggtggaacgctattatacggaggcacgcccacttctgctgaaaggcaggaattgcgacgcattgtttgtcagtcagaaaaagacgggcatttcccgtcagttggcatggatgattgtcaaagaatatgcaagtcaggcaggcatcgggcacatcagcccgcacagcctgcgccacgcctttgccacgcatctggtgcggcacggcttggatttgcgcgtggttcaggatatgttgggacatgccgatttgaatacgacgcagatttatacccatgttgccaacgtatggttgcagggtgtagtgaaggaacaccattcccgaaactgaggcttctactttggtttaataagaaatcaatcgaaaatgcaaacttgataaaaaattaccaagacaaaccgtgtataccgaccttgcaatgcgaaccgtttttatttatattcgcatacgataataaaagccgctatcggtacgatagtttgagaacacacggagcacaaaatgtttgtctgcatctgcaatgccgttaccgaccatcaaatcaaggaaaccatcgccgccggcgcgaccacaatgggcgatttgcagtcgcaattgggcgtagcgagctgctgcggctgctgcggggagcttgccgcttcgtttctgacggcgcacaatgcgcaaccgacggttacggcgggtatcaacgttcaagcgtaaaacggttttcgaaatgccgtctgaactgttcagacggcatttttactgtttttggcaggacttgagtatcatcttcctcgaaaacattgttttttcccaaatagaccatgattctgctgcgtctaaggctttggcgtgtgcaaattgacagataaggaaacgcggatgaaattgaccttgatgtttcgtgaatattgcagcttgtgccacaaaatgcgcgacgaactcaaaccttttcaggatgaatacgggttcgggctggaagtggtcgatgtggatgaaaatcctgttttggaagaaaaatacaatgagctggttcccgttttgttggcgggagatgaggaaatctgtcactggtttttggatgaggacaggttgaaacagtttctcgaacggtaaaaaaatgccgtctgaagcaggacttcaggcggcatttttttcaaatcaacgttctttacgtttttgcggggcggatgacctgccggtaaaggaagcacgtttggatgcttggtaaattgctagtcttcttcgatgttgcatattaaccctttctttattttatttgtcggttgggaggattcttatttattgattttttcaataaaaattagaaaatttattgtgagatgttattgttggcaatcatatcatgttttactgttgatggaagcatgattgtgtaaagatgatatgtgtttgtgtaatcggtagattttatagtggattaacaaaaatcaggacaaggcgacgaagccgcagacagtacaaatagtacggcaaggcgaggcaacgccgtactggtttttgttaatccactatataagaaaaccgccaaggcggtgcttgacggcggaaacagaggggcgggcggcatcagagcagcttggaaacgacctgtgcaaggctttttgccagtctgacggtttgatgccgaagtcgttttcgattttgcggcagtccaaaatgctgtatgcgggcctgggggcggcggtcggatattccttgtctgaaacggcagtcaattcgggaacggggaaggatgtctgctgttgcgatgccgcttggaaaatatgttgggcaaattcgtaccaggatacggatttgctgccggcgtagtggtaaatgccgcgaacgggattggagtgctgcaacaggcggatgatggtggcggacaagtcgccggcataggtcgggcagccgatttggttgtggacggcggacagcggggaacgttcccgcgcaaggttcagcatcgtgcggataaagttgtccccgtattcgctaaacagccaagaagtccgcaggataaggctgtcgggattggcagacagtgcgagcagctcgcctgcggttttggattgtccgtatacattggaaggattggtaaagtcgctttcctgatagggtcttttccctttaccgtcaaagacatagtcggttgagatgtggatgaatcgggcatgggcgcgatgtgctgccaaggcaaggttgtaaacggcggaagcattgacggcaaatgccgctgccgcatcgccttccgccttgtcgacggcagtataggcagccgtgttgacaatggcgtcgggttggaaacttttgaccatgttgcagacggcatcggcatcggtaatgtctagggatgcggaatccgtcgcaatggtttcccagtcttccggaagacggtcgcgcaggcagcgtgccagttggcttttcgagcctgtcaataggattctcatgaggtatttcctttggtaaaagtgtattgtaggacttgctgtcggtattatagtgccaaaattttgccgacggttgacgggttggctttttgtgccatgggtattgttttgcgccgacttcggctagaatatcggtttgtgattcaaacctgtcgggtgtcgggtcggtattttcaagatattttcaggggggggcgaaatgagtgagattggtttggtaaagatctattttggaaaagtgcgcgatttatatgaaatcgacgataaacgtatgctgatggtcgcttccgaccgcctgtccgcgtttgatgtgattttggacgacccgattccgagcaaaggggagattctgacgcagatttccaatttttggtttaaaaaactggcgcatattatgcccaaccactttaccggtcaaacggtttacgatgttttgcctgaaaacgaagccaaagctttagagaaacgcgccgtcgtggctaaaaagctcactccggtgaaagtagaggcgattgtgcgtggttatctggcaggcagcggttggaaagattatcaaaaaaccggctcggtttgcggtattcaactgcctgaaggtatgcaggaagcgcaacaactgcctgaagtgatttttacgccctcaaccaaagccgcagtcggcgatcacgatgaaaacatcagctttgaagaatgcggacgcattatcggcaaagaattggcggaagaagtgcgcgccaaggcggttcggctttacaccgaagcggcggaatatgccaaatcgcgcggtattattatttgcgataccaaatttgaattcggtttggatgaaaacggtacgctgacgctgatggatgaggtattgactcccgattcgagccgtttttggcctgccgaccaatacaaagtcggcaccaatccgccgtcttttgacaaacaattcgtccgcgactggctggaacaaagcggttggaacaaaaaagcccctgcgccgaaagtgcctgccgatgtgattcagaaaactgtcgagaagtatcgggaagcattgactttgctgactcaggattgatttttaagtttgaaggccgtctgaaagaaatatggttcagacggcctttttattgtatcaatactggattttaaggatggttgcctttataatccgcaattgctttcagcgtccgaaatgccgtctgaaagcttgtttataacctgccgcacggtctgaaaccctaactatgcacattcggattttagtgtgcattattagtgttttagcagtgcggtattttgaaaggaacaatgatgttcgacaaacacgttaagaccttccaatacggtaatcagaccgttactttggaaaccggcgaaattgcccgccaagccgccgctgccgttaaagtctctatgggcgacaccgttgttttggttgccgttaccaccaacaaagaagtgaaagaaggtcaagacttcttccccctgaccgtcgattatttggaacgcacttacgccgcaggcaaaattcccggcggtttcttcaaacgcgaaggcaaacaaagcgaaaaagaaatcctgaccagccgtctgatcgaccgtccgattcgtccgctgttccctgaaggtttctaccacgacatccaaatcgtagcgatggtcgtgtccgtcgatcctgaaatcgattctgatattcctgcaatgttgggtgcatctgccgcgctggtgttgagcggcgtaccgtttgccggcccgatcggcgcggcacgcgtcggttatgtaaacggcgtgtacgttttgaatccgactaaagccgaattggcgaaatcgcaattggacttggtggtcgccggtacttcaaaagccgtgttgatggtggaatccgaagccaaaatcctgcccgaagacgtgatgctgggcgcggtggtttacggccacgatcaaatgcaggttgccatcaatgcaatcaatgaatttgccgacgaagtcaatccggaactttgggattggaaagcacctgaaaccaatgaggaactggttgccaaagtccgcgggattgccggcgaaaccattaaagaagcgttcaaaatccgtcaaaaacaagcgcgttctgccaaattggacgaagcttggagtgcggtaaaagaagccttgattaccgaagaaaccgacactttggcagccaacgaaatcaaaggcattttcaaacacttggaagccgatgtcgtccgcagccaaattttggatggccaaccgcgcatcgacggccgcgacacccgcaccgtccgtccgctgaacatccaaaccagcgtattgccgcgcacgcacggttctgcattgtttacccgtggcgaaacccaagctttggccgttgcaactttgggtacttcgcgcgacgagcaaatcatcgacgcgctgtccggcgaatacaccgaccgctttatgctgcactacaactttccgccgtactctaccggcgaagtgggccgcatgggcgcaccgaaacgccgtgaaatcggtcacggccgtttggctaaacgtgcattgttggccgtattgccgaaacctgaagatttcagctacaccatgcgcgtggtctccgaaattaccgaatccaacggctcttcctctatggcttccgtctgcggcggctgcctgagcctgctgtctgccggcgtgcctttgaaagcacacgttgccggtatcgcgatgggtctgattctggaaggcaacaaatttgccgtcctgaccgacattttgggcgacgaagaccacttgggcgatatggactttaaagtggccggtacgaccgaaggcgttaccgcgctgcaaatggacatcaaaatccaaggcattaccaaagaaattatgcaaatcgctttggcacaggccaaagaagcgcgtctgcacatcttggatcagatgaaagccgccgttgcgggcccgcaagagctgtccgcacacgcgccacgcttgttcacgatgaaaatcaaccaagacaaaatccgcgaagttatcggtaagggcggtgaaaccatccgttcgattaccgctgaaaccggtacggaaatcaatattgccgaagacggtacgattaccattgccgcaaccactcaagaagccggcgatgcggcgaaaaaacgcatcgagcagattactgccgaagtggaagtgggcaaagtgtacgaaggcactgtggtgaaaatcctcgataacaatgtcggcgcgattgtcagcgtgatgccgggcaaagacggtttggtacacatcagccaaatcgcccacgagcgcgtacgcaatgtcggcgactacctgcaagtcggtcaggtggtgaacgtgaaagcattggaagtggacgacagaggccgtgtccgtctgtccatcaaagccctgctggacgcgcctgcccgtgaggaaaatgccgccgagtaacgcttagggtgaaagtgccgtctgaacaggtttcagacggtattttttacgggtatcgggaatgaatggggcttacagccacaggacggcaagtttccataatgcccataatgatacggataatcccgtacacaggcggatatatcggttttgcatgatttttttcagttgcagggaaaaaatgccgattgctaaaagattgggcagcgtacccagtgcaaaggcaagcatatataacccgcccgttgccgcactaccgcttcccagcgcgtaaagcgacgcgctgtaaaccagtccgcacggcagccagccccataatattccgaccgcaaggcaggcgggtatggattttatgggtaacagccggttgagtatcgggttcaggttccgccatatcggtttgccgattttctcgatttttgccgccaaggaagaaataccgctcaagtataagcctaaaaagagcagcaggaggttggcggccgtgtataaaatattctgcaggacgcgggtttggtcgagtgaaacgccgacctgtccgattaatccgagtatcaggccgattgccgtatagctgcttacccgtcctgtgttaagcagcaggatcagccaaaagcggttgatatgcggggggagttggagcgcaaacgcgctgcttaatccgccgcacataccgatgcagtgcgttccgccgaagaaaccgagtaggaacagggtgaggaaagtgatgtcgtggttcataggcagtttgaagtcaaatatttttcgggaaaagggatgatttgcggcagtccggcacataggatccgccgagggcattgcccgtgctgttaaagtcttgaataaggatgcagtttgcaccctgtatttcgataattttgtaaaatccgccctttactgcgccgtcggcgggtttgccgtgtgcgtcaaaatacaggatggtgcggttttgaagatgcgcgcaatttgaaacggccgggtttgccggtatgtttcgggtgcaggcggcaaggattgcacaagggaaaagcaacagtaatatgcggaacatggtgtttcttgtaaggggtaacaaacagtataatggctgattttaatcctcaggcggcgggagatggaagcatttcccttcggtgcgggggatttcggattcggaagcaacagacgatacgggatttcggaacaatatgaacactttgaaatttaccaaaatgcacggtttgggcaacgattttatggtgattgacgcggtcagtcaggattttacccccgaggacgcgccgattgcggaatgggcggaccgcttccggggcgtgggcttcgaccagcttttggtggtcgggcgttcggaaaccgaaggcgtggatttccgttaccgtattttcaatgccgacggcagcgaggtcgggcaatgcggcaacggagcgcgttgttttgcccgttttgttgcagacaagggtttgaccgataagaaagaaatttgtgttgaaacggcaaatggcgttatttttccgaaattgtccgataacggtatggttacggtcaatatgggcaaaccgaagtttatgccgtctgaaataccgtttgtccccgaatcgggcgagggggatgatgcctgtatttacggggtgcatctcgaatccggcattcagcctgtcagctgcgtcaatatgggcaacccccatgcggtgattgtggtcgatgacgtggaatgcgcgccggtgcgcgaaaccggttcgcttatcgaaccgcacaggcagtttcccgaacgcgtcaatgtcggctttatgcaggttgtcggccgaaccgcgattcgtttgcgcgtgttcgagcgcggcgtgggcgaaacccaagcttgcggtacgggcgcgtgtgcggctgtggtggcgggtatccgtctggggctgttggatgaagggaaaacggtagaggtggttttgccgggcgggactttatatatcgaatgggcctgcggcggcgatgtgatgatgaccggccctgcggaagcggtgtttgaaggtgagttggcgtattcatgattttgctgcatttggattttttgtctgccttactgtatgcggcggtttttctgtttctgatattccgcgcaggaatgttgcaatggttttgggcgagtattatgctgtggctgggcatatcggttttgggggcaaagctgatgcccggcatatggggaatgacccgcgccgcgcccttgttcatcccccatttttacctgactttgggcagcatattttttttcatcgggcattggaaccggaaaacagatggaaacggatggcaggcagaccccgaacatccgctgctcgggctttttgccgtcagtaatgtatcgatgacgcttgcttttgtcggaatatgtgcgttggtgcattattgcttttcgggaacggttcaagtgtttgtgtttgcggcactgctcaaactttatgcgctgaagccggtttattggttcgtgttgcagtttgtgctgatggcggttgcctatgtccaccgctgcggtatagaccggcagccgccgtcaacgttcggcggctcgcagctgcgactcggcgggttgacggcagcgttgatgcaggtctcggtactggtgctgctgctttcagaaattggaagataatacggtgcggccgtatcggaacaaaaagttataaagaaagaaattttggatattggttttttaggcggcataggtttaggataaagccatatccgaaatttgtttatgtttcggcgcaaatcccctgcaatcggacaggatgcctatggggattgcgccttactgtcgaaaccttattattcaggagcagaagatgaaaattgcaaacagcattaccgaactaatcggcaacacgcctttggtcaaactgaaccgtctgaccgaaggtttgaaggcagaggttgccgtgaaactggaatttttcaatccgggcagcagcgtcaaagaccgcattgccgaagcaatgattgagggtgccgaaaaagcgggcaaaatcaacaaaaacaccgtcattgtcgaagcaaccagcggcaatacgggtgtcggtttggcaatggtatgtgccgcacgcggctacaagctggcgattaccatgccggaaagcatgagtaaggagcgcaaaatgctgttgcgcgcgtttggtgcggagctgattctgacccctgccgccgaaggtatggcgggcgcgattgccaaagcgaaatccttggtggacgcgcatcccgacacttattttatgccgcgccagttcgacaatgaggcaaaccccgaagtccaccgcaaaacaaccgccgaggaaatttggcgggatacggacggcaaagtcgatgtcttcgttgccggcgtcggcacgggcggtacgattaccggcgtgggcgaagtgttgaaaaaatacaaacccgaagttaaagtggttgccgtcgagcctgaagcttcacccgtattgagcggcggcgaaaaaggcccgcacccgattcaaggcatcggcgcaggctttattccgaccgttttgaataccaaaatttacgacagcattaccaaagtgtcgaacgaagcggcttttgaaaccgcccgcgcaatagcggaaaaagaaggcattttggtgggtatttcttccggtgcggcggtttggagtgcgttgcagcttgccaaacagcctgaaaacgaaggcaagctgatagtcgtgctgctgccttcttatggcgaacgctatctctctacgccactttttgcagatttggcataatgctttaatcggattgtcgaaacattcagacgcatttttcggtatcggtgtaacgccgtgccggaaaatgcgtttttgcatatatgccgaaaacgccggttgtgttttaatcaggtgttggtgtcgccgcatcgcttgagggaaatattttttatagtggattaacaaaaatcaggacaaggcgacgaagccgcagacagtacaaatagtacggaaccgattcacttggtgcttcagcaccttagagaatcgttctctttgagctaaggcgaggcaacgccgtactggtttttgttaatccactatattcgggttttatttggcaggacggttttttgccccaacggaaaatagcctgcctgcccgtaaaatcagccgtttgtccgggtgcagccggggctttgggcttcagacggcatattttcggaatggcggcattcttgccgtcggcgcggcagccgtatggggaagggaggggatattgtggtcggtaacggcaaaaaatatgccgcaccattgctggtgctgggttgcgtggtgttcggtctgggcagtctgattgtcagatccgtccccgtcggttcgtatgcaatcgcattttggcggttgctgatttcggtgttcgtattttggtttttagcacggtttttcaggcaaaaattcccaaaaaacaggaaaaccgtccgatatgccctgacggcgggcgtgtttctcgctttcgatttggcgttgtggcacgaaagcatacacgcggtcgggccgggtatttccaccctgctcaacagcctgcaaatctttttcttgtcggcaatcggtgttttctttttcggcgagcgtttgagcgggctgaaaaaggcaggcttaatatcggcagttgccggcgtggcgatgattgccggtgcggaattcggctacaacggtaatgcggtttggggattcgccagcggtttggtatcgggactgatgctcgccctgtcgatggtgtttgtccgcaaaacccatgaaatcgagccggtggcgcttttcccttcaatgatgattttgagtttgggcggcgcggtatcgctggttgttccggcattgctgatggatggcggcgcgctttatccgacgacttggaaagatgcgggtttggtgcttgtgtacggcgtggtgatgcagtgcttcgcgtgggcgatggttgcctatgcgattccgctgctttcgctgtcgctgacggggctgctgcttttgtccgaaccggttgccgccctgttcatcgattatttcgggttgggcaaaccgattgaaggcgtgcagtgggcaggggtggcgctgacgctttcggcaatttacctcggttcgctgaaacggcagtcttcacattgatttcatcagggcaatattggcagttcgccgtgcaaaacctgcgtatattggactgataggtaggaaaatccgacaacgttagactcgcctgtaaaagtgaggaatagcaaatgccgtctgaaactattttcagacggcattcttggcttcctggcctaacggattgccgtaccggacctgccgaaatcgccgaagttcatcaaaatgaacattgccttgccgacaaccagcttgtcatccacaaatccccagtagcgcgaatcggcactgttgtcgcggttgtcgcccatagcgaaatagcgtccttcgggaactttgcacacgaaaccgctgccgtcgtcggcatattggcagtgttccaaaccgctttgctctatggaatatccgttttcagacataatatcggaggtatatttgcccaatacgggcagggaaacggcaggctgtccttcttttttcagaatattgaaggatttgccgtctagaccgctgcggaacatatccgtgttgtggatttcggaagggtcggtgtcgtcgggataacggtatgtgccgtcaggaatgtcggaagtgggtttgccatttaccgtcaaaatcttatcccgatattcgaccacatcgcccggaatgccgacaatacgcttgatgtaggtcatctccggctgcagaggataattaaaaacaacgacatcgccccgttcgattttgcctgtaggaataaatatattgtttaaaacgggtacgcgcaggccgtaggaaaatttgccgaccaaaatgaaatcgcccttgatcaggcccgggcgcatcgagctggacgggatttggaacggttcggcgataaacgaccggatgaggaacaataccaaaacggtagggaagaaactgccgaaataatcgccgaagtggctgctttccgagatttcgggatgagtcttcaggcggtatttatataccccccaagccgtaccgcacaatacaacgaaaatcaggaaaacggcggtaaagctcataaacagggacaaagcggcaaacacgccgaccgctgtcaggatataggcgtattcaaggccggaactccattccccgttttcctgccgcttcttgtcgcttttgaaataaaggatgatgccggcaagcagcgcggcagccgcgcccgacattagcattgtgttcattgttgttccttaatgcttaaaaacccgcctgtccgtgcaaccgttttaaggcggcaaattgcaaaatttgtttgcgggcgcgtgcccctgaaatcagggcggtttgaggggtgttcccgacgcgccgccctgtgtgccggagttatttgtcgctcacctgcaaaatcgccaagaacgcgctttgcggaatttccacattgcccacttgtttcatacggcgtttacctgccttttgtttttcaagcagttttttcttacgcgtaatatcgccgccgtaacatttcgccaagacgtttttacgcagtgctttgacgttttcgcgggcgataatctggctgccgatggcggcttggacggcaatgtcgaacatttggcgcggaatcagctcgcgcattttcgatgctagctcgcggcctcggtgaaccgcgctttgacggtgcacaatcaggcttaaggcatcgactttttcgccgttgaccataatatccagcttaatcaaatcagacggttggaactctttgaaatgataatccaacgaagcatagccgcgcgaagtggatttgagtttgtcgaaaaagtccatcaccacttcgttcatgggcaaatcgtaagtcagcatcacttggcggcccatgtactgcatattgacctgcacgccgcgcttttggttacacaaagtcatgacgttgccgacgtattcctgcggcacaaggatggtcgcggtaataatcggctcgagtatggtttcgatgctgccgatgtcgggcagtttggacggattttcgacttcgattttttcgccgcttttcaacacgacttcataaatcaccgtcggcgcggtggtaatcaaatccatatcgaactcgcgctccaagcgttcctgcacgatttccaagtgcaacagacccaagaagccgcaacggaagccgaaacccaatgcttgggaaacctcaggctcaaatttcaacgaagcatcgttaagctgcaatttttccaaagcatcgcgcaaagcttcgtagtcgtggctttctacgggataaagtccggcgaatacctggctttgcacctcttggaaaccgggcagcggctcagtggcagggttggcaaccaaagtaaccgtatcgccgactttcgcctgtcccaattcttttacgccggtaatcaaaaagcccacttcgccggcttttagttcttgtttttgaactgatttcggtgtgaatacgcccagctgctcgacctgcgtttccgccttggtgctcataaagcgcactttgtctttcagtttgatggtgccgtttttcactcgaatcagcataaccacgccgacatagttgtcaaaccacgaatcgacgataaccgcttgcagcggcgcgttttcgtcgccggtcggtgcggggattttggcaacgatttcttccaaaacgtcttccacgccgatgccgcttttggcggaacattgcaccgcgccgacggcatcgatgccgatgatgtcttcgatttcctgttccacgcgttcggggtcggcggcgggcaggtcgattttgttcaaaaccggcacgacttccacgcccaaatcaatcgcggtgtagcagttcgccacggtttgcgcttccacgccttgcgacgcgtcaacgaccaaaagcgcgccttcgcaagccgacagcgaacgggaaacttcgtaagagaagtcgacgtgtcccggcgtgtcaatcaggttgagttgatacacctgcccgtcgcgtgctttatagttgagcgcggcggtttgcgctttgatggtaatgccgcgctctttttcgatgtccatggaatcgagcacctgcgtactcatttcgcgcaaatccaaaccgccgcagtattggatgaagcggtcggcaagcgtcgatttgccgtggtcgatgtgggcaatgatggagaaatttcggatatttttcattagagttgttttgaatgtcggacagtgggtttgggaaatgccgtctgaacaaacggcgttgcgtccgaatatcgggtgcaacgtggaaatagcccgttattctaacggaaaaccgctgttttggcataagtttgataaaggtcttataaagatttgacgatttctgccaccatttttgcggaatttgccgccgccgttttcaagaactcgtcaaagctgatgtctgctttttcatctgccgaatcggaaaccgcgcggatgatgacgaaaggcgtttccaactgatgacaggtttgggcgattgccgccgcttccatttccactgctttgacttcggggaagtgcttgcggatttccgccacgccttcgctgctgtggacaaagcggtcgccgctgacaatcagcccttgttctaccgccgcgccttcaaacgtccgcgccgcccgttttgccgcctcaatcaaaatgccgtctgaagcaaaccttgccggcagttgcggcacttgtccccaggcatagccgaatgcggttacgtcgacatcgtggtgtgcggtttccgtgccgatgactacgtcgccgactttcaaacccttgcccaaaccgcccgcgctgccggtgttgatgacgcagtccgctgcgaattcacggataatccaagccgttgcaaccgccgcgttgaccttgccgatgccgctcaatgcaagcaccatgcgttttcccgccaattcgccttcataggcggaaaatctgccgaaagagacggctttgacattttccatcatctcgcgcaaaagctcgatttcttgttccattgcgccgataacggctactgttttcaaagacatattgctgacctgttgtgaatttcggatagaatgcctgattatacacgctaacacggcaggattgagtggaggtggtttgtccgtgccgtctgaaacggtttcagacggcacggcgggtttttggtagaatgggaaggtacagattgtttgaagattaggggacgaggatgtttaccgatgaaaatatgaccgcaaaggaagaactgttcgcatggctgcgccatatgaaccaaaacaaaggttccgacctgttcgtgacaacccatttcccgcccgcaatgaagctggacggcaaaatcacccgcatcacggacgaaccgctgacggcggaaaaatgtatggaaatcgccttttcgattatgagtgcgaagcaggcggaagaattttcatcgaccaacgagtgcaacttcgccatcagcctgccggacaccagccgcttccgcgtcaatgcgatgatacagcgcggcgcgacggcgttggtattccgtacgattaccagcaagattcccaagtttgaaagcctgaacctgccgccagtcttgaaggatgtcgcgctgaaaaaacgcgggctggttatttttgtcggcggcaccggctcgggtaaatcgacttcgcttgcctcgcttatcgactaccgcaatgaaaattcgttcggacacatcatcaccatcgaagacccgatcgagtttgtccacgaacacaaaaactgcatcatcacccagcgcgaggtcggcgtggatacggaaaactggatggcggcgttgaaaaacacgctgcgtcaggcgcctgatgtcatccttatcggcgaaatccgtgaccgcgaaacaatggactacgccattgcctttgccgaaacggggcatttgtgtatggcgacgctgcacgccaacagcaccaatcaggcactcgaccgcatcatcaactttttccccgaggagcggcgcgaacaattgctgacggatttgtcgctcaaccttcaggcgtttatttcgcaacgcctcgttccgcgagacggcggcaagggcagggtggcggcagtcgaggtgctgctcaattcgcccctgatttcggagttgattcacaacggcaacatccatgaaatcaaagaagtgatgaaaaaatccactaccctgggtatgcagaccttcgatcaacacctttaccaattgtatgaaaaaggcgatatttccctgcaagaagcattgaaaaatgccgattccgcacacgatttgcgtttggcggtacagttgcgcagccgccgcgcgcaaagttccagccccgatttggaactgctctgatggcggtatggatttccggacggatggtttgaaatgatttatccgtggcataatgagcaatggcggcagattgcggaacattgggagcgtcgtcccaatgcatggctgtttgccggcaaaaaagatacggggaaaactacatttgcccgctttgcggcgaaggcactgttgtgcgaaacccctgcaccgggctgcaaaccctgtggcgaatgtatgtcctgccatctgtttggacagggaagccatcccgatttttacgaaatcacccccttgtcggacgaacccgaaaacggacgcaaactgttgcagatcaaaatcgatgccgtcagggaaatcatcgataatgtgtacctgacttcggtacggggcggtttgcgcgtgattctgattcatcctgcggaaagtatgaatgtccaagccgccaacagtttgttgaaagtgttggaagaaccgccgccacaagtggtctttttgctggtcagccacgcggcggacaaggttttaccgaccattaaaagtcgctgccggaagatggttttgcccgctccttcccatgaagaggcattggcatatctgcgtgaaaggggtgtggcggaacctgaggaacgtctggctttccattccggagcgccgctgtttgatgaggcggacggtgtccgtgcgttgcggattaaactgttggatattttggcagaaccaaggttgttgaagattttggattacgccgcgcttttcgataaggaaaaacttccgctcgccgtatttgtcgggtggatgcagaaatggctggtcgatttgggattgtgcctgcaacacatgaaacccgtctattatcccgcttatgaagacaggctgcttcagacggtatccggtttccgtccgcgcaatgtatttgcggcggaggatatgctcaaacagcttgccccctacgggtttcatactttaaatgtcaaaatgcagatcgagcatctgctcatcaactatttggaattgaagaaagagaacgggtgaattatgtcagacggacaaaatattccggcaaaaatgatgtcgttgcagctgaaagacatgaatctgctgtacagctcctacatgccgtttttggaacacggcggtctgtttgtgcagaccaacgacgtattttccatcggggacgatattctgcttgccgtagaaatcctcaacttccccaaactgttcctgccgaccaaagtcgcctggatcaatcctgcgcgtacttcctccaaacccaaaggggtggggctggcattcacaaaacacgaaaactgcctgaaagtcaaagaccagatcgaagtcgaactgggcaacacaatcggcggcagcagacctacgtttaccatgtaacgccatgcatatcatcgattcgcactgccacctcaattttgaaggtttgaaagaacgcctgcccgaagttttgtccaacatggaagcaaacggcgtggggcaggcactcgccatcagcgtcagtagggaaagcttctccgaagtctttgccatcgccgaagcgcacgaacacatctattgcaccataggcgtacatcccgacagcaaggaagccgaagaattttccattgcggaaatggtcgaagccgccgcccatccgaaagtggtcggcatcggcgagacgggtttggattattactggtgcaaaggcgatttgtcctggcaacacaaacgctttgcagaccacatcgaagcagccaatcaaaccggactgcccgttatcgtccatacgcgtgatgcggcggcggacaccttgtctatcctgaaagaatgccgggttaattcgggcgttatccactgtttttccgaagacatcggttttgcccgtgcagcaatggatttggggctttatatttctttctcgggaatcgttacctttaaaaacgcacccttggttcaggaggcggcgaaatatgtgccggacgaccgcattttggtggaaaccgatgcgccgttcctcgcccccgttcccaaacgcggcaggcagaacgaaccggcttttgtgcgccataccgccgaacatatcgccaaattgcggaaccaaacattggaacaggttgcggcatatacgacggaaaacttttaccggctgtttaaaaaagtacccgatatgcggaccgtctgaccctgtaccgacgataaggaaaaccatgaaggcaattcatccgtatgcatgtccgcgctgctgccggctgcctgccaacacgtttcggacaggcatggcaaattccgcttccaaattctgcattgccaaaggcggcagacgggaagcaaaaaaagacgaaagcggcggcggatatgccctgtgccatttgccggacagcaggattgtcgaggagtgggaatatttccgttcacaatattgatactgcgcgatatacggcaaatattgtgggaagtttccgcttttgcgtataatgcgccctacctgacaaattttgtcaactttatcaaaaggaataagcgatggcttccatccacgaccaaattaaagaagtagtaacgacacaccgcgtcgtattgtttatgaaaggtacgaagcagtttccgcaatgcggtttctcttcccgcgccgtgcaaatcctgaacgcggcaggctgcaccgattacgttaccgtcaacgtattggaaaatcccgaagtgcgccaaggcattaaggaatacagcgactggccgaccatcccccaactttatgtgaacggcgagtttgtcggcggttcggacatcctgatggaaatgtatgaggcaggcgagctgcaagagctgctgaaagcctgatggattcggcaatgccgtctgaacgtgtttcagacggcattttcttttccggcaaatcaaaaaaaagtataatggcgcgtctcaaaatcacattggaacaccgcgatgaacgttaatgttatcaaccatccgctcgtccgccacaaattaaccctgatgagggaggcggattgcagcacctacaaattccggacgcttgccaccgagctggcgcgcctgatggcatacgaggcaagccgtgattttgaaatcgaaaaataccttatcgacggatggtgcggtcagattgaaggcgaccgcatcaagggcaaaacattgaccgtcgttcccatactgcgtgcaggtttgggtatgcttgacggtgtgctcgacctgattccgactgccaaaatcagtgtagtcggactgcagcgcgacgaagaaacgctgaagcctatttcctattttgagaaatttgtggacagtatggacgaacgtccggctttgattatcgatcctatgctggcgacaggcggttcgatggttgccaccatcgaccttttgaaagccaagggctgcaaaaatatcaaggcactggtgctggttgccgcgcccgagggtgtgaaggcggtcaacgacgcgcaccctgacgttacgatttacaccgccgcgctcgacagccacttgaacgagaacggctacatcatccccggcttgggcgatgcgggcgacaagattttcggcacgcgctaactgactgattttcggagttgatatgaattttcaagactatctcgccacatttccttcaatcgaccatctgggcggtttggacgttcaggatgccgacggcaaaacggttcaccacattcctgccgttcagggtaagctcggttcgctcaagctgtacaatgctttggcggaacgttttgacggaaaattgggtaaagaagcggcagaacagggtttgatatggtttgccgaacacgttgccgacgcgcgtgcccatccgggcaagcatccgaacatcgatctgctggaaaatgtcgtgcaaagcggtgaaacctggttgctcaagccgctttccgcgcaataattttcgaccatgccgtctgaaatccgtttcagacggcattttgtcggaaagaagaccgtaaaacgggcattttcttttctatttcaggatacgggcaatgatgtttcaacacacaggacgacacataaagcgccgccctatgtgttgccctaatttggaaggggttacacccttttcaaataaaatctgatgctgctgccacgaaggacggatgtccgagtggcggggtttcaaccattaaggaaatacgatgaaaaaaatgttcctttctgccgtattgcttctgtcggctgccgcccaaaccgtgtgggcggatacggtgttttcctgtaaaacggacaacaacaaatacatagaagtccaaaaaatcaaccgcaatctttacgaatattcgttcggcagtgcggcaaaaaaagaaattgccatacgcaacagcaaagctgacctgttggggcgttccgacaggtggcaaggtatgggcagcggtcgttgggcaacgatgaaattccaaaacggcgaatttatgtacaccatatggacaggcttcgattccgtgactcatacggaaagcagcggtgtcgttgtggagcgtaggggcaaggaagtcgcacgggtcggctgtacgccgaaaaccgcgcaggcgaatttcaacgatgacgatttttcctagtaatcggggcggataaggcgatggaaacagcgaaacccgtcatgctgattgtccgtccgtcgggcagggccgcagaagatgtcgaaacttgcctgaatgccggttggcgcgcggaagtattgagtccggtcgaaatcgaagcagatgctgccggactggaacttttgtccgaacaatatgcccgtgcggatgccgtgttttgggtcagtccgaccgccgttgaaaccgccgtcccgtaccttaacctttcagacggcataaaggcgcagattgccgtagggcagggcagccgccgcgcattggaacgctgtttggtcagaacggtcatcgcgcctgatgacggcaacgacagcgaggcggttttgcgcctgccggtttggaacagtctgcccgaaggtgcgcgcgtattgtttgtgcgcggacacggcgggcgggattttttgatgaatgccttgcaggagaaaggttttcggacggaggtggcagaagtctatttcagacggcataaacctttgaactttcaaaatttccaaaccgaaaatattgccgccgcctatattacgtcgaccgagctggtgcgcttgctgttcgggcagcttccgccgcaattttcccgattcttcaaatccttgctatactttacccatcatccgcgcattgcggaggcattgaagcgcgaaggcgtgtgttcggtcgaaaccgtccctacgctggaagccgcgctttcccattcttccatttccgtttcagacggcatggtctttcccggaacctcaaattaataaggagcaaaacggtgggcgaacctgaaaacaaatcatccgaacccgtacgcgagatacaggcatcaaaagaaatgccgtctgaaacctcttccccacgcaaagaaaacgaaacagaagtacacattcctgccgctccttttatcgtcaaacagtccggcagcaacgctttggcagtctgcgccctggtattggcggcattgggtttgggtacaagtggttttttgtttgtccaaggacagaatgtcttgaaaaaccaagagctggcattcaaccaaaaaatcgacaaagccgccttgggcgagtcggaaaacgccgccctgttgaaagacaacctcaaccggcaagccgccatacaatcagagctcgaccgtttggacggaaacgtcaaagcaaacggcgaacaaatcttggaaatgcaaaaatcctatcgcgagttgaccaaaggacgcgccgattggctggtggacgaaaccgagaccatactcaatctggcggcgcaacagctggtgttgactggcaatatccaaacggcagtcggcgtattggagcatatcgacagccgcctgtcccgtttcaatcaggcagagcttctgccgatcaagcaggcggtcagcagcgacttggcggaactgaaaaaccgtccctatgtcgatatttccggcacggcattgcgcctcgacaggctggaaaccgccgtatccggactgccgctgatgctcgacggcgtgctgaaaccgggcgtacaggtgaagaacgaagccgcttccgcttcatggtggcagaacgtatgggaaaaatccctcggcacattgaaggggctggtcgaaatccgacgtttggaaaacaacgatgccatgctgatttctcccgaacaggcatattttgtgcgtgaaaacctgcgcctccgccttttggatgcgcgcactgcattaatgcagcgcaacagcgaagtctatcagggcgatttgaacaatgccgaagccgccgtcagacagtatttcgatgccaagtctcccgccacgcagtcgtggctgaaagaactggcggaattgaaggcgttggatgtgcggatgactgcggatgacggtttgaaaaacagcctaaatgccgtccgcgcctatcgcgacggtacgcgcatgacggcggcggaaaatcaagaagcggaacaggcggcttccgaaccggcaaacgaaaaaacagcttccgaaccggctgccgcatcggatgtgaagaccatagaagcaccgtccctgccttcggaacgcaaaccggaacagcctgcaaaaaaacagaccgtaccggaaaaggcagggcgttcgccgtccgctaaaggagaacgcgcatgaaaacggtagtctggattgtcgtcctgtttgccgccgccgtcggactggcgctggcttcgggcatttacaccggcgacgtgtatatcgtactcggacagaccatgctcagaatcaacctgcacgcctttgtgttaggttcgctgattgccgtcgtggtgtggtatttcttgtttaaattcattatcggcgtactcaatatccccgaaaagatgcagcgtttcggttcggcgcgtaaaggccgcaaggccgcgcttgccttgaacaaggcgggtttggcgtattttgaagggcgttttgaaaaggcggaactagaagcctcacgcgtgttggtcaacaaagaggccggagacaaccggactttggcattgatgctgggcgcgcacgccgccggacagatggaaaacatcgagctgcgcgaccgttatcttgcggaaatcgccaaactgccggaaaaacagcagctttcccgttatcttttgttggcggaatcggcgttgaaccggcgcgattacgaagcggcggaagccaatcttcatgcggcggcgaagatgaatgccaaccttacgcgcctcgtgcgtctgcaacttcgttacgctttcgacaggggcgacgcgttgcaggttctggcaaaaaccgaaaaactttccaaggcgggcgcgttgggcaaatcggaaatggaacggtatcaaaattgggcataccgccgccagctggcggatgctgccgatgccgccgctttgaaaacctgcctgaagcggattcccgacagcctcaaaaacggggaattgagcgtatcggttgcggaaaagtacgaacgtttgggactgtatgccgatgcggtcaaatgggtcaaacagcattatccgcacaaccgccgccccgagcttttggaagcctttgtcgaaagcgtgcgctttttgggcgagcgcgaacagcagaaagccatcgattttgccgatgcttggctgaaagaacagcccgataacgcgcttctgctgatgtatctcggtcggctcgcctacggccgcaaactttggggcaaggcaaaaggctaccttgaagcgagcattgcattaaagccgagtatttccgcgcgtttggttctagcaaaggttttcgacgaaatcggagaaccgcagaaggcggaggcgcagcgcaacttggttttggaagccgtctccgatgacgaacgtcacgcagcgttagagcagcatagctgattttgggaaatatctttatctgggagaatttgatggggtcttcagattcctttaaggaaaagaaagaaatatttgaaattggaacgcctgcttatcgccaaaagttaattgatgtttggaaaaagagcattaatggaaacgaaaaatcttgggtgctctttgaaaatgggacttgcgtcattttacttgaaccggaaaaagatttggcgaaacaagctaaagagatgttaagcaaatggggcaaggttcaaataggaacaccatctgcagattttggcattatcactttagatagtggcgatggatatgccgtttcatgccatcatcccgaaatttttacgctaatcctaaaagaagaaggattggatgaagatttcaaaatcggtatcgaagggcgctctcatcgcgattgtgatgctgaagaacccaaagttatccatatcgaagataaacgcaccattgaaaccccatgaaaacctgctgccgtttaatcatctactgatgattacttaggcaaatgtgcccgtccctcccttttcagacgacctttcattgcggaaaccgccgcaaaggttgtctgaaaaccgttttccttccccgttttacaaacaaaccgaaagccccacatgatctctttgaaaaacgacactttcctccgcgccctgctcaaacaacctgtcgaatacacgccgatttggatgatgcgccaggcggggcgttatctgcccgaatacaaagccacacgcgcgaaagcgggcagcttcctcgatttgtgcaaaaacaccgaattggcgaccgaagttaccatccaacctttggaacgtttcgatttggacgcggcgattttgttttccgacatcctgaccgtccctgacgcaatgggcttgggactgtattttgccgaaggcgaaggcccgaaattcaaacgcgccctgcaacacgaggccgacatcgccaagctgcacgttcccgatatggaaaaactgcaatacgttttcgacgcggtaacttccatccgtaaagcattggacggccgcgtaccgctcatcggcttctccggcagtccgttcacgctcgcctgttatatggtcgaaggcggcggcagcaaagaattccgcaccatcaaaaccatgatgtactcgcgccccgatttgctgcacaaaatcctcgataccaacgcccaagccgttaccgcctacctcaacgcccaaatcgacgcgggcgcgcaggcggtgcagattttcgacacttggggcggcgtgttgagcgatgcggcgtttaaagaattcagcctcaaatacatccgccagatcgtcgccggactcaaacgcgaaagcgaaggccgccgcgtgcctgttatcgtatttgccaaaggcggcgggctgtggctggaaagtatggcccaaatcggcgcagacgcattgggcttggactggacgtgtaacatcggcgaagcacgccgccgcgtcggcaagcaagtcgccctgcaaggcaacttcgacccgttcgccctcttcggtacgccggaatccatccgcaccgaggtcgcacgtatcctagccgactacggacacggcagcggccatgtcttcaacctcggacacggcatcaaccaacacgccgaccccgaacacgccaaaatcttagtcgataccgtacacgagctgtctcggcagtatcacggcgggtaagccggcaggaaaccgcccgatatgccgtctgaagccgagagatggccggttagggtaaaaataaggcaatgcggcaatatccgccgtgtacggatagtacatgacggcggcgttgtcgtattggcgcaatcccaaccgtccctatgttcagacggcatttttgttttcagatgcagggaaaaccgatggcaaaaacgcttaaaaccctttaccaatgcaccgaatgcggcggcacttcgccgaaatggcagggcaaatgcccgcattgcggcgagtggaacacgcttcaggaaagccttgccgcgcccgagccgaaaaacgcccgtttccaatcttgggcggcggatacctcgaccgtccaatccctctccgccgttaccgccaccgaagtgccgcgcaatccgaccggtatgggcgaactcgaccgcgtattgggcggcggtttggtcgatggtgcggtcatcctgctcggcggcgaccccggcatcggcaaatccacgctgctgttgcaaaccatcgccaaaatggcgcaaagccgtaaagtgctatacgtttccggcgaagaatccgcccaacaagtcgccctgcgcgcgcagcgtttggaactgccgaccgacggcgtaaaccttcttgccgaaatccgcatggaagcgattcaggcggccttgaaacagcatcagcccgaagttgtcgtcatcgactctatccaaaccatgtattccgaccaaatcacgtccgcccccggctccgtgtcgcaggtgcgcgagtgtgccgcccaactgacgcgcatggcgaaacagatgggcatcgccatgatactggtcggacacgtgaccaaagacggcgcgattgccggcccgcgcgtgctggaacacatggttgataccgtgctgtatttcgagggcgaccaacattccaactaccgcatgatacgcgccatcaaaaaccgcttcggcgcggcaaacgaactgggcgtgttcgcgatgacggaaaacggtttgaaaggtgtgtccaacccgtccgccatcttcctcgccagctaccgcgacgatacgcccggctcgtgcgttttggttacacaggaaggcagccgcccgcttttggtcgaaattcaggcattggtcgatgacgcgcacggcttcacgcccaaacgcctcaccgtcggactggaacaaaaccgtcttgcgatgctgcttgccgtgttaaaccgccacggcggcatcgcctgtttcgatcaggatgtgttcctcaacgccgtcggcggcgtgaaaatcggcgaaccggcggcggatttggcggtcatcctcgcgatgctttccagcttccgcaaccgccctatgcctgaaaaaaccgtggttttcggcgaaatcggcttaagcggcgaagtccgccccgtcgcacgcgggcaagagcggctcaaagaagcggaaaaactcggcttcaaacgcgccatcgtccccaaagccaatatgccgcgcaacgccaaagagtttccgaacctgaaaatctacggcgtttcgagtttgcaggaagccatcgatatttgccgcgacagcagggaataaacggaaatgccgtctgaaatcgggtttcagacggcatttggtttgtggcggattgaaacaagaaggcataccggcgacagataagatttgcggcaaagttgcctgtgatgtggcaaaaacacacacgcccgtcatccccgcaagggtgggaatccggaatcgtccgtttcggcaatgattgaaaatcacggtaacccaaccgattggattcccgacttcgtgggaatgaggggcgtgtgcatttgatttccatccgccatatgtcggcgacgggcttattcgcctacggttttttgtatcagtttttcggcgtttgccaaagtgtttgccacttcgtcgaaaccgatgcggctgccggcgatgagggcgcgcgtatcggtataggcggcgcgtactttgccgtccgtttcggtaacgaggacgcgtaggggcagttgcagggcgaaggcggggtctttgaccatcagcggcgtgccggctttgggcgtgccgaagacgatgacttttgccggctgcatcgttaagccgtttcggcgggcggcttcctgatggtcgatgacggcaaaaatgtccatccctttgctttttatggcggtttcaaggcggctgacggtttcgtcaaaactgtattttgaggtgagggtatgcgtggtcatagcggtttcgttttgggtggacggttcgctggcaggatgtgccgaagcggttgaaatgcagagtgcggatgcggcaatcagggggagtatgtgtttcatcgtatttcctttttcctttttggttgaaacggtagaatcagactttattcgggaggggtgtaaccctttccaaatcagggcaacacatagggcggtgctttatgtgtcgtgaaacatcattgttccttatcggtttgtttatcaggcttcggacggggcggcgcgcgccgcgcccgatgttgcgccgcgtgccggaacgccgtatgccgtctgaaagcctgtcctttcagacggcattgcgtcatttcatcccttttttgagcaggtcttcataaccgccgtgattggcaacatttgtataacctgcttttttcagctcttgaagggcggcttcggcacgccgtccgctgcggcagtagaggttgaccggcgtgtctttgtcgggcgcggcttcgtgtatgcggcggacgatttggtcgacggggatgttgaccgcgttgtgcaaatgcccttcgctaaattcctgttcggaacggacatcgatccaaacggccggatgttgcgcggtttgggcggcggatacgggtttttgcggggctgcctgcgcggcaaaggcggctgaggcaatgagtgcggcggtaatcaggtgtttgatattcatagggttttcctgcggttgttgtccgaaaggacgggaagttattttatctgttccaaagcggcggcatctatgtcccaacgccaaacgccgccgcctttgccatccaatccgcgcaaaaacaggtagcggacggaaacggcggcgggcggttgtccgcgcagcttgaagtagcgtgcggcggcaacggcgtaaatcagtgcctgaaggtaatagtggtggtgtgcgacggcttcgtccattgcctgttgcgtgtaggcggatgcgtccgtaccgaggtggtttgatttgtagtcgatgacgcagatattgccgtcggggtcttggcagaccatatcgacaaagccgtttaaaaagccgttgacggtgtggaagtcgagcgtttcggcagcggcacggcagacttcgggcagcctgatgtcgtcgcgggcaaaccagtcgcgcaggcgtttgaggctgaagtcttcggtgtggagggtaaagcccatttcgggacagcggcactcgggtgagatgtcggacaggtcgtatgcccccgtcagcggcgttttgcggcaggcttccgccatttcggcaacggcgggcagccatatttcttcaaaaccgtattttttcagcttgtcggcaatgagggtttcctgtccggcggctgcttgtccgaatttgaaatcttcaagaatttcgtgcaggcacagccccgcctgcgtgcctttcggaaaatcgtgtatcgatatgccgtctgaagccgtcggcgtttcagacggcatcgccggcaccgaggtttcggcggcatccaaggacgggcaggcatcttcttcgccgccgtcgggcgtttgggtatggcggcttaaggcggtaaagctagtgtggcggacaaatcggaatccgcgttcgggaatgctgtttgcggcaaattcggcggtttgaccggcgttgctgcgataggcggcagggggcggcgcattttcggtgaaggcgaaatttgtgccggaaggggcgttgtccgccacgcgccgccagttgcgtttgagcatcgcgatgccgtctttttcacacgcataggcacggcggacggtttcacggctgtcttggggcgagccttcaatcaggtaggcgagggggttgtcggcagtattggtggagtacgcggcgtagatgttgagctgttcctcggcacgcgtcagcgcgacataaagcaggcgcaggcgttccgccatttcttcatcggcgtattgtttctgttcgtcttccgacagttgcgcctttgccaacagttcggttcggtttgcgccttggtggaggatttgccagtcggacggtccggtatcttgcgcgtcccacgcaaacgggcagtacaccagcggatactgcaaacctttcgaggcgtgcatggtaacgattttgaccaaatcttcgtcgctttccagacggatggcgcggttgtcgccgctgttgttttcggcaaggctgatttggtcgcccagccatttgtgcagcgcggcggggttgcggttttgcgcgtcttcggcggcaagcagttcgagcagttggaaataattggtcagactgcgcccgttgttccggcttaagaggcgcgtttcgatgccgtgtgtttgggaaaattgctgcatagcggcgaaaatgccgtatttattccagttgtcgagtgcggttcgggcagattccgcccaatgcaaaatctcgctttcgttttggttgaagtcgtgcaattgctgcgcgtcataaccgaatatgctgcttgtcaggacaaaacgcagcgttccggcgcggcgcggttcgagccagaagccgatgagtgcggacagggcggcggcttcgggcgaggcgaacacagattcgcgcgaaagcaggacgctttgcacctgccgttttttcagggcggcggaaaccatcaccgcctcgttgtgcgtgcgtaccagcacggcaatatcgcccgactgcaacgggcagcctttgaaattcagacggcctctggcggcttcgttgagcgcgtgggcgatttcgtcggcgcaatagtcggcggcacggcggcgcaaaacgtctttgttggctttttcattgtcgttttcgtgcagccaacgaacctgtacggcaggacgttcgggggacagcctgctttcggcacgcgccgcaccgacttccgaatagccgatgttttccaaaacgaacgggcgttctttgaggcggaacagcgcgcctatgctgccgataagcgcggcgtggctgcggtagttggtggcgagcgtgtagcggtgccgcgcgtcttccgccgcctgaaggtaggcgtaaatgtccgctccgcgaaagctgtaaatcgcctgtttgggatcgccgacgaggaacagcggtcggttttgggcgatgaaaatcttttggaagatttcgtattgcagcgggtcggtgtcttggaactcgtcgatcagcgcggtttcccagttttcggcaacggcgcgggcgagagtgtcggcgtgcggattgtcggtcagcgcggtgtggacatcgagcagcaggtcgtcgaaaccgcgttcgcggcgcgattttttcatctcggcaaggctgcggttgaggtattcgattaaatccagttgcagccggatcattgttgcttcttccgcttcttcgagtgcgttcaaatcgcgcccgaagtctgccagtttctgcaattcggcaaatactgccgcatcgggcgttttgccttttttcagtccggcttcgagtttgtcggatgcaagtttcaagagtctgtcgtgtgtgtctttgtccagaaagggcagttgtccggcggcggatttttgtgccagttctttaaaaaggttgccgaagctgtttttgcggtaactgttgccgttgaggtcgggatgaatgcgccaaaagccggcttccagttctggcagcaggcggcagatggtttgccatgaggtttcggcgttgcgctgcgcctgtttcaaatccgcctgcggacggcggaaattcaggtacgggcgggaaagatagcgcgaaatttgggcaaggacggtttgcggcacagctttgcgtttaagcgccaatgcggcaagcaccggatcattgctgacgcgttcccgccaaaaatcttgcgccgggataagcaggcggtcgccgtcttcttcggtcatttcgacatcgaacggtgcttggcacaggaaggcgtagtcgcgcaggatgcgctggcagaagccgtggatggtatagatggcggcgttgtcgaattgcccgatggcggccttgaggcggacaatcagacgcgtccggccctctttttgcaaagcctgttttaagagttcgggcaggaaggtgtcgccttcgtggtgttcggcgcagtaggcggcaatgccgtctgaaagcgtgtcgtctccaagtttggcaattcctttgctttctaaaacttgtaacacatcgtccaaacgcccgcgcaggcgtgttttcagctcggcggtggcggctttggtgaaggttacgaccaatacgcgttcgacgtttttttgttctaatacgatcaggcgtgtaaacagggcggcaatgccgtaggttttgccggtgccggcagaggcctcaatcaggttggtgccggaaatggggacggttagcgggtcgaatgcttggatgcttgcagacatagtgcgcgctcggaaaacggttggacggtaaaacgggaaaatgccgtctgaaaaatggtttcagacggcatcgtccggcttagaggttttgcaggcgttcgacagacggcgcgtagtagtatccgcccgaaacggcggcggagagatgtcggagcagcaggtcggttttgccgtccgtatcgccgaacatactcaataattgcgcttcgatattgtgcagcgtgcggcagtatgcggtaaacatcaaaccgtgttcgccgctgattttgccgaagggcaggctgcggcggacgattttcaggccgactccgttttctttcaggttgacgcggccgaggtgcgaatcgggcaggcggacatcgcggccgaattcgtcgtcggtttccttgccgcgtccgaccgaggcctcctgttcggcgacggggacggcatcccattttttcaaatcgtgcaggtatttttgcagcaggacatagctgccgcccgcatcgggttttccttcggggatgatggcgacttcgcggacattttcatcgccctgcgggttttccgtgccgtcgacgaaaccgtccagcccgcgatcctgatacaggcgcaaaccgtgttcttcggacgcgacgcatatgctgtcgccgaacgcgcccaaaacggattgggcaagcgcgtaggcggcgttttggcggaaggattggatgtggatggacatatcgtgctgcgtggacggcgcaagcccgttgcccatttcggagaagggtttgatttcactgccttcgtccgtatgtccgaatgttgcccaggctttgctgccgaaggcgatggtcagacccaaaatatcgtccggaaagcgggctttcaaggcagttaacgcgtcgagcgaagcgcggcaggcggctttaatatcgttgaggcgattggcggcgaagtcggcttcgataaagatgccggcttgggcgtggtcgggaatgatggcggattggggcgtgttcatgagatgttcctttttggtgtcatctgtttcggatagattatagcaccgaatcggcaggcggatttttgccggaacggcgtgcgtgaatccgccgtttacatacctgatgccgcttttcggtttcgtgccgcccgccgcctttcccgccccctttatttccgcttccggcggcttcggcatatcttttccattccgatttggaataaccatataaaaaaagtattctttgtgtttgccgcaatttcacttagaatgccgcacttgcacactttttacaggagaggatgatgttgaaaaaattcgtactcggcggtattgccgcattggttttggcggcctgcggcggttcggaaggcggcagcggagcatcttccgcgcctgcacaatcggcagtttccggttctttaatcgagcgcatcaacaataaaggcacggttaccgtcggcacggaaggcacttacgcaccgtttacctaccacgacaaggacggcaaactgaccggttacgatgtggaagtaacccgcgccgtggcggaaaaactgggcgtgaaagtcgagtttaaagaaacgcaatgggattcgatgatggcgggtttgaaggcggggcgtttcgacgtggtggcaaaccaagtcggtctgaccagccccgaacgccaagcgacattcgacaaatccgatccttacagctggagcggtgccgtattggttgtccgtaacgacagcaacatcaaatctatagccgacatcaaaggcgtgaaaaccgcacaatccctgaccagcaactacggcgaaaaagccaaagctgcaggcgcagatttggtggctgttgacggtttggcgcaatcgctgaccctgattgaacaaaaacgtgccgatgcaaccctgaacgacgaattggcggttttggactatctgaagaaaaacccgaatgcgggcgtgaaaatcgtttggtccgcacctgccgatgaaaaagtcggttccggcctgattgtcaacaagggcaatgacgaagccgtggcgaaattcagtacggcaatcaacgagctgaaagccgacggtacgctgaaaaaactgggcgaacaattcttcggaaaagacatcagtgttcaataatttccttgcttcgctgccgtttatgacggaaacacgcgccgatatgattgtcagcgcgtttttgcctatggtcaaagccggcttcgcggtctctctgcctttggcggcagcttctttcgttatcggtatgatgattgcggtagccgtggctttggtgcggattatgcccgccggcggcatcgtgcggaaaatcctgctgaaattggtggaattttatatttccgtcattcgcggtacgccgctgttggttcagcttgtgattgtgttttacgggctgccttccgtcggcatctatatcgacccgattcctgccgccatcatcggcttttcgctcaatgtcggcgcatacgcttccgaaaccatacgcgcggcaattttgtccgtacctaaaggccaatgggaagcaggtttctccatcggcatgacctatatgcagacgttccgccgcattgtcgcgccgcaggcattccgcgttgccgtgccgcctttgagcaacgagtttatcggtttgtttaaaaacacctcgctcgcggcagtcgtgacggtaacggaattattccgcgtcgcgcaggaaacggcaaaccgcacttatgactttttgcccgtctatatcgaagccgctttggtttactggtgtttttgtaaagtgctgttcctgattcaggcgcgtttggaaaaacgtttcgaccgctacgtcgccaaataaggagttgtcatgattaaaatccgcaatatccataagacctttggcgaaaacactattttgcgcggcatcgatttggatgtgtgcaaagggcaggtggtcgtcatcctcgggccttccggctcaggcaaaacgacgtttctgcgatgcctaaacgcgttggaaatgcccgaagacggacaaatcgagttcgacaacgagcgaccgctgaaaatcgatttttctaaaaaaccaagcaaacacgatattttggcactgcgccgcaaatcaggcatggtgtttcaacaatacaacctctttccgcacaaaaccgccttggaaaacgtaatggaaggaccggttgccgtacagggcaagcctgccgcccaagcgcgcgaagaggctctgaaactgctggaaaaagtcggcttgggcgacaaagtggatttgtatccctaccagctttccggcggtcagcagcagcgcgtcggcattgcccgcgcattggcgattcagcctgaactgatgctgtttgacgaaccgacttccgcgctcgatcctgaattggtgcaagatgttttggataccatgaaggaattggcgcaagaaggctggaccatggttgtcgttacgcatgaaatcaagttcgccttagaagtggcaaccaccgtcgtcgtgatggacggcggcgttattgtcgaacaaggcagcccgcaagatttgttcgaccaccccaaacacgaacggacgcggagatttttaagccaaatccaatctaccaagatttgattaagcatttttcctgtgtttacagaggccagattagattcggattgctttcgatgacggctttgaattggttttgaatccgctcgatggcttcttgcgtatccgcctcaaaacgcaacaccagaatcggcgtggtattggaagcacgcatcagaccgaagccgtcgggaaattcaacgcgcagaccgtcgatggtgatgatttcggttgcgccttcaaattcggctttggcggcgagttcgtcgataacctgatggccgttgctgccttcgggcagggcgatgttgagttcgggcgtggaaatgctttgcggcaggttgtttaacacttcggacggattatcggaggcagacaggatttccaagaggcgtgcgccggcgtacagaccgtcgtcgaagccgaaccagcgttctttgaagaagatgtgtccgctcatttcgccggcaaccggcgcgccggtttctttcatggcggatttgataaagctgtggccggttttttccattatggctttgccgccgtgttctttaatccaaggcgcaagcaggcgggtggacttcacgtcgaaaatgactttcgcgccgggattgcggttcaaaacgtcttgggcgaacagcatcagttggcggtcgggataaataatgttgccgtctttggtaaccacacccaagcggtcggcatcgccgtcaaacgccaagccgatttcggcatcaccgtttttcagcgcggcaatcaaatcttgcaggtttttcggtttggatgggtcgggatggtggttggggaaagtgccgtccacgtcgcagaaaagctcggttactttgttgcccaagcctttgtagagtttgccggcaaacgcgccgcccacgccgttgcccgcgtcaatggcgatgttcatcgggcgtttgagcctgatgtgtccggtaatgtgtttgaggtattcgccggagatgtctttttcggtgacgctgccttgtttgccggcggcagcaaaaccgtctttttcaatgatggacaaaagttcttggatggcttcgccggcaagcgtgtcgccgccgagcatcattttaaagccgttgtaatcgggcggattgtggctgccggtaatcatcacgccgctgccgccgcattcgttgacggcggcgaagtagagcataggagtggcaaccataccgacattgaggacattgatgccgctgtcggtaaagccgcgccggatgtgttccatcagttcgggaccgctcaagcgtccgtcgcgtccgagcgcgatgcgggtaatgcctttttcggcggctttggcggcgatggctttgccgataaggtaggcggcttcgtcggtcagggttttgccgacaataccccggatgtcgtaggctttgaagatgtcgcgggcgatgcttgccataaggtttcctttgtgtccgtttaggaaaaacgggcatattttaacatagcggtatgccgtctgaaggcttgcgtccggttttcagacggcatagcacggttacatcaaataacatgccgtctgaaataaaagcagcctttgtgcaggctgctttcggattgtcggtttataccgcttcggctttaatgatgacgacaggttcgctcggtacgtcgtcgtggtaaccatgacgtttggtagaaacgccttcgatggcatcgacaacgtcaaaaccgtcaacgactttaccgaatacggcatagccccagtcttggacgacggttttgccgtacagctctttagaacggaagttcaggaaagcgttgtcggcagtgttgatgaagaattgcgcgctggcggaatgggggtcggaagtgcgtgccatggcgatggtgtatttatcgttgggcaggccgttggacgcttcgttttgaatcggatcgcgggtttctttttcgttcatgttttcatccatgccgccgccttgaatcatgaagcctttgatgacgcggtggaagattacgccgtcgtagaagccgtctttgacgtattgctcgaagtttttggcggtaacaggggctttgtcgaaatcgagttcgattttgatgtcgcctttgttggtgtgcaggataatcatgggtttcctttcgttagaatctggttttgaatgattcgacaaattgtgtctgaacgacaaacttcaaggtcgtctgaaaaatattctttcagacggtcttgttgtttaggtcgatggtttacatcagtacagcataagcccacagagcaaccaatactacgcagaggatgttcagcagtatgccgacattcatcatttcgcgttgcttgattaagcccgtgccgaacacaatcgcgttaggcggtgtggcaaccggcagcatgaaggcacaagatgcgccgatgccgatgacgaataccaagacttgttcgggcagccccatctgcatagcgatgccggagaaaatcggtacaagcaatgcggcggaggcggtgttgctggtgaactcggtcagaaaaataatgaaggcggcgacgatgagtatcaccaaaaatgcgggcgcgccggaaaaggtggcggcaacctgctgtcccaaggcttcggacgcgccggatgttttcaacagcgtgctcaggctgatgccgccgccgaagagcatcaacacgccccagtcggtattgcgggcgacttccttccattgcgccacgccgaagacgacgacggcgacggcggcactcagggcgataacggtgtcgggattggaaatgccgaaggcggttttgattttggagctgaatatccacgcggcggctgtggcaaggaaaatcaacagcgcgatcacgcggtgcagcgtccaagggatggattcggctttgatttccacgcgttcgttcaaattaggtttgaggatgacgtacagggagagcagcatcaagggcagaatcaacagcatcatcggcaggccgagcttcatccagccgacgaagtccagatttagggctttggcggcaatcaggttgggcggcgagccgacgagcgtgcccaagccgccgatgctggcgcaataggcgatgccgagcaggaggaagacgtaggttttgtgttctttttcctggtcgaggtggctcagcatacccattgctagaggcagcatcatcgcggcggtggcggtgttgctgatccacatggacagaaaggcggtaacgaggaacaacatcaaaaccgccactttcatattgccgcgcgacaggcgcaacaggctgacggcgattttacggtccagccgctgcatatgcagggcggtggcaagcgcgaagccgccgaaaaaaatgtagataatcgggttggaaaaatcagccatcgcctttttgatgtccatgtcggggaaaccgagtacgacggcgagaatcggcaccatcagtgcggttacggtaatgtggacggcctcggtaaaccaaagtgcggcaacgaaaatcagcagcgcgatacctttattggcatcggggctgtaaggcaggatgtggtaaatgccgaaacagacgacggcggaaataatggtggtcagcaggcccttaaagtcggtaatcggcttctgcgcactgagcagctcgacgttttcgggatgctgggttttgtcctttgcatgcaggttcatgaatactcctttaaggcaacaaaatcggtttttcttttgtgtcgtgcaatccgaaacggtttgtggaatcgccgcttctgcaactggttcgagtatatttgtaatctgatgtagtgtaaatatattgtaaacgatttgtcggttttgtttatgagatgggattgatatgtaaggggaaaaataggatatatcgggaagaggtgcatcctgtttggggaaaataaaccgatttagtccgggcggcaggcagctcgcgcggtaaagagggcaagggctgcgcccgtcaggtcggcaaggacatcgcccaaactgccggttctcgttgcggtaaaccatgcctgcgcgcattcgctgaagagggcgaaacagagggcaaagaccatcaggctgcgataggggatggggcggttgtcggttctgaatgctttggtcagaagccagatttgtgcgaaaaacagggcgaggtgcgccactttgtcaaaatgcggaaaaggcggtggcgcggtttcggcagctttgaaaagcagtgagtaaatgctgcctgcaaaccacaatgccgagagcaggataaagcggttgcgtggcagattcatgcttgttcctcttcaagccatgtctggcatagtttggataggcgcaggaattttccgccgcgtgcggccagcatatcgcgccaaacggcaatttcttcggcggagggggcatcgtctatgctgcattcgtagagcaggaaatcgagggtttcttcgatgacggggatggattcggtttggataagctgcttgagttcggtcatgactgttcggatatggaaatcgggaacatgccgtctgaaagggcttcagacggcatcgggtcatttgctgtgcaggaagcgggttgcttcttcccatttgccggcaaggatgtcgggtatggcttgcagggatttggcgacggcatcgtcaatctgtcggcggtgttccgtactgggtttgttcaggacatagccgacgacgaggttgcggtcgcccgggtggccgatgccgaggcgcaggcggtaatagtctgccgtgccgagttttgcctgaatgtctttcaagccgttgtgtccgccgttgccgccgccgagtttgaatttgatccgtccgcagggaatgtcgagttcgtcgtggacgacgaggatttcttcgggtttgattttgtagaactgtgcaagcgcggcaactgcctgtccggaacggttcatgaacgtggcaggtttgagcagccaaacgtcgccgtcgggcagggcggcacgggcgacttcgccgaagaattttttttcttctttaaatgaagccttccatttccacgccagttcgtcgaggaaccaaaaacccgcattgtggcgtgtctgttcgtattctttgcccgggttgcccaagccgacaaccattttgattgtgtttgacatgatattttccgtgtttctgtcgaatgctgtctgaaggcttcagacggcatggttattcttcttgattttgaacgcgtttgcggcgcgcttctttggggtcgatcaacagcgggcggtacacttcgatgcggtcgccgtcgcgcagcggcgtgtcgtctttgacggctttgccgaaaatgcccaaaggcgcggaatgcaggtttaaatcttcaaatatgccgtccaaaccgctttgcagtgcggcggcgcggacggttgttccctcggcaagctgcatggttttcaaaacctgtcggtcgggcagcccgtacacaatctcaatttcaagcataacggcggtctgcctctttgacgaacgcttcgaccagcgtggtggaaaggtggttgaagacgggggaaattaaggcggacaaaacggcattggaaaaatcgtattccaaattgaattcgattttgcacatatcgtcgcccaaatcgataaatttccacgttccacgtaaggttttgaacggaccctcgagcagttccatacggatttccctgcccggaatgttgcggttgtgcgtggcaaacgattggcgaacgtgcatataatccataaacagccgcgccttcagttcgttgccgctacgcccgatgacttcggtcttgctgtaccacggcagaaagtgcggatagtcttcaaccttgtcgaccagctcgaacattttgtccgcgccgtgcagcaccaagatgtttttttcaacttttttcacgggcatcaccaatgcgggcgtgtattcgaagggcggtattatagcggtttaattttaaaccggtacagccttgccccgttctgatttcaatttaaaccgccatatcgcagattcgtaaaaaccgatacggctttggcgtttcagacggcattgagtggaaaatgccgtctgaaaacgggatgggaaaacggcagcttgcgggctgccgtttgttcgggaagttaagccttgttttcaggctgctgctcggactctgtcgaagcggtgtctgccggggcaggtgcttcggtttcttcccgagtcggagcgtgcggcgcgttatcttccgccgcgtccgcattctcgcgcaggttgtggctgtaatctttgggcgggctgggttgtttgcccgccatgatttccagtacctgatcgcggtcgatggtttcccattccatcagggctttgcacatcgtttccatcttgtcgcggttttcatcgaggattttgtaggcaacctgatattgctcgtccaaaatccggcggatttccgcgtcgatgtcctgctgggttttctcggaaatgttttgcgaacgggttacgctgcgtcccaagaagacttcgccttcgttttccgcataaaccatcacgcccattttgtcgctcatgccgtagcgcgttaccatttcgcgcgccatttgggttgcgcgttcaaagtcgtttgatgcgccggtggagatgcgtccgacgaagatgtcttcggcaatccgtccgccgaacaggatggagagctggctcaacatctgatctttatacatactgatgcggtcgcgctccggaagctgccaagtcagacccagcgcacgtccgcgcggcataatggttactttgtggacggggtcggtaaagggcaggctttcggcaacaatcgcgtgtccggattcgtgatacgccgtcgcacgtttttcgtcttcgtgcatcaccatactgcggcgttccggacccatatagattttgtctttggcgtcttcaaaatcgctctgatcgactttgactttattgcggcggccggcaaacagggcggcttcgttgaccaagttcgccaaatccgcgccggaaaaacccggcgtgccgcgcgcgagggacaataaatccacagattcgtccaaaggcacttttttagaatggacgttcaaaatctgttcgcgccctcggatgtccggcagggggacaaccacttggcggtcgaaacggccggggcgttgcagcgcaggatcgagtacgtcggggcggttggttgccgcaatcacaattacagtctgattgctctcaaaaccgtccatttcaaccaacaattggtttaatgtttgctcgcgctcatcattgccgccgcccaaacctgcgccgcgttggcggccgactgcgtcaatctcgtcgataaagatgatgcagggggcgtttttcttcgcctgctcgaacatatcgcggacgcggctcgcaccgacaccgacgaacatttcgacaaagtcggaacctgaaatgctgaagaacggcacgccggcttcgcctgcaatcgctttcgccaaaagcgtcttacccgtacccgggctgcccgccagcaggatgccgcgcggcacgcgcccgcccaggctttgatagcggttcggcgctttgaggtaatcgacgatttcctgtacttcttctttggcttcgtcgcagccggcgacatcggcaaaggtcactttgttggcatctttgtccagcaggcgggcgcggcttttaccgaatgagaatgcgccgccttttccgccgccgcccgtctgcatacgcatgaagtagaaccatgcgccaatcagcagcaggacgggcagcaggctgtaaaacagggcagccagcgcgctcggtttttcttccggcgttacttttacgcggacgtttttgtcgagcagtgttttaattaggttgtcgtccaaaggcgcgttggtgaagaaagtgcttttgtcggtgcgctcgcccttaatcaggtagccgctgacgacggatccttcgatgttgacgccggatacttcgccgttgttgacctgttggatgaactgagagtattcgatttgcccgttgtcttcttttttaccgtctaaagcgttgaacgcagccatcaggccgatacccaaggcgacccagacaaggattgatttaaaggtgttccccacttagcaaggctccataattgaggtgtaaaacggaaatgattgtaaagcacgccgtctgtattgtcagcgtttatttttgcccaataaataaatctcactggagcgattgcgcgaggcttcgggtttgcgcgtctgcaccgtgccgaaaatttcgcgcatggctgccatgtattcctgatagcctgcaccctgaaagactttgaccaaaaagctgccgccggttttcaggtgttgcgaggcgaagtctaaagccagttcgcacagataaaagctgcgtgcctgatcgcttacggcgtttcccgacatattgggcgccatatcgcaaattacaaggtcgagcgggcggttgtccaacaaggtttcgaattgtgccagtacgtcgttctcgcggaagtcgccctgaatgaaggagacgccccctatggcttccataggcaggatgtccaaggcgaaaactgctccggaagtacccgtcagcttggcggcaacctgcgaccagcttcccggcgcgctgcccaagtcggcaagtaccgtgccgggtttgattaatttgtctttttcgttgatttccaaaagtttgtatgcggcacgggcgcggtagccgtctttttgcgccatatggacgtagtggtcgttgacgtgttcgtgcagccacgcttttgaggatttggaacgtacagccatagtggttcgcgggtcggaatggaaaccgcgtattgtacgttaattttgccgatgtcgtgccaaatcgcgtacaatgccgcattattctttttattcaagcagtaggaaaatgacggataccaaattgaacaccaaagaaattttggaactgaaagcgcgcgcgcaccatctccatcctgttgtgatggtcggtcagcagggtctgacggacgcggtcatcaaggaaaccgatgcggcattgacggcgcatgagctgattaaagtgcgcgtattcggcgacgaccgtgccgaacgtatcgaaatctgcactgccttatgtgaggcggttgatgcgcaactggttcagcatatcggaaaacttttggtattgtggcgtaagaatatcgaagcctgacagcctgaagcagttgttttgctattgttctttaacgggcgggacgccgtccttcggcgcggcatttcggcgggccgaaaccctttccggtgaaaacggattttgattgccgcccgatgctgtctgcaagttgcggcggcttccgtatggtttgaattgttgacaggatgattggagggcttatgcagtttccttaccgcaatgttccggcttcgcgtatgcgccgtatgcgcagggacgatttttcacgccgcctgatgcgcgaacacacgctgaccgccgatgatttgatttatccggtgttcgtattggaggggtcggcgcgcgaggaggatgtgccttctatgccgggtgtgaagcgtcaaagtttggacaggctgctgtttacggcggaagaggcggtaaagctcggtattccgatgttggcactgttccccgtggttacggcaaacaaaaccgagcgtgcgcaggaggcgtacaatcccgaaggactcgtgccgtcaactgtccgcgccttgcgcgagaggtttcccgaactgggcattatgacggatgtcgcgctcgatccttatacggttcacggtcaggacgggctgacggacgaaaacggttatgtgatgaacgatgaaaccgtagaggttttggtcaagcaggctttgtgccacgctgaagcgggcgcgcaggtggttgccccttccgatatgatggacgggcgtatcggtgcgattcgcgaggcgttggaggatgccgggcatatccatacgcggattatggcgtattccgccaaatatgcttctgcattttacggccctttccgtgatgcggtaggcagttcgggcaatttgggcaaggcagataaaaagacctaccagatggatccggcaaataccgatgaggcgttgcacgaagtggcgttggacattcaggaaggtgcggatatggtaatggtcaagcccggtttgccgtatttggacgttgtccgccgcgtaaaggacgagttcggtgtgccgacttatgcctatcaggtttcgggagaatacgcgatgttgcaggcagcgattgccaacggctggctggacggcggcaaagtggttttggaaagcctgctggcattcaaacgtgcgggtgcggacgggattttgacctattacgctattgaggcggcaaagatgttgaagcgttgattttcggccgggttaattgaaatgccgtctgaaaccatggtttcagacggcatttttacagtttacaaagttgtatcgagtgcggcggaaatatcgttccaaatatcgtccgcgtcttcgatgccgatggagaaacgcagcagaccgactttgatgcccatttccattttcacatcatgcggtacgccgctgtgggactgggaatagcaatggttgaccaaactttccacaccgccgaggctggaagccattttgaccagtttcatgtttttaatcacgctgtttgccgcttcacgcgtgtcgtttttgagataaaccgtaaccacgccgccgatgcctttgggcatttgtgttttcgccagttcgtaatgttcgtgagacggcaggccgggatggaacactttttcaatggcaggatgggcttccaaacggcgcgcgatttcgagtgcgttttggcaatgggcgttcatgcgcagagccagtgttttgatgccgcgcaacaccagccagcagtccagcgggccggcaaccgcgccggtatgcaccatcatatcgtgcaaaggctgcgccagttctttggttttggcaacgacgatgcccatcaacacgtcggaatggccgcacaaatatttggtagcggaatggaatacaaaatcgcaacccatatccaacggctgttgcagatacggcgtggcaaaagtgttgtcgataccgaccagcgcaccggctgctttggcttttgcggcaaggactttgatgtctaccaagcgtaaaagtggattggacggcgtttccagccaaaccagtttgaccttgtgcgctttaagcagttcgtccaaattatccggattgcctaaatcggcaaaaacaacgttcaccccccatttttgataaacatcgaccaataaatcataagcgccgccgtaaatatcggcgacggcgacaatggtatcgcccgggcgcaggaaagtgcgccatacggcatcaattcccgccataccgctggaaaacgcaaaacctgccgcaccgtgttccaaatcggcaacggtgtcttctaaaatctgacgggtcgggttgctcaggcgcgaataacggtaaggcacattttcgccaatctcgtgcaacgcaaacatactgttttgataaatcggcggcatcagcgcgcggttgtgttcgtcgcaatcgtagctggaatgaatggctttcgtggcgaatttcatttggtctctgcctatgtagatgtgaataatcgaagattttatcactatctgaaaaatagaaacaatcaatgcagctgctaaaagcgagtgatataatctcgcatttgcagattgacggtatattccccggcggaaacgccataccatgcacacatctcaacaattacatgaatattaaggaaaaacaactcatgaacactattgcagacgtgcaatccagccgagatttgcgcaatctgccgatcaatcaggtcggtatcaaagacctgcgctttccgattaccctgcaaactgcagaaggcatccagtccaccattgcccgtctgaccatgacggtttacctgcctgctgagcagaaggggacgcatatgtcgcgttttgtcgcattgatggagcaacatgccgaagccttggattttgcacaattgcgcaagctgactaccgaaatggtcgcgcttttagattcccgcgccggcaaaatcagcgtttctttcccatttttccgcaagaaaaccgccccggtttccggtattcggtccttactggattatgatgtctgtctcacgggcgaaatcaaagacggggcatacggccacagtatgaaggtcatgattcccgtaacctcgctttgcccgtgttccaaagaaatttcccaatacggcgcgcacaaccagcgttcgcacgttaccgtcagcctgactgccgatgccgaagtcggtatcgaggaagtcatcgattatgtggaggcgcaggcgagctgccaactctacggcctgctcaaacgccccgatgaaaaatacgttaccgaaaaagcctacgaaaacccgaaattcgtggaagatatggtgcgcgatgtcgctacttcgctgattgccgacaaacgcatcaagagtttcgtcgtcgagagcgagaatttcgagtctatccacaaccattcggcttatgcctatatcgcctacccgtaggcgcgtttgcgatgaaccaaatgccgtctgaaaggcgtttgggcgttattggcgaatctgccgccgtatcggaaatcaatttgcaatacaagtaataaaaggatgcacgatgacagtattaagcaaagagcaggttctatccgcatttaaaaaccgtaaatcatgccggcattacgatgcggcacgcaaaatcagtgccgaggattttcagtttattttagaactcgggcgtttgtcgcccagttcggtcggttcggagccttggcagtttattgtggttcaaaaccctgaaatccgacaggcaatcaagccgttttcttggggtatggcggatgctttggataccgccagtcatttggtggtgtttttggcgaagaaaaatgcccgctccgacagcccgtttatgttggaaagcctcaaacggcgcggcgttaccgaaccggatgccgtagcaaaatctttggcaaggtatcaggcgtttcaagctgacgacatcaagattttggacgattctcgcgccttgtttgactggtgttgccgtcagacctatatcgcgttagccaacatgatgacgggtgcggcgatggcaggtatcgattcctgcccggtggaaggtttcaactatgccgagatggagcgcatattgtccgggcagtttggtttgttcgatgcggcagaatggggcgtgtccgtcgccgcgacattcggctaccgcgttcaggaaatcgccacgaaagcgcgtaggcccttggaagaaaccgttatttgggcataaggcaatgccgtctgaaaacgcaaggattttcagacggcattttttaatgcttggcggattcgcatttgaagtgcaactttccctaacagaaaaaggccagtatgcggtagcatacggcctttcctgcaagaaagattgccatgagccacacgcaactgacccaaggcgaacgataccacatccaatacctgtcccgccactgcaccgtcaccgaaatcgccaaacagctgaaccgccacaaaagcaccatcagccgcgaaatcagacggcaccgcacccaagggcagcaatacagcgccgaaaaagcccagcggcaaagccggactatcaaacagcgtaagcgacaaccctataagctcgattcgcagctgattcagcacatcgacccccttatccgccgcaaactcagtcccgaacaagtatgcgcctacctgtgcaaacaccaccagatcacgctccaccacagcaccatttaccgctaccttcgccaagacaaaagcaacggcagcacgttgtggcaacatctcagaatatgcagcaaaccctaccgcaaacgctacggcagcacatggaccagaggcaaagtacccaaccgtgtcggcatagaaaaccgacccgctatcgtcgaccagaaatcccgtatcggcgattgggaagccgacaccattgtcggcaaaggacagaaaagcgcattattgaccttggtcgaacgcgttacccgctacaccatcatctgcaaattggatagcctcaaagccgaagacactgcccgggcagctgttagggcattaaaggcacataaagacagggtgcacaccattaccatggataacggcaaagagttctaccaacacaccaaaataaccaaagcattgaaagcggagacttatttttgtcgcccttaccattcttgggagaaagggctgaatgagaacaccaacggactcatccggcaatacttccccaaacaaaccgatttccgtaacatcagtgatcgggagatacgcagggttcaagatgagttgaaccaccgaccaagaaaaacacttggctacgaaacgccaagtgttttattcttgaatctgttccaaccactaatacactagtgttgcacttgaaatccgaatccaagcttatttaaaacgattcgccgggagcgagataacgccatttgccgggcggcagcctgccgagtttgaccttgcccatgcggatgcgtttcagcccgacgacgcgcagtccgaccagttcgcacatacggcggatttgccgctttttaccctgtttcaacacgaagcgcagttggtcttcgttttgccattctacttgggcgggacgcagtttctcgccgtccaaactcaatccgtgattcagtaaggcaagtcctttttcgtccaatttgccgcgcacgcgcaccaaatattctttttcactgccgctgttttcgccgataagctgcttggcgatacggccgtcctgagtcaataccagcaatccgaccgagtcgatgtccagcctgccggcgggggcgaggccgattttgtgtttcggatcgaaacggatgcggccggtatcgccttcccagtgattttcaggggtaatcagttcggcggcggatttatagcctttttccgcttgtgcgctgacatagccgacgggtttgttcaacaggatggtaatgcgtgccgcctgctgttcgtgggctttcttgttcagttcgatacggtctgccggtgaaactttctgaccgagtacggcggttttgccgttgaccgttacccaaccctgttcgatatagccgtcggcttcgcggcgtgaacaaagccccagttgcgccatgcgtttggagaggcgcacggcatcttctgtatggtcggaggaaattttgggattcatggatactttcgggtaaaggccggcttagactaattgctcgccccagtgcagtttttggcgcagggttttgaaatattggtagtcggtcgggtgcaaaatgcgtaagggatttcggtagcggcggatggtgatgcggtcgaggttttgcacgtcgatatgggtttgaccgtcgaaatggacgcgcgcgtcgccgccttgggtaacgaggatttcgatttcggacgtgtctggaatggcgatggggcggttggtcatggattgtgggcagatggggacgagcgtgaaggcgtgtaatcctgcctgcatgatggggccgccggcggcaagcgaataggcggtcgatccggtgggggtggagacaatcagcccgtccgaacgctgggtatagacgaattcccgattgacgaagacttcaaactcaatcatctgtccggcaccgccacgggagaggacggcatcgttgagggcgatggcgcgttcggcggttttgccttcgcggatgagtgcggcctcaatcaggatgcgctcttcggcaaggtatttcccttctaaaacgggcaatagcttgtccgtcatatattcgcggggaatttgggtcaggaagcccaaatgcccttggttgatgccgataatcggaacggcgcgcagggcgatttcgcgggcgacggagagaaaggtgccgtctccgcctaaaacggcgaccaggtcgcagtattgccccagttcggtcttgttgacgatatggcagccgacggtgtcttgggtatagatgcagccttcctttatgccgacttcgtcgagatagacggtaaagccgtgctgcttcaaaaaggtaatcagcgtgtgtgcggtgtcttggatgtcgggcgtgttggggcgggttacgatgccgatgttgtgaaaagggctgttcatgtcggatgccgtctgaaggttagtctatccaaatgtcgcgttcgagccggtcgaggcgttcgttgaggcgttccacgccgtcgcgcagtctgcttatttcgtcgaggcagtcggcaagggcttcgttgccgatgtttgcggactcggattcgcgggaaaatccgccgatttgttcggcgatgttcctgccgatttgtttgatgccgtgtccgatgtcggcggcacggctgccgatgtctgcctgcgtgccgaaaatccgtgccaattcgtccgatgcgcgggaacgcaggctgccgagcagggacagtaccgcgatgccgaggatgaggtcgccttcgagcccgatgtcgcccgccccgggttcgcctccttggaggattttctgtaccgcgctgttgcggaaggtaatttcggtgtctgcaaagccgtttcccgccgagagcaaaccgtcttccgtgatgcgtcccgccagtttcagcccggcaatgttcagggtcagtgttttgcctgcaaaggcggcaagttccgagcggctgtccgggctttgcagaatcaggcggttgatgatggggaggagggcggacatattttctgatcggggcggagaatgcctgtttgttgctgttgccgcttattttacaggcttaagccgttatcgcaaacggtacggatgattttgcccacgctgtcgtcgggtgcaaaatccggcgcgggcaagccgagtttggcggcttcttccgtatagaattcgcgtcgtgtcgggtggcgcggttcgataatgtttttcagccgcctgccgccggggttaaatgccgtctgaaacaggctttcgacggcgatattacggtggacgatgttgatggggcggttgccgcccgggatgttttgcttttgaacaaggcggccgacgggatggcgttcggcgcaataaagcccgcccagccgcaggatgtcgatgttcggaacgccgctgtcgagcaggtgttgttcggcggcgaggatttggcgggcggactcggtttgcggatcgggtagggcgatttcgtcgcattcgcgcgctgtatcgccgtaaacgctggtactgcttgtgaaaatcaggtgttgcacgttgcacgcccgggcaagttctgcccattgtttgacggtatcggcgtaatgtgtcagcgatgatggcggcaagaggcagaaccaaacgggtttgttggcatggtgccgccaaaagcttgtatctcgggcaaggttcgcgctttgaaacgcgctgtcttgattgaggtcgatggtatcgaggtgtatgggcagattgatatcgtccgaagtcaggctgcgtttgacggcggcaacgcggctgccgtgttggtaaaacttttgtgccagcggcaggccgaggtaacctaggcctgtgatggagatatggggcggggggactgcgcgcattcgctgataccgtcgggtaagtgccgtctgaaggctgattcggacgctgtgggtttacgggttgccgttgccgattttccggtcgtatttcttgcggtgttcgggcaaaagataaggacgaaggaggcttaaggtgcggcggatgccgcgtgctttggagtcttcggtcagcttggtgcggccgcgcagggagctgtcgaagtcgaaccagtatttcgtgaccatccacatattgacggcgagatcgttcatggcggtttggtcggcttggatgatgttcagaccgttgagttgggtgagcaggttgaccaagagcggggagactttggcttgggtgaaggtattgtgttcgcccaacaattcggcactgcgtgcaagcagggtgttcacgtcgctgaataggaagcggtattcccacatcacatcataaataccggccatataattgatggagtcttccacatcagacggcaacacggcttcattcaggtatgccagcagggcttcgctgtaacgtttgaacagttggacgatgatttcgtctttgttgcggaagtggtaatagaggttgcccggactgatgcccaagtgggcggcaatatggttggtgctgatgttgcgctcgccttcctcgttgaaaagcgcaaggctggcgtcgatgatgcgtgtgtaagtattgattttggcggggcgggtcacgggcatactccttggatttacaggctgaacgaagcaggcagccaattaggttcggcgtgcaattctacctgaaaccgagcaaatactgtaaatttgatgtgttgcgccaactgccggacatcgtttgccgaggcgttgtttttgttcactaagaccaaagcctgcctgtcatgtaccgccgcgccgccgatttggaagcctttcagacggcattggtcgatcagccagccggcggcgagtttgaccgaaccgtcgggctgcggatagcgcggcatatcaggatgccgctgcaacaaggtggcggctttttctgcgctgacgacggggtttttaaagaaactgccgacattgccaagcacgttaggattaggaagtttactgttgcggattgcacacactgcatcggaaacatctttcgccgtcgggaccctgcccgcgctcagttcggcaacggcggccgccaaatcgccgtaacccaaagtcggcacaaaatgcgtttttaatgcaaatacgaccgaaacaatcacataacgccctttaccctcctgcttgaacaggctttcgcggtaggcgaagcggcagtcggcattggcaagctcgacaaaggtctccgtatccaaatcaaagcagcgcacgctgtgaatcacgtctttcgcctccacgccgtatgcgccgatgttctgcacgggcgatgcgccgaccgtacccggaatcaggctcaggttttccaaaccgctcaaacccagcgcaacggtgtgcaggacaaaatcgtgccaaatttcgcccgcctgcgcttcaatcagaaccatgccgtctgaacgcgcaatctcgcgtatgcctttgttttccatgtgtacgaccagtccggcgtaatcctgcatcaaaaggatgttgctgccgccgcccagccataaaacagtatcgcggtcgaactccagcagtcggacgatgtcgcgcaactcgtcggcatgttcgagcgcgataaaggcccgggcttgggcgcgaagaccgaaggtgttgtagggggtaaggtcggttcggtatcggatgggttgcatggtttgaactttaactgtatttgaattgaagtgtactgcgttttcagacggccttatgcgatctgaccatctccctactgcacaattccaagcaccacaccaaggcgatggcggcgatggtgagcgaggcaatcaatgccgtccagaagccgtaaatgcccatattgaaacggtaggcgagcagatagcccggcagcaggccgcagccccaaaaggcggcggcgtggatgaacatcggcacctttgtaactttgtagccgcgcaaggcgtaggaggcgatacattgggtgaagtctgccggttggaacaagccggcgaacagtaagacggtggcggcgatgcttaaaaccgccggatcattgttgtacatacttaccagcggcgaacggaataataccaaggaaagcacggtaatcacggcgagcatccatcctaacaccagtgacacgcccgaaatataacgcgcccgcgaaaattcgcgccgcccaagcgaaaagccgatgcgcaccgtccccgccgagccgacgctttgcggaatcatatagagaatccccgacaaactgatgccgacctgctgcgccgccacataatcctcgccgaaaggcgcaatcaaaaacacgataaacgaaaacgcgctggcttccaaaaaataagacagcccgatgggtgcgccgattttccaaatctgtttgaacaccgcccaatccggtttgccgaatttcgccgtcagtccgaatgggcggaagaaattttccttggcgatataaatccacaatgccagcgcgctgaaccaaaacaccgccatcgtcgccagtccgcagcctgcgccgcccaaagcgggcataccgaatttgccgtaaacgaaaatatagttcagcggcacgttcaacacaaacgccgcaaagctgaccaacataatcaggcgcgggcggttcaggctggaagtgtaggcgtgcagcgcgcggtgtaccattgccgccggcatcgccaagctggtgaacaacatatactgcgccatcgtgccttccacataatcgctcaaggtcagccagttgcggaacggcgtaatcgccgcccacatcaagaccatgccgaacacgcccaaaaacagcccgaaccaaatcccctgccgccccgtttcgcccacttcgtcggttttacccgcgccgtaaagctgggcaatcatcgggttcagcgccgccataatgcccataaaggtaatataaaccgtggcaaacgcgctgctgcccaaagccaccgccgccaagtcttccttgcccgcaccgcccgccatcacagtatcgacaaaaccgatgcccacctgcgcgacctgcgccaacagcatgggcagggcaagagtggtcagcaggcggacttctttcaggaagacgggaaaggaaaagcggttgaggtcgagcagcataagtgttcaatcaacaaaaatgccgtctgaagcagaaaacggcagcaggaagtgatgagaaataatggtgcacattatatcgtaaaaaaatgccgtgccgtcagacggcggatacagggtataaaagtatattcagattgtgtgtattttatggtaaagtttggttttaacgacttgacggcattgagccgtcggacaggggctgttcggattctgaatcggaaagaagcaccgccgttttgacagcggcgtgatgcgttgcggcaaagatgccgtctgattgcggatcgggcagtcttttgtgtttacaggataaaatagaaggcagattctcatgcagacatggcagcttccggaacatatcgccgacgtactgcccacgaacgcgcggcagcttgaaagcgcgagggagcagttgttggcactgttccgcgtacacggttatgaactggtacagcctccgctgatggagtacgcacattccctgctgacgcatatcgatgcggggctttccctgaaaaccattttggtaacggacaggctcagcggcaggcagttgggcatacgcgccgacatcacgccgcaggtggcgcgtatcgatgcccatcttttatccgccaaccaagggattaaccggttgtgttatgccggtccggtgttgcacgcgcagcccgacggtctgctgaatatgcgcgaacccttgcaggcaggggcagaaatgtacggttttgctgacatccgtggcgacatcgagctgatagacctgatgctgaaaagcatgaaaattgccgatatgggcaaagtgctgctttcgctggggcatatcggcatatttcgcgccttgtccgatgcggcacatttggatgcggggcagtccgcaacgctgcttgccttgatgcaggataaagataccggggcggtcgaagcgcaggtcaaggcttggaagctggacggcatgtgggcaaaagcattctcgctgttgccgcgcctgtacggcgggcgtgaagtgttgtccgacgcgcgcggacggttgccggatttgtcggcggtcggcggcgcgttgggcgaattgcaggcggtgtgcgacgcattccccgattgtgaaatccatatcgacttgtccgagctgcgtgtcgacaattaccacacgggcttgctgtatgccgcctatgccgccgatttccacgacgcggtcgcgcgcggcgggcgttatgacggattgggcggatatttcggtagggcgcgcccggcaacgggattcagtttcgacttgcgcagctttatcgggcgtttgcccgccatcgaacggcagcccgccgtgttggtcgatgcggaagatgccgaagcggcgcacgaagcggtcgaagccttgcgtgaacaagggcagtgtgtcgtaatcgattacggtatcggacacaatgtttcggaagagcttgcaggccgtctgaaaaagacggacggcgtttggcaggtcgtgaaacgctaaatacccgttcatggcggatgaaaggcaaatcgtggcggggcgcaaagccgcaccggtttggggatttccgcaataatttttaatatcgataggttatatggctatggctaaaaatgttgtagtaatcggcgcacagtggggcgacgagggtaaaggtaaaatcgttgactggctggcggaagaagccggcggcgtggtgcgcttccaaggcggccacaatgcgggccataccttggttgtcggcggcaaaaaaaccattttgcgcctgattccgagcggcatcctgcatgaaagtttggactgcttcatcggttcgggcgttgtcgtctcccccgaagccctgttgggcgaaatcgacgagttgaacgcggcaggcgtgaaaaacgtcgaaggccgtctgaaaatcgcgccgacctgcccgctgatcctgccttaccacatcgcgctcgaccaagcccgcgaagcatcgcgcggcaaaggcaaaatcggcacgaccggccgcggcatcggccctgcctacgaagacaaagtggcacgccgcgccattcgcgccgccgatttgctgcatcctgaaaaactgcgtgaaaaactggatgccgtccttgcctattacaatgtccaactgcaacatctgcacaatgccgagccggttaaagcggaagacgtgatggcggttatcgaaaaagtcgcgccgcgcattgcgccgatgattaccgacgtgtcccgcgtgttgaacgagaaaaacaaaaacggcgaaaaactgctgtttgaaggcgcgcaaggtgcgttgttggacatcgactacggcacttatcccttcgttacctcgtccaactgtctggcgggcgcagcttcggcaggcgcgggcgtaggtcctcaaatgctggattatgttttgggcatcgtcaaagcctataccacgcgcgtcggttcgggcccgttcccgaccgaattgttcgacgaagtaggcgtaggtttggcagaacgcggacacgaattcggttcggtaaccggacgcgcacgccgctgcggctggtttgatgccgccgccctgaaacgctccatccaaatcaacggcatttccggtatgtgtattactaaactcgatgtaatggacggcgttgaaaccatcaatatctgcgtcggctatgaattgcccgacggcggcaaaaccgacatcctgccttgcggttccgatgcggtggaaacctgcaagccgatttacgaaaccatgcccggctggcgcgaatccactttcggcgtgaaggactacggcgcattgcccgaaaacgccaaagcatatttgaaacggattgaagaagtctgcggcgcgccggtcgccatcgtctccaccggccccgaccgagaagaaacgattgtgctgcatcatccgttcgcataaggttttgcagtaaaattgccgtctgaagccctaatccgccgttggtcataaatagtagggtatcaacatttcgggctacaatggtacgtcagccaatgccaagacgtgccagcctgatttgttgatgtgtgtactattgcataggcggttaagccatgcaggagatgaaagtgtatatgtcgcgcaaagcccattagccgcaagcgaggggcggggtgcgcgagagagaggggggcaggtgctaagtcattggttatctccttactatctatctaactacgggtgcattatgcgcctatgcctgttttttgtcaaacactatacagttaaaatgtgtaaatatttagtaaggacatatacccttttctttacatttagctccatcggataccagtgcgttcagagaaaatttgaaaatttctatattttggttgtataatgctttcattttagaaaggtctataatgccaaaatcactctcgctacaagatgttcagttaaggttttccagtaaatttcctgataagacggttttgaagttcactaaaaactacgaaccggtaacaatccaatgccctttgcatgggtcggttgtttacgggaatctacaagctgccatgaaatcctcaacaggatgtcctgaatgtactcgaaatcccgaaaagccctctccaaacgccgttgccattaggttggaggacacagagacaggggaaatctacgagtttgcaagtacactggctgccagtaaatttatcggttgctccaacagcactttagctgtacgtttaagcggacgcactccgtttgaccgattgattaggtatcgttataggttggtaaagtaagttcacaaccactatggcacttacatttactcaagcagtttctaagctaacctctaaatttccacatttgaatcttgtggagttcaatggcgttcgttacccgacggtaatcgtctgtcctatacacgggagggttacttgctctacattcaaaagtatgttggactctaaaagtgggtgtccaaaatgtgcatcttatggtgtcaattcccacaaaattccagaagatacaatagataaattatctaaaaatacagtattggaggatactgtaactggcgaaacacttacattcccctcaagagcatctgctgcaaggtcattgggtataaacccagcagctatcactgaccgtataaaaggtcgggttcacacagagactttacttgcagggaggtataaggttcacatctgcactaaatgacgtatacactttttaacagtgtatacccctcgccactatcaggtgcttctcgaaaaatttgacatttttataaatttgctattaaatccatttgacaatcaattttggagtctcaaatggccaaatctttcaaccaagcagcttctgaacttactgatatattccctaatatctctctaaccggctttgacggtgtgaattacccagtaaccgttaattgtcctatgcacgggaacgttcgttattcgacatttaatgcccttataaagtcaaagtacgggtgtcctgagtgtgctaagatgtcaaaaacccaaacacctccaaatgtagggaagcccctcctcatcctcgacacaacgaccaacgaaacactcacgttcccaagcgttactgccgcaggtgctgctttaggtgtacatttccaacaaatcaatcacaggctcaagggtcgaacgtcgcccgacaaccttatttcaaacaggtacaaagtgcttgggtacgataggtaaggttcacaacaccctaaatcctacgaaccaagctcgacggacgttcaaatcccggttagagttaatttatgtaaagatttagtaaagacgtataccatttttctttacattgtgcttgcgcaggatttcaggtaggtctcaaaaaatttgaaaatttctatattttggttgtgtaatccatttgcacataacctatggagacaaattatgggtaagcgaatgactttcgataccgccaaatcacgctttcaagagaaatttccacatttagaattgttggagttcagtggcatttataaaccttccagtgttagatgtcctacgcacggggttgtccaacttttgtattacgacacagctataaagtcaaagtatgggtgtccggagtgcgggaaacttaaaatgaaggaaaatacgcctccccaaaaccaaaaacctgtctccatcctcgacaccgccacaggcgaaacactcacgttccccagcgtacaagctgccgccaaagccctaaacaccccctacggctctatacgaaccaagctcgacggacgttcaaatcccgacaaccttgtctgtaacaggtataaggttctgctataatcaacctatggaaaatattgaagaatacgcactgctgtctcccgaagccctgctggaacgcctggataccgttttgagtatcagaatcggcggcaagggttgggaatccagttatgaccgccaactttgcacagacgctggtcgaaatacaggacagtctgtacagggttgtgtcaaccgtccaatacggggatgacaacctcaagcggttgacagcggacaaacggaagcagtatgagttgaacttcaagatttccgagggttctacgcgtgtagagtccgactttaaagagactttggttcggttcggtagagatatgcttcaagatatgccccctaaaatccgttcggcaacgctggtagcgttgacgaccctgcttgtcggaggggcgttgggttacggttatttggaatacctgaagcaggttgcttcggaagggtatcagaccgagcgtctgtataatgccgtcgaccgtcttgcagaatcccaagaacggataacgtccgccatcctgaagggtgctagaggtgccgatttcgtgcaaatcggcagacgttcctacagtagggaggatatatcggaggcaaatagacgtgcagagcgtgtcccgtatggcgcagagttggtttcagacggcaattttaccgctgttttatctgatataggggattaacaaaaatcaggacaaggcgacgaagccgcagacagtataaatagtacggaaccgattcacttggtgcttcagcaccttagagaatcgttttctttgagctaaggcgaggcaacgccgtactggtttttgttaatccactatattttctgtccggatacggtttatcagggtatatcaatgcggcgtatccggtgcggaaatggatacggttggtgtcggtatggaaacctgatgttttcagacagcatatacaaaaaaccgtactgcttgcgcgtacggtttttgccgtttcaaatcggtttaaagcgatttgaggcgggcgatacggttgtccagcgaagggtgggtgctgagcagggagtcgcgcgtatctccggcgatgcccattgcgttcatttcttcgggcaaatcgaccgggttgcctttgagcctttgcagggcggaaatcattttcggcgcgccgaccagttttgccgcgcccgcatcggcgcggtattcgcgttgtcggctgaaccacatgacaattaagctggcaaggaagccgaacaggatttggaataccatgctgaccaggaaataagttccctgggactggctgccgtcgttgtttcgggcaatcaggttggcaataatgcgcgacaggaacacgacaaaggtattgaccacgccttgaatcagcgtcagcgtaaccatatcgccgttgccgacgtgtgccatttcgtgcgccaatacggcttccacttcgtcacgcgtcatatggtcgagcaaaccggtgctgacggcgatcagggagctgtttctcgatgcgcccgtggcaaaggcattgggttcgggggagtggtagatggcgacttcgggcgttttcaggttccattgccgcgcttgggcttcgacagtgttcaaaagccaggcttcttcttcggtgcgcggcgtgtcgataacttccgcgccgaccgattgtttggcgataaatttggacatcagcagcgaaataatcgaaccagtgaagccgacgacggcggaatacgccaacaggctgcccgtgccgccccggctgttgatgcccaaaaccgccaaaacaatgttgattacgaccaaaacagcgatattggtagccaaaaacagaaaaattcgtttcacggatgttcctttttggtagggtgtgatgttttgaaattttgggggattgtcccaaaaagttgccggcttgtgaatatcagactcggcaaaggtatgcaaaacatttgcttgcaaatggcagtttgtgcagttggtttttgaactattgtgccaagccgtgtagaatcgtaaaccatctgtttgattccaataaacacatttcaaaggatcacttcatgaaagcattacttttaggcgcgccgggcgcgggcaaaggcactcaggcgcaattcatcaccgcagcgttcggcattccgcaaatctctaccggcgacatgctccgtgccgcgattaaggcaggcacgcccttgggtttggaagcgaaaaaaatcattgacgaaggcggcttggtgcgcgacgacatcattatcggcatggtcaaagaacgcatcgcgcaagacgactgcaaaaacggtttcttgtttgacggtttcccgcgcacattggcacaagccgaagcgatggttgaagcaggcgtggatttggatgcagtcgttgaaatcgatgtgcctgacagcgtgattgtcgaccgcatgagcggccgccgcgtgcatttggcttccggccgtacttaccacgttacctacaacccgcccaaagttgaaggcaaagacgacgtaaccggcgaagatttgattcagcgcgacgacgacaaagaagaaaccgtgaaaaaacgccttgccgtttaccacgagcaaaccgaagttttggtcgatttttacagcaaactggaaggcgaacacgcgcctaaatacatcaaagttgacggcacccaagcagtagaagccgtgaaagccgaagtattgggcgcattgggcaaataaatcgaaaaggtcgtacccacgggcaggcttcgcactctgaaaacagaaaatcaggttttcagacgacctgtttttgataaacagcgtgttgcaaccgaaaaataatcatttggcgtcattcccgcgcaggcgggaatccatttctgaatttgggcaatcgctgtttaaatctgatgaactgagttttatcaatggattcccgcctgcgcgggaatgacggctgatgtaccggttcaaatttatccgaaacagtttgtcggaggcttgagtccgcgtaggtcggacatcaatgcccgacctacggtttgaatttacgttgttatagtggattaacaaaaatcaggacaaggcgacgaagccgcaggcagtacagatagtacggaaccgattcactttgtgcttcagcaccttagagaagcgttctctttgaactaaggcgagacaacgccgtaccggtttaaagttaatccactatactgcgaaaaagacgataaaggtcgtctgaaaacccgaaacgaaaacaccatgaatcctttaatctccgacttccaaactccgcaacaacgcacccccgttatcgtcgcccttgatttttccaacgaaaaagacacgctcggattcgtccgcaaccttgacccgacattgtgtcaaatcaaaatcggcaaagagctgtttaccgcgacgggacgcaatttggcagaaagcttaatcaatcaaggtttcaaacttttcctcgatttgaaataccacgatattccccacaccgtcgcgcaagcctgcaaagtcgctgccgatatgggcgtttggatggtcgatatgcacgcatcgggcggccgccgtatgatggaagccgcagcagaagccgttgccggatacggcacgaagccgctcttaatcggcgtaaccgtgttgaccagcatggaacaaagtgatttggcggaaatcggtttgaacaccgcccctgaagaacaagtcatccgcttggcaaaactggcgcaaagttcgggcttggacggcgtggtctgttccgcccaagaagccgcgccgctgcgccgcgaattgggacaggattttgtcttggtcacgcccggcatccgcttggacgttgccggcaataatgatgaccagcgccgcatcatgacaccggccgaagccttggctgccggttcgacttatttggtaatgggtcgtcctgtaacccaagctgccgatccggtagccgtattgcgcgaagtgaaccgcgtggcaaaccttgaagcaaactgattttcagacggccttacaggctgaggccgtctgaaaaaatacaacggaggcaatatgtccgccaagttccaacaagaaaccctcaaatcccgtttcgcgcaagccaaagtcctggttgtcggcgacgtgatgctcgaccgctattggttcggcgatgtgtcccgtatttcgcccgaagcccccgtgccggtggcgaaaatcggacgaatcgaccaacgcgcgggcggagcggcaaatgtcgcgcgcaacatcgcttcgttgggcggcagggcagggctgttgtccgtaaccggcaacgacgaagccgccgacgcgctcgatgcgctgatggtgcaggacggcgtcgcctcctatctgatgcgcgacaaacaaatcgccaccaccgtcaaactgcgcgtcgtcgcccgcaaccagcagcttatccgtcttgattttgaagaacatcccaactgcgaagtgttggaacaaatcaagcagaaataccgcgaaatcttgcccgaatacgacgcaatcattttttcagactacggcaaaggcggcctgtcgcatatctccgatatgatcgattgggcgaaacacgccggcaaaaccgtcttaatcgaccccaaaggcgacgattacgaaaaatatgtcggtgcaactctgattacgcctaaccgcgccgaattgaaagaagtggtcggcagttggaaaaacgaaagcgagctgaccgaaaaagcgcaaaacctgcgccgccacctcgacctgaccgccgttttactgacccgaagcgaagaaggcatgaccttgttcagcgaaggcgaaccgatttaccagcccacccgcgcccaagaagtttacgacgtatccggtgcgggcgacaccgtcattgccggaatgggcttgggtttggcggcaggctgcaccatgcccgaagccatgtaccttgccaatactgcggccggggttgtcgtggcgaaactcggtacggcggtttgctcgtttgccgaattgatcaaggcattgtcagggcaatcaacaatgtagttttcatattgataagataaacagaacgatataagtatgactatttcgacaatggcacagacacacgatactcgattacaaaaaactttgctctttcccagtcaacaaggttggaaatctaaaacttttcttaaacctgattcacatattagattagcaaccgtattcagcgggattggtgcggttgaacaggcattccaccgattaaatttaaaccataccattgttttttcaggagatattgatccatacgttaaaaaaagttatcttggaaactataaattaaatgaagatttttggcataacgacattactcaatttgatgcgagaaagtttagaaatcaagttgatattttagttggaggcagtccttgccaagcattttccatggttggcaaacgtgcaggattagaagatacacgaggaacattattctatgaatttgctcgcgttgtggatgaagtccaaccaaagatatttatttatgaaaatgtaaagggcttgcttaatcatgataatggaaaaacttggaaagttgtaaaaagtgttttttattcacttggttatgacttatatttccaaataatgaatagtaaggattatgggattcctcaacatcgtgagcgtatttttgttgttggctttcatacccctcctataaatggttttcagtttcctgaaaagattgaattagaacatactatgcaagattttttggaggactatactgatagcaaatattttttacgtgaaaagggtgcgaaatttgttaccagttctaaaaatagacaaaaacgttatacacagattaatggagaaattgccttatgccaaaaagcaaatcaacaatttaattggcatggtgattttatttttcaggcagcccgcgaatctgaatttgatgactttatttttgatgtaaataacgttgaggaaaaatattatctttctgaaaaaatcaaaaattatgttttggcaggaggaacaaaaaattttaaaaccagtacggaaactgatttgcctgtagctcgcccattattgcaaactatgcataaaatgcatcgtgccggggttgataattatgttactcataatcgtggacgtattcgtaaattaacacctagggaatgtttgcggctaatgggttttagagatgattttaaaattttagttagtgatactcaaatgtatcgccaagcgggaaacagtattgttgttgatgtattaatcgctatattaaaacaaatggatattacgctttatggagagtaaaatgccggattttcaaagaattactattgaaaacatagagtattttattgtcgatagtattcaaaatttacgtgcggaagatagttttattcacaggaataacaagttatctgtttttggtggtaatggggaagcacgcaaatatgtaggtagttatattgatgatagtggtcgaaaactaagtacattttttgagtatgaaaattgggggattactgagacaaaaaatggaaggagggtagaatatcctttcattcagaaaaattgttttttttataagaaaaatttacagcgttatttggttgatgcaaaagttgaatatcacaaacaagaacagaaatatcatcatgatatttcaaggttttatgatgattacgttttaagtattaataatctgcctacagaaaatattttcttttcaatccatgatgtatcagaccatttggaaaattctaaaggttaccgtaggggttatatccgttcggaggatgatatatggtcaatttggcgtaagattgtattgcccaaaattagttatttatcaattcttaaactattgcctgtcaaagatatagaagattcagaaccattattttatttccgaatatttttggattatcaatttcgctctatcgtgcacccgcaactcttatcaagagaaaaattagaaataccggcttcagaatttaatcaattcgtagagcaagaaatcattaaacagaaaagtagaaaagggcagcagaaatatcgcaaggatgttataaatcatatgtcgcaatgtccatttacattaattacagatgagattttgttaagggctagtcatattaaaccttatatggtttgtattactgagaaaaatgagaaagaggcattagattatttaaatgggttagctttaacgccgacttatgattggttgttcgatcaaggttatattactttcttggatgatggtcgtttgatttgcggtactcgactaagccgttacacatgggaaaaacttaatatcaatccaaatgcaaaaaattaagatgagaatatatcccgaaggaagagaaaaatatttggaatatcatcgcaaatttgtgtttcaggacaatatcgatgatttcttgtaactaagtttattaattttactcaaaacaaaggaaaccgaatatgaccatcatcgtaacaggcgcggccggctttatcggcagcaacatcgtcaaagcacttaatcaacgcggtattactgacattgttgccgtcgataatttgagcaaaggcgaaaaattcaaaaaccttgccgagtgcgaaatcgcccattatctcgacaaacacgaattcatccgccaagtgagggaacacattttaccttatcaaaacatcgaagccgttttccatcaaggcgcgtgttccgatacgatgaaccacgacggtttgtatatgatggacaacaactaccagtacacgctggatttgctggactggtgtcaggacgaacgcatccccttcctttatgcctccagtgcggcggtttacggcaaaggagaaatcttccgcgaagagcgcgaactcgaaaaaccgctcaacgtgtacggctactccaaattcctgttcgaccaagtattgcgtcgccgcatgaaagaaggtctcaccgcccaagtcgtcggcttccgctacttcaatgtttacggacaacacgaacaacacaaaggccgcatggcatccgtcgccttccaccacttccaccaataccgcgaacacggttacgtcaacctgttcggcagtaacgacggctacggcaacggcgaacaaacccgcgacttcgtcagcgtcgaagacgttgccaaagtcaacctctacttcttcgaccatcccgaactttccggcatctacaacctcggtaccggccgcagccaacagttcaacgaactcgccgccgccaccgtcaacgcatgccgcgccgccgaaggcaaacctgaaatgagcttgaaagagttggtagaagaagaacttatccgctacattcccttccccgacgcgctcaaaggcaaataccaaagcttcacccaagccgacatcaccaaattgcgcgaagccggatataaggaagaatttttcgatgtcaaatcaggcgtcgaccgctacgtcaaatggatgctggaaaatttggcttaatttgaatgcccgtaaaaaaatcgtctgaaaatatcaggcgattttgatttgtttaacttttatatggatttcgatgatgaccgaaatgcaacaacgcgcccaactgcaccgccaaatttggaaaattgccgacgaagtacgcggcgcggtggatggctgggactttaaacaatacgttctcggcacacttttctaccgctttatcagcgaaaacttcaccgactatatgcaggcaggcgacagcagtattgattacgccgctatgccggacagcatcatcacgcccgaaatcaaagacgatgccgtcaaagttaaaggctatttcatctaccccggccagcttttttgcaatattgccgccgaagcccatcaaaacgaagagctcaacaccaagctgaaagaaatttttaccgcgattgaaagctccgcctccggctatccgtccgaacaggacatcaaaggcctgtttgacgacttcgacaccaccagcagccggctcggcagcactgttgccgacaagaacaaacgccttgccgccgtcctcaaaggcgtggcggaactcgatttcggcaattttgaaaaccaccacatcgaccttttcggcgatgcctacgaatacctgatttccaactacgctgccaacgcaggcaaatccggcggcgaatttttcaccccgcaaagcgtatccaagctgattgcgcggctggcggtgcacggacaggagaaagtcaacaaaatctacgacccagcttgcggctcgggcagtctgctcttgcaggcgaaaaaacagtttgacgagcacatcatcgaagaaggcttcttcgggcaggaaatcaaccacaccacctacaacctcgcccgcatgaacatgttcctgcacaacgtcaattacaaccaattccacatcgaattgggcgacacactgaccaacccaaagctcaaagacagcaaaccctttgatgccatcgtttccaatccgccttattccatcaactggataggcagcgacgaccccaccttaatcaacgacgaccgctttgcccccgcaggcgtacttgccccgaaatccaaagccgattttgccttcatcctgcacgcactgaactacctttccggcagaggccgcgccgccatcgtctcattccccggcattttctatcgcggcggcgcagaacagaaaatccgccaatatctggtggagggcaactacgtggaaaccgtgattgcccttgcgcccaatctcttttacggcaccggcatcgccgtcaatatcctggttttgtccaaacacaaagacaataccgacatccaattcatcgacgcaagcggcttctttaaaaaagaaaccaacaacaacgtcttaatcgaagaacacattgctgaaatcgtcaaactcttcgccgataaagccgatgtgccgcatatcgcccaaaacgctgcccagcaaaccgtcaaagacaacggctacaacctcgccgtcagcagctatgtcgaagccgaagacacacgcgaaattatcgacatcaaacagctcaacgccgaaatcggcgaaaccgtcgccaaaatcgaacggctgcggcgtgaaattgacgaagtgattgcagagattgaagcatgagcatcatcctatacaccgccaacgacggcactgcccaatttgccttgcaggaatttggcggacagctttggctgacgcaggcggacatggcagaactgtaccaaaccaccaaacaaaatatcagcaaacacattaaaaccattcttgcagagcaagaattggaagagaaggcaactgtcaacttccagttgacagttcaaaatgaaaacgggcgcaaggtaaaccgcaaaatcgcccattattccctgcccatgattattgccgtcggctaccgcgtccgttccgcgcggggcatccaattccgccaatgggcaaccgaacggctggacgaatatctgaccaaaggctttgccatagacgacgaacgcctgaaaggcacaggcggcggcgactattggaaagaactgctcaaccgcattcgcgacatccgcagcagcgaaaaagccctataccggcaagtgcttgatttatatgccaccagccaagactacaaccccaaaagcagcgaaagccaaaccttttttgccgccgttcaaaacaaactgcactatgccgccagccggcaaaccgcagctgagctgatatacagccgtgccgacagcagcaaagactttatggggctgaccacctttcaaggcgcaatccccacgctgaatgaagccaaaatcgccaaaaactatctgaccgaagacgaactgttccgcctgaaccgtctggtttccgccttcttcgacctagcggaaatcaaagcgcaggagcaaagccccatgtatatgcgcgactggatagccgaattggacaaattttccgggctgtacggacaaggcacattacagggtgcaggcagcatcagccgcaaacaggcagagcagaaagccgaacgcgaataccgcgcctatgaagcgcgcatcctgtcgccggtggagcaagcctatctggaaagcgttaaagcgttggaaaaaacagccgtgcaacagatcaaacagaaaaaagaccgcacaaaataactaccattcaggctacctgaaaaagcagcctgcacaccattgcaggcagcctgaaagcaggacggacttcagcccgcagaaataacggcaaacggacagagtgagccgaagcaccccgcaactgccccacatcccgccgcaacgggaaagaaacggaaaacaaccatggatatgcaaaacaaagcgaaaaaattgattgagatgattcagacggcaccggtggagtggaagccgttgggggaagtggcgaaagtattaagaggaaaacgtttgacaaagaaagagctaattgaaggtgggaaatatccggtttttcatggcggattgattcctcttggttggtttgaccagtttaatcgtagagctaatcaaacgatgattattaatacgggaagtattggtgaagttatatggagtggcgtagatttctggtcatctgatggtacttttgtgattcaaacaccaaactatcttgatgataagtttatattctactttttaaaaacaagagaaggatatataaaatcccaaaagagagttggtggagttcctactattgatagattagtagttgaaaatatttcgatccccatcccacccctggaaacccaacaaaaaattgtaaaaatacttgacaaattcacagagctgtaagctacgctggaagctacgctggaagcggaattaaccctgcgcaaacgccaataccggtattaccgcgactttcttttagattttaacaatcaaatcgggggggatagctgatggctataaaggccgtctgaaagatgtggtttggaagacgttgggggaggtatttaatatttttgctggaggcgacgtaccaaaagacgctttctctgaagtggaaacggaagaattttgtatccccattttatctaatggtataggaagtaaggcactatatggctggactaatgttgctaaaatcaatcaacctagcttaactatatcagctagaggaactataggttgggctagctttcagaataaaccttttttcccaatagtacgcctgttagtgttaacaccaaaaattgaattaaacctaaaatatgcctactactttatgaaaagtattgaatcaaattataaagttcctgaaagcggtattccacagctaacgaaaccaatgataaaagatatttcaatccccatccctccactccccgaacaggaaaaaatcgtcgccatcctcgacaaattcgacaccctgacccactccatcagcgagggcctaccgtacgaaattgccctgcgccggaaacaatacgaatattaccgcgggcagttgttgagcttcccaaaggctgcctgaaaagtcatagctggtctttaaatcatgccgtctgaaaaatattgataaggaaatatcatgggaaaaagtttaaccgaaattgctgaggaactaaaaggaaacgataaaaaagtccagctaatctatgcttttaacggaacagggaaaacacgtttgtccagagagtttaagaatttaattgctccaaccagttcagaagagccagacggagagccaacaagaagaaaatttctctactataatgcatttactgaggatttattcttttgggacaatgatttgttagcgaacgaagctccaagattaaaaattcaaaagaatagttttaccgactggttgcttagggataatggactggatggagctgttattaaaaactttcaatattatacagatgataagttgactcctgattttaatgatgatttttcagaaattgcattttattttgctcgtggtaatgatgagcagattgaaaatatcaaaatttccaaaggtgaagaaagtaattttatttggagcattttctatgtattaatcagacaagtcatcgctgaattgaatattccagaagatagcgaagaaggacgttccacagatcagtttgacgatttggaatatatttttattgatgaccctgtcagctctttggatgaaaatcatctgattcagcaagcggttgatttggctgatttgataaagcttagcaaaccgaggttaaagtttatcattactacacataatgttttattttacaacgttctatacaatgaactaaaaaaattagaaaaggaaaagaaaagttatcttctgttaaaaaatgaagatggtagttttgatattcttgaaaaacaaggtgattccaataaaagtttttcatatcaccttcacttaaaaggagttattgaaaaagctatcgagaatcagcaggtagaacggtttcattttatgttgctgagaaacctgtatgaaaaaacagctaattttttaggctataagcaaaggtctgatattttgcccgaagacagcagacgaaactattttcaacgtattattaactttacaagtcattctacattatctaatgaggcatttgccgagccaacaccacaagaacaagaaactgtcaaattgcttttgcaacacttgctggataactataatttttttcaagatgatgaacaaagagataagccatgaacctcgaaaccaaacccatcgctgaaacgccgaatttcatcgtgctcgaccaatatgaaaaaatcgaacagtcgggcagctaccaatcggaaaaccggttggaagcggagttaatcgccgatttgcagaatcagggttacgaataccgcaaggatttgaacagccaaagcaggctgctggaaaacctgcgcgcgcagttgcagcggctgaacgatgtggcgttttcagacggcgaatgggcgcggtttttgacggaatatctggacaggccgtctgaaaacattaccgataaaacccgcaaaatccacgacgaccatatttacgatttcgcttttgatgacggtccttggattcggatttcaagtgcaacactagtgtattagtggttggaacagattcaagaataaaacacttggcgtttcgtagccaagtgtttttcttggtcggtggttcaactcatcttgaaccctgcgtatctcccgatcactgatgttacggaaatcggtttgtttggggaagtattgccggatgagtccgttggtgttctcattcagccctttctcccaagaatggtaagggcgacaaaaataagtctccgctttcaatgctttggttattttggtgtgttggtagaactctttgccgttatccatggtaatggtgtgcaccctgtctttatgtgcctttaatgccctaacagctgcccgggcagtgtcttcggctttgaggctatccaatttgcagatgatggtgtagcgggtaacgcgttcgaccaaggtcaataatgcgcttttctgtcctttgccgacaatggtgtcggcttcccaatcgccgatacgggatttctggtcgacgatagcgggtcggttttctatgccgacacggttgggtactttgcctctggtccatgtgctgccgtagcgtttgcggtagggtttgctgcatattctgagatgttgccacaacgtgctgccgttgcttttgtcttggcgaaggtagcggtaaatggtgctgtggtggagcgtgatctggtggtgtttgcacaggtaggcgcatacttgttcgggactgagtttgcggcggataagggtgtcgatgtgctgaatcagctgcgaatcgagcttatagggttgtcgcttacgctgtttgatagtccggctttgccgctgggctttttcggcgctgtattgctgcccttgggtgcggtgccgtctgatttcgcggctgatggtgcttttgtggcggttcagctgtttggcgatttcggtgacggtgcagtggcgggacaggtattggatgtggtatcgttcgccttgggtcagttgcgtgtagctcatggcaatctttcttgcaggaaaggtcgtatgctaccgcatactggcctttttctgttagggaaagttgcacttcaaatgcgaatccgccgtcgtctgaaaaacatttatctgctggacaagaaaaaccttgcccgcaaccatgtgcaggttatcaaccagtttgagcagacgggcacgcatgcaaaccgctatgacgttaccgtgttggtaaacggcctgccgctggtgcagattgaattgaaaaagcgcggtgtggcggtgcgcgaggcattcaatcaggtgcaccgttacagcaaagagagcttcaacagcgaaaattcgctgttcaaattcctgcaaatcttcgtgatttccaacggcacggacacgcgctatttcgccaacaccaccaagcgcgacaaaaacagcttcgatttcacgatgaattgggcgcggtcggacaatcatccgattaaggatttgaaagactttaccgccacgttcctgcagaaaagcgtattgctgggcgttttgctgcattacagcgtgttcgatgcgaatgatacgctgctgattatgcggccgtatcagattgccgccgccgaacgcattttgtggaaaatcaacagctcggcgcaggcgaagaattggagcaaaccggaaagcggcggctatgtctggcacaccacgggcagcggcaaaacgctgaccagctttaaggcggcgcgtctggcgacggaatcggcatttatcgacaaggttttcttcgtggtggacaggaaggatttggactatcagacgatgaaggaataccaacgtttttcgcccgacagcgtgaacggttcggaaagcacggcaggcttgaaacgcaatttggaaaaagacgacaacaaaatcatcgttaccaccatccaaaagctgaacaacctgatgaagggcgaagataatctgccggtttaccatcagcgagttgtctttattttcgacgaatgccaccgctcgcaattcggcgaagcgcaaaaaaacctgaaaaagaaatttaaaaaattctgccagttcggctttaccggcacgccgatttttcccgaaaacgctttgggcgcggaaaccacggcgggcgtgttcgggcgggagctgcattcttatgtgattaccgatgccatccgcgatgaaaaagtattgaaattcaaagtggattacaacgacgtgcgcccgcagttcaaagccgtggaagcggaacaggacgagaagaaactgagtgccgccgaaaaccacaaagccctgctgcaccctgaacgcatccgcgaaatcacgcaatatatcctgaatcagttcaggcagaaaacgcaccggctgaatgcgggtggcaaaggctttaacgcgatgtttgccgtcagcagcgtggatgcggcgaagtgctattacgaagcgttcaaaacacaacaggcaggcagcttgcacccgctgaaagtggccaccattttttcctttgcggccaacgaagagcaaaacgccgtcggtgaaattgtcgatgagacttttgaaccggaagcgatggacagcagcgcaaaagaatttttgcaggctgccatcaacgattacaacgcctgtttcaaaaccaatttcggcacggacagcaaagcctttcaaaactactaccgagatttggcaaaacgggtgaaaaatcaggaaatagatttgctgattgtggtcggcatgtttttgacgggttttgacgcgccgacgctgaacacgttgttcgtcgataaaaacctgcgctatcacggcctgatgcaggcgttttcgcgcaccaaccgcatttacgatgccaccaaaaccttcggcaatattgtctgcttccgcgatttggagcaggcaaccattgatgcgattaccttgtttggcgacaaaaacaccaaaaacgtggtgctggaaaaaagttacgaagaatacatgaacggctataccgacagccagaccggcgaagcacggcgcggttatctggatgtggcaaaagaattgcgcgagcgtttccccgatcccgacaaaatcgaaacggaaaaagacaaaaaagattttgccaaactcttcggcgaatacctgcgggcggaaaacgtattgcagaactacgatgaatttgccgcgctgcgcgagttgcagagtgtggacgcggcggacgaagatgcgatgaaggcgtttcaagaaaaatactacctgagcgatgaagacgtgcaggaaatgcggcaagtgccgatgccgtctgaaagggcggtgcaggactaccgttccgcctacaatgacatccgcgactggctgcgccgccaaaaagcaggcgaacagaaagagcaatcaaaaatcgactgggacgatgtggtttttgaggtggatttgctcaaatcacaggaaatcaatctggattacatcctgcaactggttttcgaacaccacaaaaaaatcaaaggcaaagcggagctggtggaagaaatccgccgcatcatccgcgccagcatcggccaccgcgccaaagagggtctgattgtggatttcatcaacgatacggatttggacaaagtacccgacgttcccgccatactggaaaccttctacacctacgcgcaagaggtgatgcggcacgaagcggcaggattgattgccgccgaaggcctgaacgaaaccgccgccaaacgctatttaatcagctcgctcaaacgcggctatgccagcgaaaacggcacggaactgaccgaaaccctgccgaaaatgagtccgctcaacccgcaatatctgacgaagaaacaaagtgtttttcaaaagattgcggcgtttgtggagaagtttgccggaatagggaccgatatttgacaaaatgccgtctgaaatttcagacggcatttttgattttatgcggaggcggtttttattttgaccttgcttttcttaaacttcaacacggcttcttcttttgccgcatcccagtctatccgtacgaagccgccgtcggatagtttgccgaacaggagttcgtcggcgagcggtttgcggattttttcctgaatcaggcggtgcatcgggcgcgcgcccatttgcgggtcaaaacctttttccgccagatatttgtgcaatgccgacgtgaattcggcttcgacttttttgtcgaggagccggtgttcgagctggagcaggaatttgtccacgactttggtgatgacgggttcggataagggcgcaaacgggataatcgcatccaagcggttgcggaactcgggcgtgaagagcttgttgatagcctgcatttcgtcgccgcgctcgcgtttggcggtaaagccgaggctgggtcggctgagactctccgcacctgcgttagtggtcataattaggatgacgttgcggaaatcggcactcttgccgttgttgtcggtcagtttgcctgcgtccatgacttgcaggaggacgttgaaaatgtcggggtgggctttttcgatttcgtccaagagcaatacgcaatgcggctgtttgttgatggcttcggtcaaaaggccgccttgttcaaagccgacgtagcccggtggtgcgccgatgaggcgcgatacggcgtggcgttccatatattcggacatatcaaagcgttgcagcggtacgcccatcgagtaggcaagctgtttggcgacttcggttttgccgacgccagtcggaccggagaagaggaaactgcctatcggtttgtcgggcagggcaaggccggaacgcgacattttgacggcagcaaccaacgcgtcgatggcgttttcctgaccgtaaaccatgtttttcaaatcgcggccgaggaattgcagcacctgtttgtcgtcgtgcgacacggttttttctggaatccgcgcgactttggcgatgacggtttcgatttgcgctttgccgatgacttttttctgtttggatttgggcagaatccgttgctccgcgcctgcttcgtccatcacgtcgatggctttgtcgggcaggaaacgctcgttgatgtagcgtgcggagagttcggcggcggcttcgagtgcgccttgagtgtagcggacttggtggaaggcttcaaacatcggtttcaagccgcgcaggatttgaacggtttcggaaacggtgggttcgaccacgtcgattttttggaagcggcggcttaaggcatggtctttgtcgaaaatggtgcggtattcgtcgtaggtggtcgcgccgatgcagcgcagcgaaccttttgccagcgcgggtttgagcaggttggacgcgtccatggtgccgccgctggtgctgcccgcgccgatgatggtgtggatttcgtcgataaacaaaatggcgtgcgggattttttcgagctgtttcaagacggatttgacccgcgcttcaaagtcgccgcggtatttcgtgcccgccaacagcgagcccatatccagcgcgtacacttcggcatctttaagcgcgtctggaatgccgccgttgacgatttgatgtgccaaaccttccgccagcgcggttttgcccacgcccgcttcgccgaccaaaagcggattgtttttgcggcggcggcataggatttgcaccagccgttccatttcgtgtttgcgaccaatcaaagggtcgatacggccggctttgacttcggcgttgaggttgacggtgtacgccgataaagggtttttgcccggtttggtgcggtttccattatcgtcgtccatgccgtctgaagaatagttgccatcgtcttcatcttcatcttcatcttcatcttcatcgggagagccgtgggcaatacagcgcaaaacttcaaaacgcgtaaccgattgcagcttgaggaaatagacggtgtggctgtcggtttcgctcatcagcgcgaccaaaacgtccaacggttcgactgcggcttttccggcagactgggtatgcaccatcgcccgttgcatcacgcgttggaagccgagcgtgggccgggtttcgaccgtgtctaaaaggtgttcgggaatcaggggggtgttttcggcaacgctggcggcgagctgttcggacaccactttcaaatccgcgccgcagagcttgaggacgttgtggacggaggcatcttcttcgatgagtaccaaaagcagatgctcgaggctgataaattcataatgagccttacgcgcctcgcggtaaagctgctgcaaaatctgttccaattcgggtgcaagcatattaaatctcctcgacaatacattgcagcggatgcccttcggcttttgcccgctgcatgacttgttgttgtttggtttgggcaatatcgcgcgtgtaagtgccgcacaggcctttgccttcgtgatgaaccaagagcattaccgctaccgcctgttcttgtccgagcataaagatttcggtcaggatttcgacgacaaattccatcgtggtgtaatcgtcgttcaataggaaaacgccgtaacgtttcggcggcagggtgttcagacggtgcaagagcgtgtcggattggtgttgcgcggtcatagtgtgtcccatttgaaagccgcgttcagacggcatttttgttgtattttcggtacttttgcctattttcccacttttttgaaaacatagcttgacgttttgtcttaacaaatgtaaaaagacggttaagcaggattgggcatccgccgagtatatcaagctggaaggaacgccagacggctcggtttgccgtatgccttgttttgctgattttgttaatttttgagtataggaagtttctaatggcaaccggtatcgtaaaatggtttaacgacgctaaaggttttggtttcatcacgcctgatgaaggcggcgaagatttgttcgctcacttctcagcaatcaatatggaaggtttcaaaaccctgaaagaaggccaacgcgtctctttcgacgtaaccaccggccctaaaggcaaacaggccgccaacattcaggctgcttaattcctgatgtacggtcaaatgtatatttgaaaacggcgggacaggcaatgtcccgccgtttttgtctgccgttttgccggcggcggaaaaaccccaatccccgcacgccttatcctgaacttgtgtgtaccctgttgtggacaagtggcttagtattttgacggataagggaaaatcagtgctgatgaaaaaatgtgcaatgttgtcggcaaaaggcggtgcggcataaaacggcaaacgggtaggcacggggcaaaacgtgctgccttcgtcttcagacggcatcggcagggcgttcagcttccggcaaccgtcatccccgcaatcagaatcgagccgattttgttggacgaacgccgcaaagcgtcatccgccacgccgacaatgtcgcggtacatatcctgcaagcgtccggctacggtaatctcgtggacggggtaggcaatcacgccgttttccacccaaaaacccgccgcgccgcgcgagtagtcaccggtaatggtgttcgcgccctgtcccatcagttcggttaccaacaatcccgtccccatttctttcagcaggtcggattgcgtttcgtgcgtatggttcaaatacaggttgtgcgcgccgccggcgttgcccgtggtctgcataccgagtttgcgcgcgctgtaactgctgaggaaatagccttcgacaatgccgttttgaatcacgaagcgcggtgcggtggcaacgccttccgcatcaaaatagctgctgcggaaagagcgggggatgtgcggttcttcgcgcaggttgaggaaatcgggcaggacttttttgccgatgctgtcgatcaggaaactgctttggcggtagagcgcgccgccggagagtgcgccgacgaggtgtccgataagaccgcccgaaacggtggtatcgaagaggacggggtagctgcctgtcgggatgctgcggctgccgagtcggcgcaaagtgcggcgggcggcggtttgaccgatggtttcggggctgtccatatccggatggcggcaggcggaatcgtaccagtagtcgcgctgcatgccgttttcgtcggcggcaacgacgctgcaggaaatgctgtggtgcgtgccttgccggtgtgcggcaaaaccgtgggtgttgccgtaaacgtattggtaatggccggtttgcaccgccgcgccttcggagttttcgatgcgctcatcctcgttcagggcggcttgttcgcattgttttgccaagccgacggcggcttccgtatccaaatcccattcgtggtaaaggtcggggtcgccgatgtgttttgccatcagacaggcatcggcaagtccggcgcaaccgtcttcggcggtgtggcgggcgatgtcgatggcggctttgacggtgtcttgcagggctttttcggagaagtcggcagtactggcgcggcctttgcgtttgccgacgtaaacggtaatgtccagcgacttgtcctgctggaactcgatttgttcgatttcgcccagccgcacgctgacgctttgtcccaatgattcgctgaaatcggcttcggcggcggttgcgcccgtcgcttttgccaagtcgagcgtgcggcggcagaggtcgaggagttcggaagcggtgtggttgaacagcatagaaatctttcttgatgatgctttgcggcattttaaccgtttcgggcggcaggggcaaaagcgcgccgtttgcagggcggacggtgcaaaatgccgtctgaacgcggcggcattctgttaaaatgcgctattggaaaaattcgagaatcaagatgtttgaacaagaagacgaatggatcagcaaaacccaaatgaaaaagcagatgaacgatttgcaggatttgggtatggcgttgaccaagctctcaaacgatacgctgaaaaaaatcggtttggatgcggatttgtacgaggcggtaaccgcctataaaaaaatcacatccaacggcgcgctcaaacgccaggcacaatttatcggcaggctgatgcgcgataccgatcccgcgcccatcgaggcgtttcttgccaagctgcgcggcgacgatgcggcgcacaacgcctttttgcaacgcgtggaacaggcgcgcgtacggctgttggcagacgacggcgcgttgacgcagtttatgtcggattttccgcatgcggacgcgggcaagctgaggacactcatccgcaataccaaaaaagagcaggagcaaaacaaaccaccaaaaaatttccgcgccctgtttcaagagttgaaaaccgtgatggaaaacggggacgcggaaatttaggcatattttcagacgacatccgccgttatttagattggaggataaaatgttgttccgtaaaacgaccgccgccgttttggcggcaaccttgatgctgaacggctgtacgttgatgttgtggggaatgaacaacccggtcagcgaaacaatcacccgcaaacacgttgacaaagaccaaatccgcgccttcggtgtggttgccgaagacaatgcccaattggaaaagggcagcctggtgatgatgggcggaaaatactggttcgtcgtcaatcccgaagattcggcgaagctgacgggcattttgaaggcagggctggacaaacccttccaaatagttgaggataccccgagctatgctcgccaccaagccctgccggtcaaactcgaatcgcctggcagccagaatttcagtaccgaaggcctttgcctgcgctacgataccgacaagcctgccgacatcgccaagctgaaacagctcgggtttgaagcggtcaaactcgacaatcggaccatttacacgcgctgcgtatccgccaaaggcaaatactacgccacaccgcaaaaactgaacgccgattaccattttgagcaaagtgtgcctgccgatatttattacacggttactgaagaacataccgacaaatccaagctgtttgcaaatatcttatatacgcccccctttttgatactggatgcggcgggcgcggtactggccttgcctgcggcggctctgggtgcggtcgtggatgccgcccgcaaatgaacagcaatgccgtctgaaaagctttcagacggcattttaagcacacacgcacagtaaaaccccacgttatgtcagtcaaaatccaaacccgatccgtcaataccgacgtttttaatcatttgctcaccgccggtgccgatcctttaatcgcccagctttgtgcttcgcgcggtgtgcaaagtcctgccgaattggacgacaaactcgcttccctcctgccttatcaatcgttgacgaattgcgaagccgccgcccgccgtttggcggatgcggttgggcgcaaggaaaaaatcctgattgttgccgactatgatgccgacggtgcgacggcgtgtgccgtcggtatgagcggtttggcggcgatgggggcgaaagtggatttccttgtgcccaaccgctttgaacacggctacggcttaacgcccgaacttgccgaaatcgctgccgcgcagggcgtggatttgctgattacggtggataacggtatcgccagcatcgcaggcgtggcgagggcgcaggctctgggtttggatgtcatcgttactgaccaccacttgccggccgagaccgtgcccgactgcatcatcgtcaatccgaaccaaaaaggctgcggttttccaagcaaaagcttggcgggcgtgggcgtgattttttatgtattgatggcgttgcgtgccgaattgcgccgccgcaattatttttcagacggcatcaaagagccgaatttgggcgaacttttggatttggtcgcactcggcacggttgccgatgtcgtccctctcgaccacaacaaccgcatcctcgtgtcgcaaggtttgaaacggatgcgctccggcaaaatgcgccccggtatccgcgccttgtttgaagtggcgcggcgcgattggcgcaaggcgcagccgtttgatatgggttttgcgttgggcccgcgcatcaacgccgccggacggctggacgatatgtcggtcggcatcgcctgcctgttggcgcgagatgattccgaagctcaggaactggcggctcagttaaacaacctcaatatcgagcgccgcgaaatcgagcagtctatgctgcaagacgcactgaatgatttccccgaaaccctgccttcaggtcagatgactttggtggcgtatcgcgacgacttccatcaaggtgtggtcggcattgtcgccagccgcctcaaagaccgtttttatcgtccgaccatcgtgtttgcgcctgccgacaacggcgaagtacgcggttcgggacgttccattcccaatttgcacctgcgcgatgctttggacttggtgtccaaacgccatcccgatttgattttgaaattcggcggacacgcgatggcggcgggtttgagcatacttgaacacaacattcccgcgtttcagacgacctttgaagaagccgtgcgcgaaatggtgtgcgaagacgatttgtcgcaaaccttcatcaccgacggcagcctgcccgcctgcgacatcacgttggaacaggcgcaaaaccttgcccgtcacgtttgggggcagggcttcgcgccgccgagctttaccgacgagttccacgtcgtccgccagcaacctttgggcgcggagggcaaacacaaaaaagtctggctgcaaaaagacggctgcgaatttgaagcgatgttttggcgttgcagcgaagacattcccgaatacatccgcacggtttaccgccccgttgccaacgaatggcgcaacaatctcgaattgcagctgtatatcgattactgggaagccgcgtagaggcggcggaacactgtttgaatgtgatttctgttccttcatttgcctgtttgtacgacgggaatgttcccaatcggagaaggcgcatcaaatttcagactctgccacaaaagcagggtctgatttttttggagggcaatctgttataatgacgcgttgccgccgcgagggcggcgtgattcggacggcgtagtttctacgccttttgtttatggttacggcatcttgcaaaccgcgcctgatgccgtctgaacacggttgcctgtggagatgccgctcttcgggtcagaatatttatgctgaaaaaatggttgaataagatgctgccttccggtcggagcagtaaaaaagcggaaagtaaaacggtcattcctgccgaaagacacaacatccgtgccgaaatgttgagctttgccgccgaaaacgtcatacgccgcctgaaagggacggggtttcaggcttatgtggtcggcggcgcggtcagggacctgctgctcggcatcgaacccaaagatttcgatgtcgcaaccgatgccacgcccgaacaggtgcacaaactcttccgccgcagccgcatcatcggcaggcgttttcagattgtccatgtgatgaacggtgcagagactatcgaagtaacgacgtttcgcggcggtgcgaaagtacatcagaatgcacgcggcaggattatgaaagacaatacctatggcagcatcgaagaagatgcgatgcggcgcgattttacctgcaatgccttgtattacgatcctgaaaaagaagagattttggatttccacaacgggattgccgatgttgccgcccacaggctggttatgattggcgatgccgccgaacgctatcaggaagaccctgtcaggattttgcgcgccatccgcctgtcgggcaaattgggctttgagctgtcggaagaaaccgccgcaccgattgccgaatcgatatgccgtctgaagcacgaaccggtagcgaggctgttcgacgaaattatgaaattgctgttttcagggcacgctcgcgagtgtctaaaacgtttgaacggatttgacataccggacgacatccatctgctgctcaatgccttgcgcgtttcagacggcatcgccggaaaaatgacggtgcttgccctgaaaaataccgatgagcggctgcgtgccgacaaatcggtttcggtcggttttgtattggcggctctgatgtggcccgagttggaacgccattggaaaagcaatctgcaacagggtttgaaacccgcgcccgccctgtccgatgcaatcaatacgatgcgcgaaaccgtcgaacgcggttggggcgtgccgcaacgcttttccgccacgatgcgcgaaatttggatgttccagccgcagtttgaaaaccgcaaaggcgcaaggccgcacaaactgtttgcacaggcgcgtttccgtgccgcctatgatttcctgctcttgcgcgccgaaaccggcaatgcggaccgcgcccttgccgagtggtggacggcgtttcagacggcatcgacggaacagcggtcggagatgaccaaaaacgaagccgccgcccgacacgaaaaaaacgaaggacaggcgaaaaaacgccgccgtcgcaggcgcaaacccaagccgaaggttgtgggaacggattgggaataagggtcaacagacatggagcaatgaagtttcaacacatgggatgaagcataaagtgccgttctatgcattatcctgatttgtaaggggattcatccccgtaaataaagtctaaccctgcctctcggaaaaaggatgtccgggtgggcagggttcaagcaacaaggaaaaattgatgaaaaaatgtattttgggcattttgaccgcgtgtgccgccatgcctgcatttgccgacagaatcggcgatttggaagcacgtctggcgcagttggaacaccgtgtcgccgtattggaaagcggcggcaataccgtcaaaatcgaccttttcggttcaaattccaccatgtatgtatgcagcgttacgccttttcagaagacgtttgaggcaagcgatcggaatgaaggcgtggcgcggcagaaagtgcgtcaggcgtgcaaccgcgaaacttcggcaatgttttgcgaagatgaggcaatccgatgcagaaaattcgattgatgtatcggttggacggataaagaaacggatacggatacggagcttggcttccgtatctgtttttctctgcctgattttccatgcatcgggtttcagacggcattggaatgtcagtcgtgttctgccgattcgtaggcttcgacgattttttgcaccaaaggatgccggacaacgtcttcgccggtaaaggtgtggaaatacagcccttccacgttgtgcagtttctcacgcgcatcttttaatcccgatttgatgtttttgggcaggtcgatttggctggtgtcgccggtaatgacggctttcgcgccgaagccgatgcgggtcaggaacattttcatttgttcgggcgtggtgttttgcgcttcgtcgaggatgatgtatgcgccgttgagcgtcctgccgcgcatataggcgagcggggcgatttcaatcaggcctttttcaatcagcttggttacacggtcaaagcccatcaggtcatagagggcatcataaagcggacgaaggtagggatcgactttctgggtcaggtctccgggcaggaagcccagtttctcgccggcttcgacggctgggcgcactaaaatgatgcgttcgacttggtgtttttccatcgcatcgacggcggcggcaacggcgagataggttttgcccgtacctgccggcccgagaccgaatacgatgtcgtggttgagcagggcgcggatatagccgttttgccgtggcgttctgccgccgatgctgccgcgcttggtgcggaaataataggcgtggtcatggtttttttcttgatgaccggcatcttcggtttgggcttcgacggcggcaagcctgatgtcgccgtcgtttaggtcgcgcgtctgcgccgtttccaagagtttgagcagtgcgcgtttgccggcgtgtgcaaatgcgccgttgaaagtgaaatgttcaaaacggcggctgatgtggatatcgagtgctttggcaagtaaatcaaggttgttgtcaaaagaaccgcacagacgctgcaacgccaagttgtcggtttcttctaaatgcaggtggacggtatgtgtcatatgaaggtccgaatagttggatattgtgtgattttaatctatagtggattagatttaaaccagtacggcgttgcctcgccttagctcaaagagaacgattctctaaggtgctgaagcaccaagtgaatcggttccgtactatttgtactgtctgcggcttcgtcgccttgtcctgatttttgttaatccactatatttcaccggtattttcttaccgtattctgcgattgcctgtcggaaaatgccgatcaacctgcctataacggcattttcgccaaattcgttcagacagttttctctaagtcgggcaggttcgaaatcagagtggtgttcacacattttgatgagtgcgtcggcaagggcatcgtcgtcgtcaacaggaaccaaatatccgttgccgtctgaaacaatagattccgcaccgccgcagcgtgttgcaatgacgggcaatccttgggacagtgcttcgatatagactacgccgaaggtttctgtgcggctggcaaggacgaatgcgtcgctgttcctcatcaaatccaagactgcttcgggctgcaatgcgcccaaaaatgtaacggcatgggtaatgcccaagtctgccgcctgctgtttcagccgctgttcttcctgtccgctgccgccgatgttcaggcgcagttgcgggcattgtgccaacgcccgggcaaaggcagtgagtaggacatcgtgtcctttgagacggcgaaggtgcgagacggtgcagaacacgaaatgcggtttgttgttttttttctctttgttcaaacggtcggttgaatattccgcccagtatgttgggggaggtactgccattcgcagccgtatttgtgttgcaggacgtgtgcgaaatggcggctgacggcgagacgtgcggcggcgtgtgccgccgcatttttcataggctgccattggtgcgggcgcaccaaaccgcgcgtaatggtgctgctgtgttccgtgacgacataggggatgccgtatttttgggaaatcttgaaggcaagtatgccggcatagttcatacagtgggcgtgaatcaggtcgggcagcccgttttcgcggatgtagtgtttgaaagctttcaaacccgcacacacccagcggatgcggtcgatgtcgatgaacggaaagcgggggaagaaatacatgccgtgccatgcatagatgtccaaaccgctttgccgatatagtggattaacaaaaatcaggacaaggcgacgaagccgcagacagtacagatagtacggcaaggcgaggcaacgctgtactggtttaaatttaatccactatattttgcaaaaccgtaagggtcggtcaggatgcttgctgtttctttccgcaagtagcggaacatcggtgcaagcacggcggttttgatgcctttcctctgcaatgccagtgcctgattttgaaaaaaatcccgtccacatcctgttcggattgcggataccatgaggggatgacgaggacgtgcaagggttcgggcatagtgggattccgtatcggaaaggcggttattataagacagacgcagaccgaatatttaaattgttgccttacgctaatgcaatttggcgcgccggtgtgttagattggcagttttatcggtaaggaggcggatatgttgcgtcttgttttggcggcttcgctgtcggcggtatcttttccggcagcggctgaagcattgaattacaatattgtcgaattttccgaatcggcgggtgtcgaggtggctcaggatacaatgtccgcacgtttccaagtgacggcggaaggacgggacaaaaatgccgtcaatgctgagtttgttaaaaaattcaacaagttcatcagaaaatcgaaaaatggtagctttaaaaccgaattggtatcgcgcagtgcgatgccgcgctatcaatataccaacggcagacgcattcaaacaggctgggaggagcgtgcggaatttaaggtcgaaggtagagattttgatgagttaaaccgttttattgccgatattcaagcagatgccgcgttggaatatacggatttccatgtgtcgcgcgaacgccgcaacgaggtcatcgatcaggtcagcaaggatgccgttttgcgtttcaaggcgcgtgccgaaaagttggcgggcgttttgggtgcgtccggttataaaatcgtcaaattgaatttgggacacatcggcagccatatcgcgggagggggagctgctcaggcaaaaatgcttcgtgccatgccgatggcggcaagcgtcaatatggagggtgcggattccgccgcgcctggtgtggaggaaatcagcatcagcgtcaatgggacggttcagttctgatttgaggtgaacggcaaatgccgtctgaaacccgacgataagggttcagacggcatttatatttcaggctttgggcagggtaacgccggtttgccccatatatttgccgttgcggtctttgtatgaggtttcgcagatttcgtcgctctcgaagaagaggacttgcgccacgccttcgcctgcgtagattttggcgggcaggggggtggtgttggaaaattcgagggtaacgtagccttcccattccggttcgaacggggtaacgttgacgataatgccgcagcgggcgtaggtggatttgcccaagcagacggtcaggacgttgcgcgggatgcggaaatattcgaccgtgcgcgccagtgcgaaggaattgggcgggatgatgcagcagtcgtcttcaacggtaacgaagtttttcgggtcgaagtttttgggatcgacgatggtgctgttgatgttggtgaagattttaaattcgtttgcgcagcggatgtcgtagccgtagctggacgtaccgtaggagatgatgcgtttgccgtcggcttctttgatttggttcggctcgaaagggtcgatcatgccgaattcttcgctcattcggcgtatccatttgtcggacttgatgctcataatgttttccttgtttcttgcagtgttcggacaaagcattgggggatgccgtctgaaaacggggcttatttgtttttgggcagtttcacttctttaatcatgccgttttcgcatttcataatgaagagggtttcgccgttttgcgagacggtaaatctgccgtgtgccaagccttttttgaacgtgcccgagagtaccatgttgcggaatttggtactgtcggaattgaacggttcgataaatatttcgcggttggcggcaacggtataaacgccttgcccgtcgaatttgccgtttttaaacgaaccggtatagttgcgcccgtcttggcagcgccatgtgcctttgccggcgggtttaccgtctttgccgacattgccgtcgtaggtgcagcctggttcttgataggaagtcaggacggcggccgaagtggggagggcgaacatcatggcgggcagtaggaatgcgagatgtttaagcataagggttattccattggattttggttgacggtattttgtcgtgaaaaagccgtctgaaaaatcaatcttgccagccgcccaaataggaaaccagttcttccaacatggtgctgacggattccgccatcagaatttgcgaggcgaaggcaaggccggcggcatcgtcgccgttgctttcggcttcttcctgcaatacgtcgaggtattggatgcgcttgagtgtgaagtcttgagtgaggataaaggcaatttgttcgcgccacaccaagcccagttgggtaacggttttaccgtttttgacgtgttgaaccacttcgtcggcggttaaatcttgtttggatactttgacgacgggaacaatatcgcccgtacctttgagttcgcaatcgctgtctaattcaaaaccgccttcgcaatgcccttgcaacagccagccggtcatcaaggaagagggcgattgcttggtattcggcagcgaggcttccaaaccgcccaaagcttcgcgcagcttggtcaggatgttttctgctttggcggaagccgcgttattgacgagcaggtagccgtggcgggtgttaaacaccgcttctgtacggctgctgcgggtaaacgctcggggcagcaggtcgtctgtaatttgctctttaagctcttgtttttctttacggccgacattgcgggcttcattgttttggatttccgctaccttctcttccaaaatatcgcggatgacgccggcaggcaggactttttcttcttttttcagggcgacgcgcaaggtaaagtcggcagggaaaacgagttcaggggagaatgaaaccggtgcggtaaagccttcgctgaaccagtctaagccttggcaatgggtaaattcagcttcagcaagtttgtcggcaagtacgtctgcctcaggcagcttttctttgttgagcggataaaaactaatctgcttgaaccacataatgtttcctattgtttgaaatgtcgggaattatttgctgaattgttttttcacactgactttggttttcttcttgaagcggtttttctcttcctttcggccttcgcgtttctcaatacggttgctcaggctgacgcggcgcagcggttttttcttcggtttgtcttccgcattttcatacgggttttccgaaacattgtattgaattctgagcggcgtgccttgcagattgaaggctttgcggaacgtttgggtcagatagcgcgtatagctgtcggaaatcgcgtgcagcgaattgccgtgtaccacaattacgggagggttcatgccgccttggtgggcataacgcattttcggacgcaccaagccggcacgcggcggttgctgacgctcgatcgcgctttgtaatacgcgcgtgattttcggcgtcggcatcttaatcatcgccgcgttgtaggcagcctgaatgctgtcaaacaaaccgtctataccgcgctctttcaatgcggaaataaagtggaacttggcaaaatcgaggaaatacagtttgcggttgatatcgcgtttcacttgctcgcgacgttcttcgctgatgccgtcccatttattgaccgccaccaccaaagcacggcctgcctccaaagcgaaacctgcaatcgtcgcatcttggtcggcgatgtcctgctgcgcgtccaataccaaaacagcgacgtttgccgcttcaaccgcctgcatcgctttgataacggagaatttttccactgcttcatccactttgccgcgacggcgcacacctgcggtatcgatgatggtaaacggtttgccttcgcgctcgaaatcgatatggatactgtcgcgcgtcgtacctgccatatcgaaggtgatgacgcgctcttcgccgagaatggcgttaaccagcgtagatttgccgacgtttggacgaccgataacggcaaaaacaggatgtcttgcatcggcttcttcggcttccggctcggggaatttttccaaaatatcttcaatcagataatacacaccatcgccgtgtgcacctgaaataacataagggtcgcccaaagcaagttcgtagaactcggcggcaagtacagccctattgcccccctcgcctttattcacggccaaataaacagggcgcggactttggcgcaaacggtcggcaataatcttgtcttgcggtgttaaaccggtacggccgtccaccaaaaacacaactgcatcagcttcatcgacagcctgtaaggtttgttttgccatttcgtgcaaaatgccgctgtccacaaccggctcgaaaccgccggtatcgatgaccaaataaggtttgctgccgactttgccgtgtccgtaatggcggtcgcgcgtcagaccgggcaggtcatgcacgagcgcgtctttggtgcgcgtcaaacggttgaataaagtagatttgccgacgttggggcgaccaacaagcgcgatggttggtttcatgattgagtctttctgtgtcaagtgccgttcgggagaactgaacacgagcaggtgtccgttggacacggcggatgggttttacgggaattgccgtaggatagtgttgtctgaaatgccgtctgaagagagggtggcatttcagacggcatttatttcagcgaatcaagtttcatttgaaccaattcgcgaccgacagaatcttgaggcattttttctaaagcctgtccgtagttttttaaggcttcctggctttttccctgtgcggcatagacatcgcctttggtttccatcagcaggggggcgaagtccgcttcaaccggcgtatcgagcgcggcaagcgcggcatcgtattttttttgttgcaacaacacaacgcccagacgctgcgccgccaacgcttgaatcaggctgtctttttggttggacaacacccatttcaaatggccttcggcaacatcgtaacgctgcgcgtcaaattcggttgccgccgccatcagtgtggcttgggcggcggaaatggaatgcgggtagctttgttggagtttggtcaattcggcattgatttcgctttgcggggctttgctttgcgccttttctacgatgtttgccagcaccgccgccgcttcctgattttgggaaactttacggttttggtaaaccgtgtatcccaagtagccgagtgccgccaaaatcagcaaggcaaacagccatttgcccgtggttttccaaaaatatttaaagttgtctaactcttgttgttcttcgagatgggctgccatttatgcgttcttccattgttgtaaagtaggggttaaatcctcggcggcgacagtttgctgaccgtgtgcgccgttcatgtctttgagcgtaaccgtaccgttcgccagttcgtcttgcgcgacaatcagggcaaagcgtgcgccgctgttgtcggcttttttcatttgcgctttcaggctttgatagccggaatgctgcattacattgaaaccttgcgcgcgcaaggcttgtgcgtatttcatcacctgcaagtccgccccttcgccttggtgcattgcatagacatcaggcgcagcgttcacttccagagagccgtattcgctcaccaaaagcagcagccgctcgatacccattgcaaagccgatagacggcgcaggtttgccgccgagttcttcaatcaagccatcgtaacggccgccgccgcacacagtcgcctgcgcgccgagtttgtcggtcgtccactcaaaaaccgtctgattgtaataatccaaaccgcgaaccaagcgcggattttcaatatattggatacccaaaccatccaacatcgccttgaagcgtacatagtggttttgcgaatcctcgcccaagtaatccaccaaacgcggcgccgcgttgcagatttcctgcaaatctgggtttttcgtatccaaaacgcgcaaaggattggttttcagacggcgtttgctgtcttcatccaatttatcttcataacgggtcagatattcaaccaatgccgcacggtgtgccgcgcgttcctcacggttgcccaagctgttgatttccaaagtcaggtattcgcggatacccaatttttcccataagtcggcagacatcgcgatgatttccgcatcaatatccggcccttcaaaacccaaagcctcgataccgacctgatggaactgacgataacggcctttttgcggacgctcgcggcggaacatcggccccatataccacagcttttgcgggctattgtacagaaggttgtgttcgaccaccgcacgcaggcaggaagccgtaccttcaggacgcaagctcaaactcaaagaatcgtttgaatcggagaaggtgtacatttccttgccgaccacatcggtttcctcgccgatggagcggacaaacaaaccggtttgctcgacaatcggcgtacggatttgctgataaccgtaagcgcgtgtccagcggccgaccgtatcttcaaacgcctgccaaaacgcagccgtcagtttgaaatctttttgcttgacaggcagaaggtcgttcatgcctttgacggattggattttttgtgccatttcaagtaagaatgcttaaatcaaattgcgggcgattatagcggattttaaagggtttgtgaggttggaggtggtttgcggacggcatttgacttactctgcacgtgcttgcctgatttgtccgactgtaaactccgtctgccgttttgggtgttgtgtgaaaaacaatttatttgaaattgtctcggcttttttcggtatgacagccaaaatcttacctgccaaatttccctcacgggtttgccaagcatccaaaaactgcgccctgctcattgaaacatgccccagcgacgggtcggcaagcaaaaccgtattgccgtctataccgcgcaataccgaaaaatggtcgtctttgcggtatttcagatacacgatgacggggattttcaactgcgcgagctgctcgaaagacagggcatagcccttcgcctcaaaacccaaatcaggcataatgcgccgcatatcctcaaacgacgcgcgcatctgctccttatccagctttttcaacacttcttcttccgtcagcgtttgcccgtaaaaattgttcaaaagcgtcgccaccgaagccgccccacaggaaaaatccaaatcctgctttacaatattgaaatcccgccgcgctttccaactctgcactttgatttttccgtaaacaacaggattatcgttaaacatcggtgcagcattcaaacgataagataaagaaacgacaacacacgccaacagaaaaacatatttgaacttcatcatattgtccacataaagggcagcctgaaaatctttcaggctgcccttgtcaaattattcctagctttcggcttttttggcaaaccaaacaatccgattacccgcataatactttccatttattgaaatccgacaagccgcgcccaaaaaatgccatgcactgtcgatttccgcagcaatctttgtaccgttttcttcaaattccaaatattcacccaataataaacttgaaacagaacgcgtgggcagcaagtgcccaccctacgcttattcaaataatttgattaaataaagaataaagaaaatgcatcaggaacaaaattataatctgccacctgactcacaccgcttttaaagtaaggggcatcaaaatcaaaaccgcaaaaaaaataatttttgcattgatttttaatagatttaaaattcgaatatagtgtttctctagatttaaaaagtttatctttatctatatatttgatgctttccctatccaaaataaatatttcaaacattaaaaaatcattacatgaccaagccaaatcataaatttgattcaaatgggtatcataaagataaaaataataaggtttgggaacaggtaaaatatttaatggaaaaggaggactaattttcttaatatctgatgactgatatccatatctttctatattcttaaaaatttcatctttcttaagataacaagacattctgacaatcacaacctgttcatcggatatattatctatttgcatggcgcgtataacacgccatgcctgattaaaattagtctcccttaccttaaaatctattatcttttccaaagatgaaaatgccccttatcttgaactctccagttagaacctggaagtttcgtacctcttaaatgtgtattaatatttcttatagtttcattaaaatgccacgcgctgccgatttcaacggtaattttcgtaccgctttcttcaaattccaggtattcccccattagctaacgcaaagaagcagacgccatttcggcttcgttatgataaacccgccttccgttgatatagacttccgcccctgtccgctccaaattccaaaaattccgtactgaaatttccatatcccgatattgtgcagaccatgttttttcgaaggttttcataaaatttcctatacctgtccaatcggcacatatcaattgcattattacatctcaatacgataaatatttcttaagtcaaaatgcaagcctgaccgtaccttaactgtcaaaattttattattttttattgattttaaaacaatttctgtaaaattctcttcgctttctctcttttttagaagcacataagaaaaaataaaacttccccgattaaattcataaatatgtttcaaccattcgcctcctctttctgtaagacaagattcagtttcattcttccttattgtataaatatttccttcacaaaatctgaaataaatccataaatccatcttatccataattaaagaaaaagtttcacctcgagattttgtcaacaattcgcaaggttgcgatgttgcaatcaaatagccgaaagacattttttacctcatacatggtcgaaatcagtttctgttagttcagaatccattttttcgtcaacaactgaatccgcatttttgaattaacgttttcatcagctgccgtttatctaaaccggcaggttcagtttcaaaataagccttatatgaagactgtaagcatttcagaaaaagatcatcagaagacatatctgccgaatcaaatacaactgttttgattttggtacttacccaaaaccctttttgctctttttctactatacggaaattcagaatatttccaaccgaatcaaaagcacggtaaacatcatccatcaaatcctgcggctctattttcttttccaattccgacaatccttgaaatatatccaaagacacatcttcaaatagaaaaaaaggaggagttagaagcggtttttccatgatctgtccgtagattttgattcccaagggcgatgacgaccaattccctgtccaggcaaagtcttgcccgtattatccgtaactcgacgatgataatggggaaattttccaataggatgacctgttctattaccgaaaggggctatccgcatattattgccgattttaatctcacgtccatatttagcaaaggaaacaacctttcctgcggcgcctacaccaccaggaattgcgcctaatccgccagcaatagcaacatctctaacagaagctggtctgcctgtcgttgcataactaaaaccatgctgtgtccacataccaatggcagcaccacccaagatagccaatggaagaaacgccccctctgtctccttcatctccttttgagaaagctccgccaactgcatcggtgcatctgcccgcgtgtggaacacttggtcttcaaatgcctgattgtccaagccgtttgccattgcgggggcaatcatagacagcatcattacggctgcggtgatttgttttttcataataactcctttggattacaaggttggaaaatcaaagccctgcttagaacgtatgttgcacacccaatttcaataggtaaatcagattgcaaatccagcaatttgaatattgtcattgttccgtgcaaaagggatttttattgatgagttgtgtactgggtttcagcttggctttttagataatcttttcacaagaacatacatcaatactgtccaaaaaaaaagatttgataaatatattgcaacatattttattccacctccatccgaaacagaaaccaatatatttttaattaatacatagctgattattacatttattattcctataatatataaggatcttgccaaaattttttttgattttattttaggaatatctcttatccatgctaaaatacagcccaatgtcgaaaagaaaataacagcaaacactaccttacctcctctcacttccaaccaaaccgatagcaggtttggttggaagttggtttatttattatttaacggcgaatgtcagtgttcttacccgtagaacctgcataaccatttatgccaccagcaacagtccccactgctacacctcgcataccattaatcagaattcttcctattttttcgaatccactatttcttccaaagatgcagcaaacgcaggttgagcctagacccaatctacgtttgctgccgcatctgatccctattgtttcttatccttacatcttcctgccttgtcaatcaaataaagacagaagactatacaaaaactgaccgacatactgaaaatacctatccccttccatgcaatctccgcaccattgacccaatagattagactgagaaacaacaaagccacagtataaatcaacgtaaaaaatattgcgtaaagcacaataaagggaacttttatctcacggttgttttttataatatattcagcaacttgatttccgaatatacctgataaaaaatatagtattagatcatccatttcgtttatcttctatgttttcccattgcggcgctagaagactgatttaatgctgcaccatttgcacgaataactgcattaggaatagcatttccccctttccaagcagaacgggcaaaaacactagtagtaatccctgcaccgcgcaacatcgcactgctatatccgccgcctatcataccaccagcggttgcagccaaggtacttcttgttgaagcaaattgccctgttttaattttagaaatgccgtgattagcccaagcactaattgcccctcccatcaaagcacctgccacaataggaagaaacgccccctcagtctccttcatctccttttgagaaagctccgccaactgcatcggcgcatctgcctgcgtgtggaatacgtatttttcaaatgcctgattgtccaatccgtttgccattgcgggggcaatcatagacagcatcattacggctgcggtaatttgttttttcataataactcctttggattacaaggttggaaaatcaaaacctgcttaaaatgtatgctgtacgccaaatttcagttcggaactgctttgccctgaaacgttgaaacgtgcggatgcgtttaaagccgtggttttggtgaaaccgaaacctgcgccgaaatgggcgtaggtggatgtgtttctggaggattcccgtttgccgtccgtccggtcgggctgcctgcccagccattggatgcctccggtcaggctgattctgtcgttggcagcaaatgagatgttggggttgagcagcaggtagttgcccgatttgtagcggatgccgtctgaaagggttttgctgccgttgatgcggtaggcggcggtgagggaaaggacaatcggatctatggctttgtaggtggtggcgccgatgagccaggattttcccgacgaggctttgttgcgcgatttttcgtaaaccgtgctttcaagaaagctgattagggcggggtttttgtcgtctttaaggaaagtgtggctgatgccgagggatacgtcggacatccgtttgttgcgggttttgctgttgccgtcgagtttgcgttcttcgtgccacagatagctgccgctgccgtaaatgtcggtattcccggtcagtccgtagcgcaaaccgagcgtgccgacgagcatatcggtattgctgccgttttcttggatttcggtcggaatggggataaacgaggttgcgccggtttgaatgtaaaccggtgcggcaagttcggcgcggttgttttcgctgttcaggtaggtaagggaagtttccagtttccattttcccttgtcggtcattatgtcttcaatcgtcaagggcaggtcggcataagtggataaaggcaggatggcgggcaaggcgggcaaaaagatgcgcttcatatttctcctattgatattaattcttatttactaataataatgaatatccgataatcttgtctaaataaatttttaaatcataaaaaacaatatgtttgtttttgtcaattatgtttcgatatgccgtctgaaaagtttgtgaaaaacggttacaatccgccgcatgaaaaaacgcaataatcctcttccgctgttgaacggtgtcaaacccagttatttggtgctgccgcatgaaaagcagttttacgggctgccgctgctgcattttctgtgcatccgctttccttttgtgggcgcggacgattggcgcaggcggttgaacagcggttttgtggtcggttcggatggtgcggcgttggacgaacattctttgttcgagccgggtaaggtggtgttttattaccgtgaaaccagccgtgagagcgagccgcgtattccgtttgaagaaaagattttgcatattgatgagcatttgattgtggtggacaaaccgcattttctgcccgtcatccccagcggcaggtttttgcgggaaaccctgctcacgcgcctgcgtttgcggcctgaattgcagcatttgaatgttgaggacattacgccgctgcaccgcttggacaaggatacggcaggcgtgatgctgctgtcgcacaatcctgccacgcgcggagcctatcagacgatgtttcaaaacaaaacggtatggaaaacgtatgaggcgcttgcgccgacaaggacggatttgccgtatccgctcgatgtggtttcgcgtttggtgaggggtgagaaattttttacgacgcaagaggcggaaggcgaaccaaacgcacatacgacggtcgaactgattgaaaacaggggggaattcagcctttaccgccttacgccgcatacgggcaagaaacaccagttgcgcgtgcatatgatgggtttgggtatgccgctgttgaatgacgcgctctatcccgtgccgtctgaagcgggcagcgaggattatcggaaacctttgaagctattggcaaaaaagattgcgtttgcagatcctttgtcgggtcgggaaagggtgttttgcagcggattttgcctataatgagagggaacgcaaacccgtatcggcggatgccgccgatacgggttttacattatcgatgccgtctgaaaggggttttatccgttcaggcatacgggcgcgaagcggaggatggtgtcgcgcaggacgatgagtttgccgtgaaagaaatgcgtggaaccggcgatggtaatgacgggcaaatcttgcggttccgcccatttcagtgctttcccgatttcgacgacttcgtcttccgcgccgtgtatcatcagcgttttggcaacgttgggaacggcggacggttccggacggtcggtatagtggcagactgccgcgccgatgagcagcaataaatcgggtgtgcgcgcttgtgcggcaaatgtggcgacataaccgccgaaggagaagccggataaggcaaattcgggggcttcggggtgttgggcgcgggcataatcgatgacggcgaggcagtcttgcgtttcgccgcgtccgtaatcatgtgtgcctccgctgccgcctacgccgcgaaggttgggcaggtagcagtggaagccgagtttgcttaaggctttggcggcagtttggatgactttgttggtgtttgttccgccctggagggggttgggatgattgatgacggcaacaccgcgtgccggtacttgttcggacgggatatggatggtttctaaaatgccggcaggaccggatatgtgtatggtttcgggtttcagcataatgatttcctcttgattttccgcatgttccgatgcagccgtgaagatagttgcttaaaggtggaaatgcttgccgttgttggggttggacgctttcaggccggcaagcatacggtggaagtccaatccgtatgcgttgctcagtttgtcggcacgttttttgagtttgtctatgttttgctctttggggctgctttggaaggccattaccgcgacattgccgtggctttcggcaggaagttccaagacgcgcccttcaaaaacgctcaacaaccgttcgatgaagcgttggtagcgtttgtcgccgctccaccagttggttacgaatatgccgtctgaagagagtgcgttgcggcagtctcggaagaacggttcttcaaccagcgcatcgatgatttgttcgccgtcgaacccgtccaccaaaatcacatcggtgttgtggcggaagactttgatatattctgcaccgtctgcttcaataatttcaaatttctcgccctcgaaaggcaactcgaacaggttgcgggcaatggcgatgacctgcggattgatgtccacggcggtttggcgcgtgtcgggcaggtaggtatctatccagcgtgcaaacgagccgccgcccaagccgatttgggtgatatgttgcggaagagcgtcggtaaacagcagccagcccatcatcgcgcggctgtaagagagcaccagctcggacgggtggtcgaggttcatcgagctttgaacggtgtcgctgcccaagtgaagcgaacggatattgccttcttcggaaatgccgacttcgggaaagccggattttgcaggacgcaggcggcggtagggatgtcttgccatcggtgtgaacggtcggtttgaaaggcggatattttatcagaatgccgatgcttgttctgtttcaaattaatttcttttcaaataaattacttattcggatttgccggggctttcggataaattccttgccaaggtgcggcattgcctgcataattcgctttctttgccggtatagctcagttggtagagcacctgacttgtaatcagggggtcccgagttcgactcttggtgccggcaccatttctgctgatggtgttgcaaaacatttcagtaagccggtatagctcagttggtagagcacctgacttgtaatcagggggtcccgagttcgactcttggtgccggcaccagatttgacagtccgattgtgtaaaacagtcgggctgttttgcatttgcggcacggtcggtggcagggctgcgggcatttcactataatagcccgtttcaaactgaaaaggccgtctgaaaagggcggggtaacaatatctgatgattactgtgaacacactgcaaaaaatgaaggcggcgggcgaaaaaatcgctatgctgaccgcttacgaatccagttttgccgcgctgatggacgatgccggcgtggaaatgctgctggtcggcgattctttggggatggcggttcaggggcggaaatcgacgctgcccgtcagcctgcgcgatatgtgttatcacaccgaatgtgtagcacgcggtgcaaaaaatgcgatgattgtcagcgatttgccgtttggtgcatatcagcagagtaaggagcaggcgtttgccgccgccgccgaactgatggctgccggcgcgcatatggttaaactcgaaggcggcgtgtggatggcggaaacgactgaatttttgcaaatgcgcggtattccggtttgtgcgcacatcggtctgaccccgcaatccgtgtttgccttcggcggatataaagttcaggggcgcggcggcaaggcgcaggcgttgcttaacgatgccaaggcgcatgacgatgcgggggcggcggtcgtgctgatggagtgcgtactggcggaactggcaaaaaaggtaactgaaactgtttcctgtccgaccatcggcatcggcgcgggtgcggattgcgacgggcaggttttggtgatgcacgatatgctcggcattttcccgggtaagacggcgaaattcgtcaaaaactttatgcaggggcatgatagtgttcaagcggcggttcgggcgtatgttgccgaagtcaaagccaaaaccttccctgctgcggaacatatttttgcagattgagcggtttacatgcagcatgccgtctgaaagccgtttcagacggcattttgttttgccgtgcgcggcgcgtataatcggcgcgttttgtcgggcaggaagcccgaaggataaggattaccgttatgcaaatcatacataccattcgagaactgcgcgcgtggcgtaaaaatgcgggaaaggtggcatttgtgccgaccatgggcaatctgcatgaaggacatcttgcgcttgtgcgtgaggcgaaaaaacgcgcggacagtgtcgtggtcagcattttcgtcaatcgcctgcaattcggtcagggcgaggatttcgacaaatatccgcgcactttgcaacaggatgcggacaaacttgccgccgaaggcattgccgttgttttcgcgcccgatgagaaagaactctatccgaacgtggaacagcgttacaacgtcgaaccgcccaatctgcaaaatgagttgtgcggcaaattccgcccggggcattttcgcggtgtggcaacggttgtttctaaattgttccacatcgtttccccggacattgcctgttttggtaagaaggattaccagcagcttgccgtgattaaaggttttgtcgaagatttgaattttgatgttgaaatagtgcctgttgatacagggcgcgcggaagacgggttggcactgtcgagccgcaaccagtatttgagtgcggcggaacgcgacgaagcaccgcgcctgtaccgcgaattaaaggctgttgccgaatccttggtgcagggcagtttggattatgcaggtttggaaaaacgtgccgtccaatccctgacagaatacggctgggtggtcgattatgtcgaaatccgccgcgccgatacgctcgaagtggcgcgggcgggagataagaaactggtggtcttggccgccgcctgtctggggacgacgcgcctgattgacaatttggaaataaaactcccttaaaccgcaagcgtcgggaatgccgtctgaagcggatttgcgtttcagacggcatttattttttgaacggggtttcgcaaatctacaaacgattctgcttgtgataaagttacgcctgattatatgccgtctgaaggttcggacggctgtcggataaaggatgattatgttacctaaccgtttcaaaatgttaactgtgttgacggcaaccttgattgccggacaggtatctgccgccggaggcggtgcgggggatatgaaacagccgaaggaagtcggaaaggttttcagaaagcagcagcgttacagcgaggaagaaatcaaaaacgaacgcgcacggcttgcggcagtgggcgagcgggttaatcagatatttacgttgctgggaggggaaaccgccttgcaaaaggggcaggcgggaacggctctggcaacctatatgctgatgttggaacgcacaaaatcccccgaagtcgccgaacgcgccttggaaatggccgtgtcgctgaacgcgtttgaacaggcggaaatgatttatcagaaatggcggcagattgagcctataccgggtaaggcgcaaaaacgggcggggtggctgcggaacgtgctgagggaaagaggaaatcagcatctggacggactggaagaagtgctggctcaggcggacgaaggacagaaccgcagggtgtttttattgttggcacaagccgccgtgcaacaggacgggttggcgcaaaaagcatcgaaagcggttcgccgcgcggcgttgaaatatgaacatctgcccgaagcggcggttgccgatgtggtgttcagcgtacagggacgcgaaaaggaaaaggcaatcggagctttgcagcgtttggcgaagctcgatacggaaatattgccccccactttaatgacgttgcgtctgactgcacgcaaatatcccgaaatactcgacggctttttcgagcagacagacacccaaaacctttcggccgtctggcaggaaatggaaattatgaatctggtttccctgcacaggctggatgatgcctatgcgcgtttgaacgtgctgttggaacgcaatccgaatgcagacctgtatattcaggcagcgatattggcggcaaaccgaaaagaaggtgcttccgttatcgacggctacgccgaaaaggcatacggcagggggacggaggaacagcggagcagggcggcgctaacggcggcgatgatgtatgccgaccgcagggattacgccaaagtcaggcagtggctgaaaaaagtatccgcgccggaatacctgttcgacaaaggtgtgctggcggctgcggcggctgtcgagttggacggcggcagggcggctttgcggcagatcggcagggtgcggaaacttcccgaacagcaggggcggtattttacggcagacaatttgtccaaaatacagatgctcgccctgtcgaagctgcccgataaacgggaggctttgagggggttggacaagattatcgaaaaaccgcctgccggcagtaatacagagttacaggcagaggcattggtacagcggtcagttgtttacgatcggcttggcaagcggaaaaaaatgatttcagatcttgaaagggcgttcaggcttgcacccgataacgctcagattatgaataatctgggctacagcctgctgaccgattccaaacgtttggacgaaggtttcgccctgcttcagacggcataccaaatcaacccggacgataccgctgtcaacgacagcataggctgggcgtattacctgaaaggcgacgcggaaagcgcgctgccgtatctgcggtattcgtttgaaaacgaccccgagcccgaagttgccgcccatttgggcgaagtgttgtgggcattgggcgaacgcgatcaggcggttgacgtatggacgcaggcggcacaccttacgggagacaagaaaatatggcgggaaacgctcaaacgtcacggcatcgcattgccccaaccttcccgaaaacctcggaaataatgcaggtccatcctttcagacggcataaggtttgccgggaagccggggcattcgggcaaacggcacgcagttcgcacgcgttttgcacggcacgccgaacccatcggccggcaggatggcatccgttaaggaaattctgatgaaacacaccgtatccgcatcggtcatcctgcttttgaccgcttgcgcgcaattacctcaaaataacgaaaacctgtggcagccgtccgaacacatcagcagttttgcagcagaagggcggttggcagtgaaagcggaagggaaaggttcgtatgcaaatttcgattggacataccaaccgcccgtggaaaccatcaatatcaatacccctttgggcagtacgctcgggcagttgtgtcaagacagggacggcgcattggcagtggacggcaaaggaaatgtctatcaggcggaaagtgcggaagaattgagcaggcagctggtcggtttcaaactgccaatccaatatctgcatatctgggcagatggcaggcgtgtggcgggcgcgccttaccgcatcctgccggacggcatattggaacaatacggttggactgtcggcagaaccgccgacagtggggggcaagtccgaacgttgcaactgaataacggaaatttgaacatcaggctggttttcaccgaaatcggtatgccgtctgaaaccgaaaccccggaacgctgtgcggcgcgcacgagataaggcggacagatgaatattgcggacggacggcaggcgttttccgcacctgcaaaactgaatctcgatttgaggattaccggcaggcgggaagacggttatcacaatatcgaaagcatattctgcctgatagatttgcaggataccgtatatttgaaaccgagggacgacggcaaaatcatcctgcacaatccggttgatggcatgccgcaggaagtagatttgagctaccgtgccgcatcgttgctgcaaaaatatgcgcgcaaccccgccggcgtggaaatatggctggacaaaaaaatcccgacaggggcgggtttgggcggcggaagctcggatgcggcaaccgttttgctggtgttgaaccgttggtggcagtgcggtctgacgcagcggcagctcattgattcgggcgcggctctgggggcggacgtaccgttttttattttcggcaaaaatgcgtttgcgcggggtataggcgacaggctggacgaaatggatattccgaaacagtggtatgtcatcgtcaaaccgcccgtccacgtttccactgcaaaaattttcacacacgaaagcttgacacgaaattccgcctcaagcataatgccgactttccaaaatctgcaaccgtttagaaatgatatgcaggcagttgtatttaaagaataccctgaagtttggaaagcctattccgagttgtcccgatatggatttgccttaatgacaggttccggtgcgtgtgtattcacggcgtgtcaagataggaatagcgcatacaatatataccgacaagtttcagatttgtacgaggcatatttggcagagggtctttcaaaacatcctttgttgtccgtataaacattgttggggagtcgtcaagcggttaagacactggattttgattccagcatgcgaaggttcgaatccttcctccccagccaagtcaaacgagttggggagtcgtcaagcggttaagacactggattttgattccagcatgcgaaggttcgaatccttcctccccagccagccctttttggggagtcgtcaagcggttaagacactggattttgattccagcatgcgaaggttcgaatccttcctccccagccaaataaaagcgtgtaagcctgcttacacgcttttatttcatagaaataaaaatattgaaatgcctttgtttgtgtcggatgttgcaggtataatgtcgggcttggtacaagcagagggaagcattgtgttttctgagcggaagttaaacataaaatcaggtgagaatatggctgcgtacgacagtttgatggtatttacaggcaatgccaatcccgaattggcacaacgtgttgtcaggcatttggacatttctttgggcaatgcttccgtatccaagttttcagacggcgaagttgccgtcgaactgttggaaaacgtacgcgggcgcgatgttttcatccttcagccgacctgtgcgccgaccaatgacaacctgatggaaatcctgacgatggcggatgcactgaagcgtgcttcggcaggtcgtattaccacagccattccgtatttcggctatgcgcgccaagaccgccgtccgcgttccgtccgcgttccgatttctgccaaactggtggcaaatatgctgtattcggcagggatcgaccgtgttttgactgtcgatttgcatgccgaccagattcaaggtttcttcgatattccggtggacaatatttatgccaccccgattctgttgaacgacatcaaacaacagcggattgaaaatctgaccgtcgtcagcccggacatcggcggtgtcgtccgcgcccgcgccgtggcaaaatccctgaatgccgacttggcaatcatcgacaaacgccgcccgaaagccaatgtggcggaagtcatgaacatcatcggcgatattcaaggtagaacctgtctgattgtggacgatatgattgacactgcaaatacgctgtgcaaagccgccgtcgccctgaaagagcggggggctgaacgtgttctagcctatgccagccacgccgtattctccggagaggcggtcagccgtatcgcctcatccgaaatcgaccaggtggtcgtaaccgataccattcctttgtctgaagcggctaaaaactgcgaccgtatccgtcaggtaacgattgccggtctgttggccgaaaccgtccgccgcattagcaatgaagaatccgtctcatatcttttcaatgaagaagtgatgacaggcagcatgttgctgccataagcccgaagccgtcttaagctggtcgcggccgatgacggcgattttacctaacttggagtatttaacatgacttatgaaattcaagcctctgttcgtgaagcacaaggcactggtgcgagccgccgcctgcgtcgcgaaggccaaatccccggcattctgtacggtgaaggtcaagagcctgttgcaatcgctgtggatcacaaaaccgtattctacgcattggaaaaagaatctttccatactgcgttgattaagttgtctctgaacggtgaaaccaaagacgttatcgtccgtgatttccaaatgcacccgttccgccgcgaagttcaacacatcgacttccaagctgtgaaagccgatcaacttgtacgcatccgtgttcccctgcacatcgttaacgctgaaaattcccaagcggtcaaactgcaaggcggccgcgtatctctgttaaacacttctgttgaagtagttgctttgcctgccaacatccctgctttcttggatttggattgtgctgaagtggttgccggcgacattctgcacttgtcagacatcaaactgcctgaaggtgtagaaagcgtttccctgaaacgtaacgaaaatctggctgttgctaccgttaccggtaagaaacgctaattgatttcagcagcagggcggcgcgtatgcaatacgtaccgccctgttgttttatgccgtctgaaccgtgtttcagacggcatttctttatttgttggaaaaacgggatatttgaaacggcagattactgccctgtcagacacgcccaaagcctttgccaccggcttcttttttttacattttccagtgcgacgatttctttttcggcaatggtgtatccgttttgtctgattttgatttttcctaaaatttgccctttttttactggggcgggaatcggctgtatggtttctagaatttgttctgccattttcgcttccttatgtggcagagtgatgtaggcttctttgaggaagcctgcgcggacggtttttttgctgcctccggaaatttggatttgggcaacggttttgcctttcggatatattttgggcgtatcgaaggcctgcaatgcccagttcagcagcttgctgttgtctgatgcgcgtgtttccgccgattccgaacccaatgtgatgacaaggatgtgcctgccgttgccggagtatgacacggcaaggttgtagccgccgctttctgtgtgtccggctttcagaccgtttacattgttgtccctatataaaaggatattgcggttgttttgttctatatttttgaatttgaaagatttgatggaaaacagcgggtaatattccggaaagtcgcgcatcaatgcttcagacagcagggcgaggtctttggcggtggaaacctgtccttctctactcaagcctgtcgggtttttgaatacagtgttcttcatgcccaagcgtcgggcttctttgttcatttgttgcacaaaattttcaatcgagccgttgcccagccggccggcaagggttagggcggcatcgtttgcggatagtgcaatcatgccttttaagagtttgtcggtgctgaccgtatcgccgggacgtacaaacattctgcttccttctgaagcccatgcggattcgggtatttttaagttttcttcagattggatattgcccgatttcatgtttttgaaaaccagatatgcggtcatcagttgggttagtgccgccggttcaacaggggtattgatgtttttggcggataaaatctgtttgctttgaaggtcgataacgatgtgtgccgctgtgagggtttcgggtgtttggaacgtgggggcggcgtgtaccgtcggtctgttgggcgcgggcgatgcagccgttgcgtgagaaacgcctaagatgatggaaagcaggacgggcaggattttatgtgctgtcatgaaatattctaattgtgtgcgtgtttcagtctgccgattatacgcttagggtgtctgatcgggcggatttttcttgatttcgcgccgtcttgggcgtatggttttgggttttgcgattttaataaaccgattatcccatattgaattatgaacacgccccttccttattccgattacctcatccgcatcctgacggcatctgtctatgatgtggcggtcgaaacgcctttggaaccggcacgcagcctttctgtacgtttgaaaaacaacatccttttgaaacgcgaagatttgcagccggttttttcgttcaaaatacgcggcgcgtacaacaaaatgtccaagttgccgaaagatgcgctcgcttgcggcgtgattgcggcaagcgcgggcaatcatgctcaaggcgtggcattgtccgcacagcgtttgggctgccgtgccgttatcgttatgccggagactacgccgaaaatcaaagtggatgcggttaaaagccatggcggcgaggtggttttgcggggcgtttcatacaacgatgcctacgattatgcgatggagttggcggaaaaagaagggttaacctatatcgcgccgtttgatgatcctgatgtgattgcgggacaggggacggtggggatggaaattgtcagccagcatcccgatccaatccgcgccgtattcgtaccgataggcggtggcggtttggcggcgggcgtggcggcatttatcaagcaggtccgtcccgaaatcaaagttatcggcgttcagaccaacgattcctgctgtatgaagcagtcggtcgaagcgggtgaaatcgtccatttgaaagatgtcgggctgttttcagacggcactgcggtcaaagtcgtcggaaacgaaaccttccgcctctgcaaagaacttttggatgaaatcattacagtcgataccgatgcggtttgcggcgcggtcaaggatattttcgatgacacgcgcagcattaccgagccggcgggcgcgttggcgttggcgggtctgaaagcctatatcgcccgagaaggcgcggaaaaccaaaccctgattgccgttaccagcggtgcgaatatgaattttcaccgtttgcgccacgtttcggaacggagcgaattgggcgagggcaacgaaggtatttttgccgttaccatccctgaagaacgcggcagcttccttaagtttgtcaatatattgggaaataggaatattaccgagttcaactaccgctacggagacgatgaaaaagcgcatatctttgtcggacttcaagcggcaggcccgcaggatttggcggttatcggcagccggttggatgaggcgggattgcccaatgtcgatttgaccaacaatgagattgccaaaatccatatccgctatatggtcggagggcggacggacaaagtagaaaacgagcgtttggtcagttttgagtttccggagcgtccgggggcattggcacgctttttgaaccatatgcagggagggtggaatattacgcttttccattaccgcaaccacggtgcggattacgggcggattttggtcggtatcgatgtgccgccgcacgatgccgccgcatttgacggtttcttggaaagtctgggatacagctatcacgaggaaacgcaaaatgccgcgtacaagctgtttcttgcctgacgcttgaaagcacaatgccgtctgaaagcctttcagacggcattgcgctttcatggttaaatcgaatattcaatcagttcgttttgagagaagacataaacctgtttcggaatcagcttcaattctttgccttcggcgattgggtaacgcgcggcatcgctgcctgccagcgtgatatgtacgtcctgtttgtcgtgttttaccagaatatgcgtcaatgcgccgacggcgtggattttttcgatttcggcacaaatcatcggtgtttcgtgttcggcggcgatctgccattcgtgcgggcggatatagccggtggcggtttgttcctgccatttgtattgcgcgtccaatttccacgcgaagccgttgtaatgccagaagcctttttcgatgcgtccttcaaaagcgtcggtttcgccgaggaactcggtaacgaaggcattttcgggtttgcggtaaatagcttcggcgctgccggtttgttcgattttgccgtggttcatcacgacgatttcgtcggaaacttcgagggcttcttcttggtcgtgcgtaaccagaatgctggttacacccaggttgtgatggatgtcgcgcagccaggtgcgtaattctttgcgtactttggcatccaacgcgccgaagggttcgtccaaaagcaagagtttgggttcgaccgcaagcgcgcgggcgagggcgatgcgctggcgttgcccgccggagagttggtgcggataggattttgccaaatgagagagctgcacgagcttgagtaattcttcgactttggcgcggatttgtcctttggacgggcgttcggacttgggcaatacggtcaaaccgaaagcgacgttgtcaaacacgttcatatggcggaaaagggcgtagtgttggaacacgaagccgactttgcgctcgcgcacatgtttggcggttacgtcttgcccgtcaaacaggatattgccgccgtcggcgttttccagtccggcgataatgcgtaaaagtgtggttttgccgcagccggacgggccgagcagggaaacgagtttgccggtggggacgttgaggttgatgtttttcagcgcgtgaaaattgccgaagtgtttgtttaagttttggatggtgatactcatattgcattcctttcggcggcggcgagttttttgtcttgtaatttggtaatgatgttctgcaccgccagcgtcgccagtgccaaaagtgccaatacgccggagagggcgaatgcgccggtgaagttgtattcgttgtagaagatttcgaccaaaagcgggacggtgttggtttcgccgcgtatgtgtcccgataccacgctgaccgcgccgaactcgcccatcgcgcgggcgttggtgaggatgatgccgtagagtaacgcccatttgatgttgggcagggtaacgcgccaaaacatctgccagccgcttgcgccgagtatcaatgccgcctgttcttcgctgtcgccctgtgcctgcatcagcgggatgatttcgcgtgcgacaaaggggaaggtaacgaacagcgtcgccaaaacaataccggggatggcgaagataatctgtatgccttgcgcttcgagccagccacccaatgccgtatgcgcgccgaacaataagacgaacatcaaaccggccaccacgggcgatacggaaaacggcaaatcgagcagggtggtcagcaactgcttgccgcgaaaatcaaaacgggtcagcagccacgccatcgccacacccaatacggcattgacgggaacgacaatcagcgcggtaatcagcgtcaatttgatggcagaccacgcttcgggatcgtttaaggatttcaggtacaaatcccaaccgccttttaaggcttcgtaaaacacggcgacgagcggcacgaccagcatcagcagcagaaagcccagcgcggcggcaatcagcaacacgcgcagccggcgcggttcggtcaggttgggattggcggaatagggtttcatggcggtggtgttctctggttggttttaaaatgtttggatgccgtctgaaaaaccgttttttgtggggcggattcgttttcagacaaccttttattgattaagggaataaaaacgtctagctaccgtcattcccgcgcaggcgggaatccaccgcagggcaacaggaaaacagaaaataaataaggcagccgaaattcaccaatggattcccgcctgcgcgggaatgacggtaacaggtatttcagacgacctcaacccttcgcgcccgaacgcctgcccaacgcccactgcatcacgttcagcgcaaacagaatcacaaacgaaaccagcagcataaacaacgccaccgccgacgcgccctgcacgtcgaactgttccagcttgcccgtaataatcagcggcaggatttcagaaaccatcggaatgttgcccgcgataaaaatcaccgaaccgtattcccccgttgcccgcgcaaacatcattcccgcgccggtcaagagtgccggtgtgatttcaggcaagaggacacggcgaaacgtagtccaacggcttgcgcccaaagttgccgccgcttcctcatattcgcccgacaattcttccaataccggctgcacggcgcggacgataaagggcaggctgacgacgaccagcgcaatccaaatgccgacgggtgtaaacgcgattttgatgcccaaaggctcgaaaaaacggcctatccaaccgttgggcgcatacagggttgccaacgcgatacccgtaaccgccgtcggcagcgcaaacggcaaatcgaccagcgcgttcgccagacccttgcccgggaattcataacgcaccaatacccacgccaccagcgtgccgaacacgacattggtcagcatcgcataaaacgacatccgcaagctcagccataccgccgccaacacgttcggctcggcaatcgtgttccaaaagccgccccagccgatttccgccgccttcgccgccatcatcgcaaacggcaagaccacaagcagcgacaggcacaatacggtcagaccaaggctgagtttgaagccgggcagtacgccgggcgttttgagcgctaacataaaacaatgctgaaaataaggaaaaggaaggactactttaacgatgccgtccgaaaaacggaaagaatggaaagtttggtgcaaagacgaatttgttataaagcggttggcagtttctcaagcgggcgcgatgttttaaaatatagtggattaactttaaatcaggacaaggcgacgaagccgcagacagtacaaatagtacggcaaggcgaggcaacgccgtactggtttaaatttaatccactataacaccttgttttgacggaaaaccatcatataaaggaacacttatgcagattttatcttttcaaccggacattgcggaacgtatgctggaaggtacggaaggcgagtcggtcaacgaaaacgcacaattcgtccgtacggacaacggctattggattgcgtggcatgaaggcgtagcggcactgcttgcgcccgatatgccgccgggcattccctgtttttgggtggaaggcgcggaaagccttgaagagttgtgcgtcatggtggaacgcggcgagtttgacgaagtggaagagtttgacggcgatgacgacgaatggctcgaaacggcacagggttgcgggcaccacggcgacgcttgcgcctgcggacattaaaggcattgcaggcttgccgcaaggggggcaaggctttgccgttttttaaataatcggtggattgcatctgtttgcaatgggctgaacgcttccctttgtattttattgaataaaaaaacttatcttggtattataattaaggcagcatcaattattttgggatggcaataaacgcaaagcattgatttgcgccgattgcagacttattatagcaggttgcggcgcggacttaatgggaattgtttatagagcatgatggtctgaaacatcattaattaaaaataccattaatccgatttatatttatttcaatttcaatggaaaaacatcaatgacaatgattttaagcattttaagcctgttttttatcatcagactgttatttttagccgtctctattaaacatgaaaaagccttgattgccaaaggggcgaaacaatacggaaaaaccaattccacgctgcttgcggcagttcatacgctttattatttggcgtgttttgtttgggtatggctttctgacactgcttttaatggcatatccttgattggtacgctgacggtgatggcttcgtttgtgatattgtcattgattattaagcagttgggggagatttggacggttaaaatctatattttaccaaatcatcaaattaatcgttcgtggttgtttaaaacattccgccaccccaattattttttaaacatcatacccgaactgattggcatcgccttattatgtcaagcgtggtatgttttattgattggcctgcccatttatttgctggtcttatttaagcgtatccgacaagaagaacaggcgatggcaacacttttttaacccgtttcatcaattatagcggattaacaaaaaccagtacggcgttgcctcgccttgccgtactggtttttgttaatccgctatattccgccatctctaagatttacagcgatacacgggtaatttaaggaatgcccgaaccgtcattcccgccactttccgtcattcccgcaaaagcgggaatctaggacgcagggttaagaaaacctacatcccgtcattcccgccactttccgtcattcccgcgaaagcgggaatctagaatctcggactttcagataatctttgaatattgctgttgttctaaggtctagattcccgcctgcgcgggaatgacgattcataagtttcccgaaattccaacataatcgaaacctgacagtaaccgtagcaactgaaccgtcattcccacgaaagtgggaatctagaaataaaaagcaacaggcatttatcggaaataactgaaattcaataccgcaaaaatctacccgaaatgatatagcggattaacaaaaatcaggacaaggcggcaaaacgtttggcgacttcgtcccagttgacgatttcccaaaaacctttcaggtagttgggacggctgttgcggtagtcgatgtaataggcgtgttcccacacgtcgcaggtcagcagcggcgtgttttcagtggtcagcggcgtagcggcgttggaagtagaaaccaaatccaatccgccggcaggggtttttaccagccacgcccaaccggagccgaaagtaccggccgcgcaggcattgaacgcttcttggaatttctcgaagctgccccatttcgcgtcgatggcggcggccagttcgccggcaggtttgccttgacctttggacgtgaaacccagccagtagaaggtgtggttccaagtttgtgccgcgttgttgaacacgccgcctgaagattttttcacaatctcttccaaaggcaggttttcaaattcggtgcctttgatttgattgttcaggttggtgatgtaggtttgatggtgtttgccgtagtggaactccaaagtctctttgctcagatgcggggacaatgcgtccagttcataaggcagttgcggcagcttatgttccattttgtactcctgaatattgttttaaatgttgtattttggcagtgttgctgcaaataactcggcagcccgtgtattctacctgttttgcggtgcggaaaccaattaaacctgctttacgctataatagaagattgcaatttcggcacgacagataggatgtaccatgaacgattacgcagccatgccgtctgaagaccgtgaggtcggcgcattgtctctgcccccacactcaatggaggcggaacaatccgttttgggtgggttgatgctggaaaatccggcatgggacaggattgccgatgtggtttccggtgaagacttctaccggcatgaacaccgcctgattttccgatccattgccaaattgattaatgagagccgtcccgccgatgtgattacggttcaggaagatttgcagcggaacgaagaattggaagcggcaggcggattcgaatatctgattacgctggcgcaaaacaccccgtctgccgccaacatccgccgctacgccgaaatcgtgcgcgagcgttccattatgcgccaactcgccgaagtggggacggaaatcgcccgcagcgcatacaatccgcaaggcagggacgcggggcagcttttggacgaggcggaaaacaaagtattccaaatcgccgaaagcaccgccaaatccaagcagggctttttggagatgcccgatttgctgaaagaagtcgtacagcgcatcgatatgctctactcgcgcgacaatcccgatgaagttaccggcgtgccgacggggttcatcgacctcgacaaaaaaacctcgggtctgcaacccggcgacctgattatcgttgccggtcgtccgtctatgggtaagaccgccttttctatcaatatcgccgaacacgttgccgtagaaggcaggctgcccgttgctgttttctcgatggaaatgggcggggcgcaactggtcatgcgtatgctcggctcggtcggacggttggatcaaagcgttttgaaaaccggcaggctcgaagacgaacactggggtcgcctgaacgaagcagtcgtcaaactctccgacgcgcccgtgtacatcgacgagaccccgggtctgaccgcgctcgaactgcgcgcccgtgcccgccgtctcgcccgtcaatttaacaataagcttggattgattgtcatcgactacctgcaactgatggcaggatccggccgttccgacaaccgagcttcggagctgggagagatttcacgttcgctcaaagcgttggcgaaagaattgcaagtccccatcatcgccctgtcgcaattgagccgcacggtcgaatcgcgtaccgacaaacgccccatgatgtccgaccttcgcgagtccggcgcaatcgagcaggatgccgacctgattatgttcatgtaccgcgacgaatactacaaccaggactcacccatgaaaggccttgccgaatgtatcatcggcaaacaccgcaacggtcccgtcggtaaaatcttcctcacatggacgggacaattcaccaaattcgacaatgctgcctatattcccgaggaggcaaagatagaggattaaatggctatataaaaatttattaggcgaaatcaggcaaaatcgtttaaaatcatgctgagagattgccctaaaaaataaaacgcggtcttgaggcatttttgcattcagcccgcatataattgaaaatatagtggattaacaaaaatcaggacaaggcaacgaagccgcagaccgtacaaatagtacggaaccgattcacttggtgcttgagcaccttagagaatcgttctctttgagctaaggcgaggcaacgccgtactggtttgaatttaatccacgatacattaccagttaacgttctattgcttatgtgtacacgaaaacaacaaggtttcacgctaacagagctgctcatcgtgatggtcattgcagccattatggcgatgatagccctccccaatatgagccaatggattgcatcccgccgcattgccagtcacgcggagcggattgccaaccttttgcgtttctccaggggcgaagccgtccggctcaatctccctgtctatatctgtcctgttcaagttaaaaaagacggtacgcccaacaataaatgtgactccggcaagaaggggcagggaatgttggctttcggcgacaaaaacggcaataagggatatgacaatgatacggaggatgttcttctccgcagtgtggtattgaatgatgatatcaatgataagcggattaattatgccttcaaccatatcgctttcggtcagactcagccgaccaccgaccgtgtagtttggacattcaatcaaaacgggacgttcggttatacgaaagaccagcatcttacaaaacaatccagctttttttattctgacggttatatccaaatcgtgttgacagatgcgaaggcggtttctgccgatgaaaagaaattccgttcggcggtggttttgattaacagcagcggcagggtcgaagtttgccctaggggtgatcggcgtactatgtgccagtataaataacagtttcagttttaaaaatgaatatgaagaataatgattgcttccgcctgaaagattcccagtccggtatggcgctgatagaagtcttggttgctatgctcgttctgaccatcggtattttggcactattgtctgtacagttgcggacagtcgcttccgtcagggaggcggagacacaaaccatcgtcagccaaatcacgcaaaacctgatggagggaatgttgatgaatccgaccattgattcggacagcaacaagaaaaactataatctttacatgggaaaccatacactatcagctgtggatggcgattttgcgattgatgccatgaaaactaaggggcaattggcagaggcacaattgaagagatttagttatgagctgaaaaatgccttgccggatgcggcagccatccattacgccgtctgcaaggattcgtcgggtaacgcgccgacattgtccggcaatgctttttcttcaaattgcgacaataaggcaaacggggatactttaattaaagtattgtgggtaaatgattcggcaggggattcggatatttcccgtacgaatcttgaggtgagcggcgacaatatcgtatatacttatcaggcaagggtcggaggtcgggaatgagacgtaaaatgctaaacgtaccaaaaggcagttatgatggtatgaaaggttttaccattattgaatttttggttgcgggcctgctcagtatgattgtcctgatggcggtcggatcgagttacttcacatcccggaaattaaatgatgcggcaaacgagcgtcttgccgcgcaacaggatttgcggaatgcggcaacattgattgtccgcgatgcgagaatggcaggcggcttcggttgtttcaatatgtccgagcatcctgcaactgatgttattcccgatacgacgcaacaaaattctcctttttccttaaaaaggaacggtatagataaacttattcccatagcggaatcttcaaatatcaattatcagaattttttccaggttggtagcgcattgatttttcaatacggaatcgatgatgttaatgcaagcaccgcgactaccgtcgtcagcagctgtgccgcaatatcgaaaccgggcaagcaaatccctactttagaagatgcaaaaaaagaattgaagattccggatcaggataaggagcaaaatggcaatatagcgcgtcaaaggcatgtggtcaatgcctatgcggtcggcaggattgccgatgaggaaggtttgttccgcttccaattggatgataagggcaagtggggtaatcctcagttgctcgtgaaaaaggttagacatatgaaagtgcggtatatctatgtttccggctgtcctgaagatgacgatgccggcaaagaggaaacattcaaatatacggataaattcgacagcgcccaaaatgctgttacgcccgccggggtggaggttttattgagtagcggtactgataccaagattgccgcttcttcagacaatcatatttatgcttaccgtatcgatgcgacaatacgcgggggaaatgtatgcgcaaacagaacactttgacgggaatcccgacttctgacggacagagggggtttgcactgtttatcgtgctgatggtgatgatcgtcgtggcttttttggttgtaactgccgcgcagtcttacaataccgagcagcggatcagtgccaacgaatcagacaggaaattggctttgtctttggccgaggcggctttgcgggaaggcgaacttcaggttttggatttggaatatgatacggacagtaaggttacatttagcgaaaactgtggaaaaggtctgtgtgccgcagtgaatgtgcggacaaataatgataatgaagaggcttttgacaatatcgtggtgcaaggcaagcccaccgttgaggcggtgaagcgttcttgccctgcaaattctaccgacctgtgcattgacaagaaagggatggaatataagaaaggcacgagaagcgtcagcaaaatgccacgttatattatcgaatatttgggcgtgaagaacggagaaaatgtttatcgggttactgccaaggcttggggtaagaatgccaataccgtggtcgtccttcaatcttatgtaagcaataatgatgagtaataaaatggaacaaaaagggtttacattgattgagatgatgatagtcgtcgcgatactcggcattatcagcgtcattgccataccttcttatcaaagttatattgaaaaaggctatcagtcccagctttatacggagatggtcggtatcaacaatatttccaaacagtttattttgaaaaatcccctggacgataatcagaccatcgagaacaaactggaaatatttgtctcaggctataagatgaatccgaaaattgccaaaaaatatagtgtttcggtaaagtttgtcgataaggaaaaatcaagggcatacaggttggtcggcgttccgaaggcggggacgggttatactttgtcggtatggatgaacagcgtgggcgacggatacaaatgccgtgatgccgcttctgcccaagcccatttggagaccttgtcctcagatgtcggctgtgaagccttctctaatcgtaaaaaataaggttgttttgccaataccgtctgaaaatcaatgttcagacggtatttttatgggtatagtggattaacaaaaatcgggacaaggcgacgaagccgcagacagtacagatagtacggaaccgattcacttggtgcttcagcaccttagagaatcgttctctttgagctaaggcgaggcaacgccgtactggtttttgttaatccactatacatcccgtcattcccacgaaagtgggaatctagaaatttaatgttgcggcactagccaaaaaaaccgaaaccgacaggtctagattcccgcctgcgcgggaatgacgaatccatccgtacggaaacctgcaccacgtcattcccacgaacctgcatcccgtcattcccacgaaagtgggaatctagttttttgagtttcagtcatttccgataaattgccttagcattgaatgtctagattcccgcctgcgcgggaatgacgaacctatccgtacggaaacctgcatcccgtcattcccacgaaagtgggaatctagttttttgagtttcagtcatttccgataaattgccttagcattgaatgtctagattcccgcctgcgcgggaatgacggattttaggttggggtcatttattgggaaaagcagaaaccgctccgccgtcattcccacgaaagtgggaatctagaaatttaatgttgcggcactagccaaaaaaaccgaaaccgaacggactagattcccgcctgcgcgggaatgacgaatccatccatacggaaacctgcatcacgtcattcccacgaacctgcatcccgtcattcccacgaaagtgggaatctagttttttgagtttcagtcatttccgataaattgccttagcattgaatgtctagattcccgcctgcgcgggaatgacggattttaggttggggtcatttattgggaaaagcagaaaccgctccgccgtcattcccaggaaagtgggaatctagaaatttaatgttgcggcactagccaaaaaaaccgaaaccgaacggactagattcccgcctgcgcgggaatgacggattttaggttggggtcatttattggaaaaagcagaaaccgctccgccgtcattcccacgaaagtgggaatccagttttttgagtttcagtcattcccgataaattgccttagcattgaatgtctagattcccgcctgcgcgggaatgacgaacctatccgtacggaaacctgcaccgcgtcattcccacgaaagtgggaatccagttttttgagtttcagtcattttcaataaattgccttagtattgaatgtctagattcccgcctgcgcgggaatgacgaatccatccatacggaaacctgcaccacgtcattcccacgaaagtgggaatccagttttttgagtttcagtcattttcaataaattgccttagcattgaatgtctagattcccgcctgcgcgggaatgacggattttagtttggggggcatttattggaaaaagcagaaaccgctccgccgtcattcccacgaaagtgggaatctagttttttgagtttcagtcattcccgataaattgccttagcattgaatgtctagattcccgcctgcgcgggaatgacgattcatatagtggattaacaaaaatcaggacaaggcggcgaagctgcagacagtacagatagtacggaatcgattcacttggtgcttcagcaccttagagaatcgttttctttgagctaaggcgaggcaacgctgtactggtttttgttaatccactataaaaaggcatattgaatgcgggcaaaccggctgctttccgtttttggatttcggagaatgccatcgcccagctttcatcacacataaaaaacagtgcgggcacggcttttttcagcggtattcctttcaggtgcggggcaagcgccgcccccatcaggatatgccgagaattaatcataaaggttacggtggcgataagcagtatcggcagaggttccgcccacaggttgaccgtggcaaactcggagccgccggcgaagttcatactggtcatcaacaacatttccagccagctcatgcctttttgtccgccctgcataccgagtattaatgcccaaggcagcagcccaatcagcataggcgaactttctttgatgccgcgtataaattcgttatgcggggaaggtgtgcataatgttcgtcttcataaccggaagggcgggaattatacactggcaacggatttcaaaacaaaaccgatttgccgtgtttcagcgtaaacacggcttgtgtataatctcccatctttgaaaccggccgtatgcaggagcaagacgatgaatattgaagtagaaatgaaagtattggacgaacggatggcggatgttgtccctgtctatgcaacggagggttctgcaggtttagatttgcgcgcctgtttggatgaggaagtcgttttgcagccgggtgaaacgtttcttgtgccgacgggtttggcaatttatttggcgaatcccgcatatgccgccgttttgctgccccgttccggcttggggcataaacacggcattgttttgggcaatttggtcggtttgattgactccgattatcaaggggaattgaaggtgtcgttatggaacagaagcagcgaaccgtttactgtcaaaccgtttgagcgtatcgcgcagatggttgtcgtgccaatcgtgcaggcgggcttcaaacgtgtcgaggagtttgtcggaagcagccggggtgagggcggcttcggcagtacgggttctcactaaaaatatagaatgccgtctgaaagacacgtcaggttcagacggcatatcttccgatataccgacaaccggagaaaatcatgaataccttactcaaccaactcaaaccatatccctttgcccgactgcgtgaagcgatgcagggcatttccgcgcccgaaggtctggaagccgtccccctgcacattggcgaaccgaaacatccgacaccgaaagtcattacggatgcgctgaccgcctcattgcacgagttggaaaaatatccgctgacggccggtctgcctgaactgcgtcaggcgtgtgcaaactggttaaaacgccgttacgatggcttgacagtggatgcggataatgaaattctgccggttttaggcagtagggaggcgttgttttcttttgttcaaaccgtgttgaaccctgtttcagacggcatcaaacccgcaattgtcagcccgaatcccttttatcagatttacgaaggtgcgacacttttgggcggcggtgaaatccattttgccaattgccccgcgccgtctttcaaccccgattggcgcagtatttccgaagaggtttggaaacgcaccaaactggtgttcgtctgctcgcccaacaaccccagcggcagcgtgctggatttggacggctggaaagaagtttttgatttacaggataaatatggtttcattattgcctcggatgaatgctattccgaaatctatttcgacggcaacaaacctttgggctgcctgcaagccgctgcacagttgggtcgaagcaggcaaaaactgcttatgttcaccagtttgtccaagcgttccaacgttccgggcctgcgttccggttttgtcgccggcgatgccgaactgcttaaaaactttctgctttacagaacctatcacggcagtgcaatgagtattcccgtgcagcgcgcaagcattgccgcttgggatgatgaacagcacgttatcgacaaccgccgtatgtatcaggaaaaatttgagcgcgttattcccattttgcaacaggtatttgacgttaaattaccggatgcctcgttttacatctggttgaaagtccctgatggcgacgatttggcacttgcacgcaatttatggcaaaaagcggctatccaagtattgcccggacgttttttggcgcgggataccgaacagggcaatcccggggaaggttatgtgcgtatcgctttggttgccgatgtcgcaacttgtgtcaaagctgcggaaaccattgtttccctatatcggtaaagaataaaaaaatgccgtctgaacttttgttcagacggcatttttcaatattttacggttgaatttgctataacggtatttatagtggattaacaaaaatcaggacaaggcgacgaagccgaagacagtacagatagtacggcaaggcgaggcaacgctgtactggtttaaatttaatccactatacttcacttttaatcggcttgcccgcaaacacgtttaaacttaaaatccccgtgtttgacacaataccgagcagattatgttttttgtcctttcccctgcgaagaaccttaatgaaaaagaccctgcccctgtcagcgagtttacccaacccgacctgctggcagagtccgacattctaatgcagcagttgcgcgagcttgcgccgcaacagattgccgaactgatgcacgtttccgacaaaattgccctcttaaacgcgcagcgcaatgcagaatggaacacgccgtttacgccggaaaacgccaaacaggcggtctttatgttcaacggcgatgtttacgaaggtatggatgcaaacacattggatattggacagatacgctatctgcaaaaccatgtccgcctgctgtccggtctgtacggtcttcttcgcccgttagacctgatacagccctatcgtttggaaatggggacggcatttgccaatttgcgcggcaagaatttgtatgagttttggggcgacatcattaccaaccttttaaatgatacgcttgcccaagcaggcagcaatacgcttgtcaaccttgcctcacaggaatatttcaagtccgtcaacacgaaaaaacttcgggcgcggctgattaccccaatatttaaagacgaaaaaaacggtaaatataaaatcatcagtttctatgccaagcgcgcgcgtggattaatggtgcgctatgcggcagaacatcatattaccgaccctgaaatgctgaaaaattttaattacgaaggctacgcattcaatgacgcggcttcaaatgaaagcgaatgggtttttatgcgttcggaacaaataaagtgaaaacaataaattaagtattttccgaaaaaagtgcttggcaaaatgtataaatttcattattattcctaatcttcaagaagacggaagcgtggcagagtggtttaatgcaacggtcttgaaaaccgtcgagggttgatagccctccgtgagttcgaatctcaccgcttccgccaatttttgagcgtaaaaccaaataagaatgcaatagccgcaaatattgtatttttatttggttttactgcattatcggaaacgtggcagagaggctgaatgcagcggactcgaaatccgctgagggtgcaaatcctccgtgggttcgaatcccaccgtttccgccacaaaacaaaaccgccctgattcggggcggttcttttttgttcaagttgtatcaattaccatataaaaatcatcggtttgccctatcataacgcatcaaagcaaatcatttgcaatcttgcggcatcttcttattgcatttttttatggtaatgtgtatggtaatttttggataaatgggaaattaccataatggcgaaaatcattacgccgctgtcggcaaatcaggttaaaaatgcgaagccgcgcgataagctgtataagttgtcagacggggcgggctggctttgtgggtctacccgacgggcgggcggagttggaagctgtcgtttgtgcaggatggaaggcagcagacaatttcgctggggcggtatcctgatttttcgctggccgatgcgcgggaatggcgggaggaggtgcgccgaaaacgggcgcacggggaaaatgtcgtcaataagaaggtgcgggcggattttgcttttgagaaggtggcgcgtgattggtttgtgcgttggtcgaaggggcggtctgaaaagtatgccggacaggttatgcggaattttgagcggtgggtttttccggctatcggcaatcttgatattcgtcaaatcaggacggcggatgtggtcggctgtctgcgtgtgatggaggcgcgcggtatcgttgatacgttgcgcaaaacgaaaaacagtctgaagatggtgtttgcgtttgcggtcggttcgggaatgatggaaatcaaccctgtcgcgcaaatcggttcgggtgtgtttgaacgggcgaaaacggggaatatggcagcgttgagtccgtctgaattgccgcgcctgattgattttttggagcagcgcaatgaatttgcggtttatgcgggcagggtgcgtatccatcctgtaacgcggctttgtatctattggctgctgttgacaatgacgcggattcaggaggcggcgttgatggagtggtcggagttggacggggaggtttggcgtatccccgccgaacggaaaaaggagcggcgggggcatgatgtgccgctgtcgcgggcgatgcagtgggtgttggatcaggcgcgggcgttgaatgtgaacgggcggtttgtgtttgaaagtgtgaattttcaagggcatatcaataaggaaagtccgcgcgtggcgatgcagcgggcggggctggatacgacggcgcacggtttgcgctcgcttgcgcgtacttatttgcgcgaggttctgaaggtggatagtattatgcggaaacgcaaataaaaaaccgtttccgcatttttattggaaggcttttttgcaaccgctttacacaaaggcggttttttgtgtaagaactgctataatagcagcccgtcatcgtcaggagcggctaatgcctttaaaattccaaccaagggaacgttcggttatcatgtgcgactttcgcggttatgaagaaccggaaatggtcaagaaacgccctgtcgtcgtcatagcgcgaaacaggcacaacggcaaactggtaacggtcgtacccttaagcagcacagaacctgtccctttggcggactaccaccacaaaatgagtggaaaccccttaccggacaagccgcacatccaatgttgggcaaaatgcgacatgacggcaacagtcggattggcacgattagaccgatacaaacccaaagggcgcgaccgctgcattccaataatcagtgaagaggattttcaggcgattaaaacagccgttgccaaggcattcaaactgtactagaataaaaccgttcccttaaaggggcttgcaagactgttctgaaatatgggcagccgcgcacgggcgacaggcgatgacaagccgtccgtgcgtgtgatggggcgcggaatgcgccccttgtcgtatctgcaaacgcctacaaatccccaatcagcctttcaatcaaggctgttttggacaaacccgcctttgccgcctcctgttccagtttggctatcgttgtgtccgccttaacgggcgatttaagaaccgctttacacgaaggcggtttttttgtatagtccggttcacgaggtacagaatcttgaaaatagtcaagcaatgccgtatattccgacgcaaggatttattttcaacatcagcttaaggggatgacaatgggacatatttattcggaaagccgtgatttccgcctttcagacggctgggacggcaatgactgacaacctaatacagatagcaacgccgatattgactgttatcggcgtttttgttgccgcttacggcatcatgaggaatacagaaaacgccaaaaagcgcgctgatcatggccgaacgtaacaatgccgcccttcaagaagccataaccatagtaaacgggctggcaaaaacagacggatgcatactcgccacctatacatcggataccccggacaagaagaaagaccgtgaagccatactgacagttttaaaccagcgcgaatttgtctgtgcgggcgtattaggcggagcactgcacgagaaaatgtataaagatttcgaatactccatgctgttacgtgactgggacaacctaagcagctttatttttgaaatacgccgtatcaggagcgcaccgacggcctttcaagaatttgaagccgtagcccgaaaatggaagaaaaagcctctgaaaaccaaatagcttaatagcttaacatccgccgcaacataggccgtctgaaattcagacggcctttcagtttgccgcctacggttttttgggaaaccccttgcatgtgcagggggttttgttttatattcctgttcgtggcgtcagaaaccacactacagcggcaatcactccgtcaatgtgattttttcatgtctatagttttctttccttgttgtttgtttcgatagcaggaagtttctatgaccgcgtgggcgacgaatacaagacccgaaaggggaataagtccgccctcctatgtgggttcttaaccgcgtgtccgcccatttgggctaattctcttgacacatttccataactctatataatatttcccacggtgcttgaaaacacctgacaaacagcgtatatccaacacgatagagtggaattttttacgtctatacgtatcaaatcgatttactcctatgtgggggtgcgcctacccgtaaggctggcggcgcgcctgtttgcgtgttttcaacacccctgcgcccaatttgggcattcctaaatcctacatgctgttgaagaccgcgaccctatccgccacatggcggcttttttatgcttgcagaaaatagaaagattggatatattacgaaacacgaggcgtcgaaaacctctactagaacggcatttaccccgtcagcgtgaattttttacgtccataagttttcttgtttggttgtttgtttcgatatatccgaactagtttcctatggtcgggagggtgcggaatacaatacccgcaaggggaataacgccggccttttctagtaggttttcgaacctcccgaccacccatttgggtctttcgaaactaaactaggaaactatcatgaacgtatctgttctcaattttggtaacacccctgtatctttccgtcaagacggttttttaaatgcaaccgccattgcatctcactttggcaagttacctaaagactacctaaaaagtgaacaaactcaacaatatatctctgcacttgctgagaatttaagcgttaggagaaaaatcctaacggaagcaaatcaaatagttatcgtgaagcgtggtggcagtgagcaaggcacatggctgcatcccaaactcgctattcactttgcccgttggcttaatccgaaatttgcggtttggtgcgatgagcagattgaaattttacttaacggcaaaatttcagacggcataaaaacagttacccccaaacccacccgcgcccttccggacggcttgaccggcgaacaaatcgaagccgtcaaaaaactgcacaacgccctgaccaaatccgcacccaaagaagcgcaggcgcgtatcgccattaccctttggtctgccgtcaaaagcaagttcggatgcagctacaaagaagtacctgccgaacagttccccgaagttttaagcgtgatgggccgcgtggcagttgaaaacggcgtgctgtacggcgaagtcctcgaccgcgaaccattgcccgcaccgcaacctgccctgcccatcagcggcaacgccctgtacgacctcgccgttgccgtcagatacggcgcgtgggccatccaaatgggcagagacgtttccctgccgctgaagcagctcggctgcaaacaggcggtaacgatgtggacggtctgggcggaaacacgcagccgcctcaaagccgccgcaaacgccctcgaagccttaaacgcacacgccgacgcggaacacgcggcaaaaatccgcccgatgctgcccgaaatccgcaacctgtcgtcggtttgatgcagtagggaatacaaaagccgtctgaatgtgaaaacgccctaatcgggcgtttttttattgctgtaaccccagggcttccaaaacttcgcgggtgtcccatacgggggatgtgagtggggttttcagacggcacggtatccgtccgtctttttccatacgcagcagtgtcgagtttgaaatggggcggttgcggcaggttgcgtaggcaatcagttcgcggatggtcgggcggtctatccttgcgcccagttcgttgatgttcatttttttactctcctgtaatgactcggtttctggaagcggcgtaatacggcatcggcggccgtgatgaaaagccataccgccaatgcctcagcgccggaaaatgacagcgcgatgatgatttttaatagggtgtccatcaggctttccttttttctctagtttcgtactcataaatgaacatcgggaacgcctgcccgcttctgacaagatttaaatccggtatctgatcggtaatcagacaagaaaaccgcccgtccccgccgtttcccgtcgaacagcaaatcacaaggttgccgccaaatggaatcgtatcttgattcgtgttcatctttactgctccggcaaatacgttttaaaaatcaaatcttcaagtcggcggtaaaccttcccggtctgcaccaatgactcggtttcgggaagcgcggccaaaagcttccgcatatgaccggcaatcgcctgtaacacaagctgctcgccgcgcgttttgttgtgtttggcaaccatcgccgccagcccgtaaaccgccaagtccatcattgcctccacgctgtcggcttcagcggaatgcaagagattaatctctatgtcattcttgatgttctcgttttcttcctgaaagttcatttttccagctccggcacttccgcgtcgccgtgtatccatcggtagtctttcaattcttcggcttcgcgttgtctgatttcggcgtcgatttgggcgttcaacccgtcaatctctgcctgtttgtcggcgacggctaagcgcatagcggtcaggctgttttcagccttgacttgcactgcggcttcggattgcggttggcaggcgtagatgccggcggctgcgactgcgagtaaggcggtgcggatcaagtatttcattttgattcctcattattggggtaacggcttaatatcaggcagcgtttttgaggttgtcttttgtcagacagatgagcgcctttctgacggcggcaaagggggttttgtactctggctctatgccgacaagtagctccccgtctgtgttgatgatgtcgcatccgtagcgttcggtggggtagccgtagtcgtttttcccctgttctgaggttactcggatgtcgatggagtattcttctgtgatggtcattttggggtctttcggatttgggtttttgtggaggtcgtctgaaggttcacgatttcagacgacttttttttaggcgattacgccgaaatagatgtcgatttcagggaaggctttttgtacggcttcggaaatgtcttttgccgcttgttcgattacagcatcgatttgctgcaattcgtaccacaggacgagtgcgccgctgtttttgtcgatgcggaatttcaacagggcttcaacaaagtaggatgcaccgccttgatgcggggtgaactcgatgccgaaacgttcaaacattttgaggtttttctctgtttgccctgagtcttcggattggaaggtaaagttgattctgccgtcctgttcacgatagccttgtttgaaggtggttttttcggtgtactcgagattgagcgcgaaatccaatacttcggcggcggtcgggtaaacggaattttcgttaccgggatttttggatacgatgttgcgggcattgttggtcaggaaatgggaaaactccatctgattcatgcggtgcgcattgttgttcagccagttggatgccgatgtagtgtgttgcggggtgtatacggcataaaaatcgagccagcccggagcttgttgcgtatggccattgatgacggcggtgacatcaatacgccctgatttgaaatcggcatcaatgtagatttgtgtgccgtcctgtttgtgtttttgtacaaacttaataagactggcggtatcgtgcatgaggaatttgccgcacttgcggtacgggttttgcatcaattcggggtgtgatttgtatctccagccaccgtcttggtctggtgtgaatacaagcggagtattgttcggtgcaaactcaaaaaaaggtttttgagctgcttgtaaggcggttttaatcatgttttcttgggtttccattttagatttccttttgtgtttgagttagttggatctgaccattttcaacgtgcttgacgtattggaaacttgtttgagtttcaattttccttgtgccggatcgtcggcttggatgttgccgtcaggtgtagcaaagacgatgccgccttcgcgtttttctttgggcagtttggttgctacatcgtggctgatttttaccgttccgctttggatgttttggggttggattttgagcttgacagtaatttctgactgtttaccgtgagcaaggcaggcacgcaccgcttcactcatggcttcgcctaattcacggtctaaccagccgctatttacggtcggtatttgcttggaggcaggaacaaatttcttttcttgggtttccatttttgattttcctttaaagagaggttagttaggttgccggtatcacgggatgacaataccgaggaggttatttaattttgagaatttccaaagattccacggtggagcgggctattccaaactcgttaagtgcggcaaagccggctgctggtatggtggatgctccgtaatttatttttggaataaaattttcgttcagggcgacggcggttcttgcgagatttagcaaagcgtcgaaattttctttagggatggtgatggtttccatgtcggtactccatgtggctgttgtttgtttcgatgggtgtatttaaacatagcgtttaataatatgcaacaatctgtttaagatttttgtttaaggtttataaacattttgattattaaaagaatttatttttgagatttcgcaggcgcaaaaaaaccgcctattaaggcggctttgtcggttttgtgttgttttcaggttcggcggggcatgaaaaaagcccgcataatgcgggcgggttgtttaatctgtggggtcgtatgccacatcaactatcagcttcgttttccttaggtgttggttgatagcataaatttcgtgccatgccttgcttagataatactgccgaagcatcgggattttagatagccggtgtggcattgggatatttcgtgcgcaccatagccgcaacagagtgtcttcgtcatcgatttggatatgttttaagattaagccgcttgaaccgacgggcaatagataccttgcgtcagggttggcaaaatgcttaccggaaccatcaaagtcatacaatacatttggcttgaggtctttgtagttctcttttctgcgcggcgcagatacttcgccaagccactcaaagcacagggttgctgttctgtgatgcagctcgtgaaccttcaactctccttgtacgccaaggaaattcataccggcatcgtactcaccaggccaccaaggggaatcaaaacgcctatttttgacaatcttgaaagccctatcaatattatctcgtcgtaatagcaacatttttcaatccagcacgctccaccaaaataccctgccgataacggtcaggctgtccaagggggcgttttcgtcgccatagaaaccgctgttgtggctgcgtatcagaacgctgttgccaggctgccgtatcaggtacttcacgcggaacataccgtcctgggcgaaggcgtagattttgccgtcgcgtatggcggtttcgcccgtatctacggcaattgccgcgtcttctgcgattttttcctccatactgtcgccggtcagggtgcagcaaaacacgttgtcgggattgatgcctttgcgtttaagcgtggatttgccgaacggcaggcggtagccgttgtaatcggggatttcatacgtgcctactccgcctttgaagcagctctctttgaggtaggggacgaaaacataatcatcgtcgggcagcgggtcgttgctgctccacgtcatcgggcggtggatgtctttgacttcgtggggtaggtcggggtcaataaggacgggcgcggttcggctgccttcacctgttctcagccatgtttcagatacaccgaatgcttttgctacttcaggcagcgcctttgccgctatgccacgactttcccagtttttcaaagcctgttggctgatattcagacgctctgctatgtcagccggctttaaaactccctgctctttggctatctcaaaaagtctgtcagttgtctcgtgcattgtcatttttaatcttattcgcggttggcttaattattctcccatatttaaacaaaatgttgttacacaagacttgatttttatctaaacatagtgtttaatattagcattagatttaaacatttggtttatttatggataaaagagtcaatgaagacaaacgcctgttgcaatcaatcggcagttacgcggaagttggtcgaataacagggaatagccctcaatgcgttttcaattggacgaagcgcgggatacctgcacgaataaaacttaagtatcccgacctgtttttgaactcaaagaaaccagacgaccaacccaaataaaaaaagcctgtcgtggaaagctcgccgcgggctggggaagccgcattgatgacgataatttttaatattgcttggattcggatttcaagtgcaacactagtgtattagtggttggaacagattcaagaataaaacacttggcgtttcgtagccaagtgtttttcttggtcggtggttcaactcatcttgaaccctgcgtatctcccgatcactgatgttacggaaatcggtttgtttggggaagtattgccggatgagtccgttggtgttctcattcagccctttctcccaagaatggtaagggcgacaaaaataagtctccgctttcaatgctttggttattttggtgtgttggtagaactctttgccgttatccatggtgatggtgtgcaccctgtctttatgtgcctttaatgtcctaacagctgcccgggcagtgtcttcggctttgaggctatccaatttgcagatgatggtgtagcgggtaacgcgttcgaccaaggtcaataatgcgcttttctgtcctttgccgacaatggtgtcggcttcccaatcgccgatacgggatttctggtcgacgatagcgggtcggttttctatgccgacacggttgggtactttgcctctggtccatgtgctgccgtagcgtttgcggtagggtttgctgcatattctgagatgttgccacaacgtgctgccgttgcttttgtcttggcgaaggtagcggtaaatggtgctgtggtggagcgtgatctggtggtgtttgcgcaggtaggcgcatacttgttcgggactgagtttgcggcggataagggggtcgatgtgctgaatcagctgcgaatcgagcttatagggttgtcgcttacgctgtttgatagtctggctttgccgctgggctttttcggcgctgtattgctgcccttgggtgcggtgccgtctgatttcgcggctgatggtgcttttgtggcggttaagctgtttggcgatttcggtgacggtgcagtggcgggacaggtattggatgtggtatcgttcgccttgggtcagttgcgtgtggctcatggcaatctttcttgcaggaaaggccgtatgctaccgcatactggcctttttctgttagggaaagttgcacttcaaatgcgaatccgccgtgcgctgaaattcgaccagttgatactcgaatttcctgagcgcggggacggcgcatgggtacacatcggtttccgacgcaacagcccgcaacgcaaccagatactgaccgcaaccaagaaaaacggcaaaaccgtgtatctgcccgggctgcatccttgaggtcgtctgaaatggatattttattgaaatactggaagccggtaggtgtattgctgctaatcgtcctgatttttaccgcatggcatttcgaccgtgccgaaaaataccgcatgggacgggaggctgctgctgccgaaatctcgaatcgtctgaaagacggctatatcgagcaggcaaagcaggcgcgttctgccgagcagaaggccgctgccgcgtttgccgaacgacaaaccaaattagaagaggaaaaacaaaatgctgaaaaaactgttgccgctatgcgtcttgagcttaaccgcctgcgccactacgccgccgcccaaaatcgcaacagaaacctgcccgcaaccgctaccgccgccaccgcatctgatggcgcgtcagattcccaaggctggctattattcggacagtgcgctgaaaaatatgcaggactggcagaaacagccgacggacatgcagccgatttaagggaatggcaggcatatggtcatgcagtaagcagtcagcgtgccgaataagcaaccgcccgaacctgtaagaaaagattacaggttcgggcggtttcagcatttaatcgaataagacggcgccgatgcgcgccagcacatcgtccaatacataatcgggtacagtttctttaaaagaagccttgcggatttgccagtctagagatttgagctggtggcagtggacattgccctgcgtttccgttcctgcaccgagtaaggttgaaatcatgccgctgcttcgtgcagctgctgcattcccctgtgaaatggggcaggcaaaaaccaatcccgttgcgcggttgaatgcttttggagacagagccagcgcaaaccgcccgcccttgatttccttgccgctggaagggtcgaaattcaaatggaaaatatcgcctttgtcgggaatatacatttcagacgacctcgttgccggcatcatccaagatttcccagccttctacgcgcggcggggtttcttccatttcggcaagcaagtctgccaagcggaaacgtcgggcagcacgcacacggagttcgccgttatgtacttccgctaccaaagcgtcgccgattttaaaatccaattgtttcagcatgtcggcaggcagtcggacggccgccgagttcccccatttttggacacgcaacataatcttcacctttattgtatctacaaagtagatacatattaccataaaatttcagttgttcaaatacttgtgcagaatacgccaaaagccgtccgaactgtttcggacggcttttgtactgtatttgcgccttcaggcaatattttgttatccattttcaagatgcaaaagctttctaattgcttgatgtcggatttcggttgtttagggatacaaaaccaagtaaactaaaactgtttgattggaaaatgctccgcaaggagaaaattatgttcaaaaaatcactttataaggctgctttggcgtatttcggcgattgcgtggctgcccatatttcagaacagttttgactgtttattcacaaatcagatgcctttagggggtttgctttccataatgcaaccaaaatttccaactctctaaatattgtgtctttgcgttcttcttcgcgtattttcataacaagaggcgaaactgcattccacaattttatgaagttggtgcaatgcagccgtttaaacaaatcctcatccaatactcccgagttgattgcgcacgcataaaactcgtgccgattgattacggtaagtaaatgccctctctctttttcccattgtccgcccttattttgataaatttcatacaggtcgatccgcgcgttgttgtcgtcaactgccgtgccgcgaatataaggcgaaatatgattgtcggcttctacaaattgtgcatcttggtaatcattcaaaataacatctaatgtcgccttttgctttgaagttttcttattgatgaatattgtccccagtgcaatgacggcggttactgaaacaacggtcagttgccaaaacatcagccattcggccgtccctcataggttaaactgtacgctgtgcctgaatatgtaaaataaagtgaatacagatacaaacaaggaggttagggcaattactgacaaccaacctccttgttttatttgtttccgcaccttaccagccattaaaaccctcatttttgtatttcatcgtatttccttaatggttttaaccttgcttgtcgatatctgtatattaatgccgtgcgcccgttctttcaaggggtgatttaaaaatcaggcatccttgacatcctctcctgcttaaaggcggggggactcctgccgtgtaaaccaatgccgtctgaagggctttcagacggcataaaaaaaccgcctttgtgtaaagcggttgaagaaaagcctttcaataaaaatgccgtctgaatttcagacggcattgttgtcggatatgcctattccttatccagccggcgcagggtttcggcgagctgtttgaagtcggtttctcccgccgccaaactgacaatcaagtcgtcaagcccttggtcggcggcaatgctgatgccctgcaaatccagataggtcaacattgttaaaagcgcggtgcgcttgttgccgtcgggaaaggcgtgggctttggctatggcttgtgcatagagggcggcgatttcgtagatgtcctcaaggttttcatactgccgccagttggcaatccgcgacaatgcgccgtccaagcgcgccatatccgcccgccctttcaaacccgcttcatccgccaatacggtttgatggataagcgcgaccagttcgccgtctatcatttgtcggcaagtgccttgacggctttttgatgggttttggcaatgcggcgggcggcggcaagcagtacgcgtttgcctgcttcgcctttaagctcgattttgacggggcgtgtattttggttttgcatcgctgctccttgtctgtttgcgggcattttagcttttttccggcagcttgggaaatgccgtccgaaaacacttcagacggcattcttctaatagtgtaatgcaatagttactccaagatttttgtatatggctgtttttatggtaaattaaattttcataagaaataaatatatttaaatcaatgaaataaaatttagtcgaatcccaccgtttccgccacaaagcaaaaccgccctgattcggggcggttcttttttgttcaagttgagacctttgcaaaattcctttccctcccgacagccgaaacccaaacacaggttttcagctgttttcgccccaaatacctcctaattttacccaaatacccccttaatcctccccggatacccgataatcaggcatccgggctgccttttaggcggcagcgggcgcaaatcagtccgaaataggccgcccgggcgtagcggaatttacggtgcagcgtaccgaagctttgttcgaccacataacgggtcttagataaataccggttgcgtttggtttgcgtttccgtcagcggacggttgcggcaggctttgcgcataatgccgtcctgcaactgatgttcttccagatgttgccggttttccgcactgtcgtagcctttgtcggcatagatggtcgtaccttcgggtaacccttccaacaacggcgacaggtgtttgcactcatgggcattggcgggagtaatgtgcagtttctcgatatagccttccgcatcggtacgtgtatgttgtttgtaaccgagtttgtagaggctgtttttctttgtccaacgggcatttttgtccttactcagtgtggtttgaccgctgacttgtccctcttcatcgacttctatggcctggcgctgtttgctgccgacggtctgaataatggtggcgtcaacgacggcggcggatgctttctctacttttaagcctttttcggtcagttggcggttaatcagttccaacagttcggacagggtgtcgtcttgcgccagccggttgcggtagcggcataaggtgctgtaatcggggatgctcagttcgtcaaaacggcaaaacaggttgaagtcgatgcgggtgatgaggctgtgttcgagttcgggatcggagaggttgtgccattgtccgagcaggacggctttgaacatggacaacaggggacaggcgggacgaccgcggtggtctcggaggtaacgggttttttgacggttcaggtattgttcgatcggctgccaatcaatcacctggtccaacttcaatagcgggaagcggtcgatgtgtttggcaatcatggcttgggcggtttgttgaaagaaggtgctcatgagaaatcccctaaatgtcttggtgggaatttaggggattttggggaattttgcaaaggtctcgaccttgtgttttttaaggtattcgatagtatgggcgatacctttggggttgttggtttcggttttggttttagacaaagacgaaacggcgatgacgaagtttcgtttggcgatgtcgatatagtgaattaacaaaaatcaggacaagacgacgaagccgcagaaagtacagatagtacggaaccgattcacttggtgcttcagcaccttagagaatcgttctcttcgaactaaggcgagacaacgccgtaccggtttttgttcatccactataacagcaaccctgtcgccgtcattcccgcaaaagagggaatccagtccgttcagtttcggtcatttccgataaattcctgttgcttttcatttctagattcccgcttttgcgggaatgatgacggaagggttttggttttttccgataaattcttgaggcattgaaattccagattcccgcctgcgcgggaatgacgattcataagtttcccgaaattccaacataaccgaaacctgacagtaaccgtagcaactgaaccgtcattcccacgaaagtgggaatctagaatctcagactttcagataatctttgaatattgccgctgccttaaggtctggattcccgcctgcgcgggaatgacgaatccatccgcacggaaacctgcaccacgtcattcctacgaacctacatcctgtcattcccacaaggacagaaaaccaaaatcagaaacctaaaattcgtcattcccgcgaaagtgtgaatctagaaatgaaaagcaacaggcatttatcgaaaataactgaaaccgaacagactagattcccgcctgcgcgggaatgacggctgcagatgcccaacggtctttatagtggattaacaaaaatcaggacaaggcgacgaagccgcagacagtacagatagtacggaaccgattcacttggtgcttcagcaccttagagaatcgttctctttgagctaaggcgaggcaacgccgtactggttttttatatccaatgggtgcggcgtttaatcataatcaggcagatagggataactaatgccgtctgaacgacgaatgttcagacggcatttttacctttgtgcttataaggcgtttagtgcctgattaaaggttacgctcggacgcatcacttgtgcggctttttcaggattggcggcgtagtagccgccgatgtcggccgctttgccttgtacggcggaaagctcggcaacgattttcgcttcgtcggcggtcaaagcggctgccaatggcgtaaatgcggctttcagttcggcatctttgtcttgcgccgccaattcttgcgcccagtagagggtgaggtagaaatggctgccgcggttgtcgagttcgccggctttacgtttaggcgatttgtcgttcaacagcagtttttcggtggctgcatccaaagtgtcggcgaggacttgggctttggcattgccggttttttgcgccaaatgttcaaacgatacggcgagtgcgaggaattcgcccagcgagtcccagcgcaaatggttttcttcgaggaattgttgaacatgtttcggtgcagaaccgcccgcgccggtttcaaacataccgccgccgttcatcaatggaacgatagacagcattttcgcgcttgtgccgagttccaaaattgggaacaagtcggtcaggtagtcgcgcaagacattaccggttacggagatggtgtcttcgccgtttttcagacgacccaagctgaacttggcggcttcttcaggagcgaggacgcggatgtcgaggccattggtatccagttcggcaaggtaggctttaaccttggcgagcaggctcttgtcgtgcggacggttttcgtcgagccagaacacggcaggcgtgttgctcagacgggcgcggttgacggcaagttgtacccagtctttaaccggagcgtctttggtttggcacatacgccagatgtcgccggcttcaacgtcgtgctgcattaggacttttcctgccgcatcaatgacttggacttggccgtcggcttcgatttcaaaggttttgttgtgcgagccgtattcttccgccgcttgcgccatcagtccgacgttgggcacagtacccatggttgtcgggtcaaatgcgccgtgttcgcggcagaagtcgatggttgcttggtaaacgccggcatagctgctgtcgggaatcacggctttggtgtcttgcgctttgccgtttttgtcccacatacggccggaattgcgaatcatcgcaggcatagaggcatcgacgatgacatcgctgggaacgtgcaggttggtgatgcctttgtcggaatcaaccatcgccaaatcggggttggcagcgtaaacggcggcgatttcggcttcgacggcggtgcgggtgtccgcatccagtttgtccagattggcaagcaggttgccgaagccgttgttaacgttgacgccggcagcagccagtttgtcgccgaatttttcaaaaacaggcgcgaagaatactttgacggcgtgtccgaagataatcgggtcggacactttcatcatagtggctttcatgtgcagcgagaacaacacgccttttgctttcgcatcttttacttgttcggcaaggaaggcgagcagggcttttttactcatcacggtcgcgtcgatgatttcgccggctttcagggcgacgggctcgcgcagctcttttttgttgccttgtttgtcggtgaatacgatggatacggaagtcgcttcaggtacgataacagattgttcgttatgaaaaaagtcgccgctttgcatggtggcaacgtgggttttggagtctttggtccatgcgcccatgctgtgcggattttttttcgcaaagtttttcactgctttaggggcgcgacggtcggagttgccttcacgcaggacagggtttaccgcgctgcctttgatgcggtcgtagcgttcgcgtacggctttttcttcatcggtttgcgggtcggcgggatagtcgggaacggcaaagcctttagattgcaattctttaatcgcggcagtcagttgcggtacggacgcgctgatgttcggcagtttgattacgtttgcatcgggttgtttcaccagttcgcccaattcggcaagcgcatcaggtacgcgttgcgcttcggtcaggtattcgggaaacgccgccaaaatacggccggagagagaaatgtcgctggttttgacatcaatatcggcgtggcgggcaaaagcctgcacaatcggcagcagcgattgggtcgccagcgcgggtgcttcgtcggtatgggtataaacaatggtggatttttgagtcataggattattctcttgtaggttggttttttcttttggaacacattgcgcggggaatgtgcgtggctattatggcatattttggcggctttgttcgcgctttgttcgatcttggcgtgtttgaacgcggcggcgtgaaaggaagggggaaatggttttcccgcgtttggcggcggtcggaggtgctgtgcctgatgtgcggcggcatattttcggtgaaattgattttatagtggtttaaatttaaaccagtacagcgttgcctcgccttgtcgtactgcttgtactgtctgcggcttcgtcgccttgtcctgatttaaatttaaaccactataatattcggtaactgtcggaatatctgctaaaattccgcatttttccgtcccgggacactcggggcgtatgttcaatttgtcggaatggagttttagggatatgggcttgaaaaaggcttgtttgaccgtgttgtgtttgattgttttttgtttcgggatattttatacatttgaccgggtaaatcagggggaaaggaatgcggtttccctgctgaaggagaaacttttcaatgaagagggggaaccggtcaatctgattttctgttataccatattgcagatgaaggtggcggaaaggattatggcgcagcatccgggcgagcggttttatgtggtgctgatgtctgaaaacaggaatgaaaaatacgattattatttcaatcagataaaggataaggcggagcgggcgtactttttccacctgccctacggtttgaacaaatcgtttaatttcattccgacgatggcggagctgaaggtaaagtcgatgctgctgccgaaagtcaagcggatttatttggcaagtttggaaaaagtcagcattgccgcctttttgagcacttacccggatgcggaaatcaaaacctttgacgacgggacaggcaatttaattcaaagcagcagctatttgggcgatgagttttctgtaaacgggacgatcaagcggaattttgcccggatgatgatcggagattggagcatcgccaaaacccgcaatgcttccgacgagcattacacgatattcaagggtttgaaaaacattatggacgacggccgccgcaagatgacttacctgccgctgttcgatgcgtccgaactgaagacgggggacgaaacgggcggcacggtgcggatacttttgggttcgcccgacaaagagatgaaggaaatttcggaaaaggcggcaaaaaacttcaaaatacaatatgtcgcgccgcatccccgccaaacctacgggctttccggcgtaaccacattaaattcgccctatgtcatcgaagactatattttgcgcgagattaagaaaaacccgcatacgaggtatgaaatttatacctttttcagcggcgcggcgttgacgatgaaggattttcccaatgtgcacgtttacgcattgaaaccggcttcccttccggaagattattggctcaagccggtgtatgccctgtttacccaatccggcatcccgattttgacatttgacgataaaaattaatcgcatagcaaatcaaaatagaaaatggcggagtgcgtggggtaaaaataaggatagcgttttttcatttggattgacgataatttctgattgctttgcgtgtgctgaaatggcaaagaaaatgccgtctgaagtcttcagacggcattgttttgttttggatgttattcgggcgcgcggaaactgtcgtggcaggatttgcagcttgcgccggtttcgccgtaggcggctttgatttcgtccagtttgccggtttgggcggcggcgttgagtttttcgacggcggcggcgaattttgttttttcggcttcaaattttgcaccatccgaccaaacggcgggcagtgcgcggccgttgccttgcggatcggactcaaaaagtgtgaacggtttcttgctgctttcggcaaacgacgctgccgcctgtttgaatttttcgacatcgtaaggttcttcgtctttgaccattttgcccatgcgtgtgaattcgggcatcatggatttgaacgcggcggtgcggttttcggaaatttcgcctttgggttgggaaggtattccgctgcctccgcaggcggaaaggagcagtgtgatggcggcagcagcaaggctgatttgggttttcatattgaatgtgtcctgtcgtggtggtatggttgttgtcattttcagtcggcgcgatgccgtctgaagggtgttatgatacctgaaacaggtttgggaaacgagaaagaaaggaaaaacaatggctgttttaattaccggtgcttcggcaggattcggcgaagcgatgtgccgtgcgtttgtcggggcgggataccgcgttatcggtgcggcgcgccgtgcggacaggcttcaggccttggcggatgaattgggtgctttgttttaccctttggaaatggacgtgtcgcgacgcgagtcggtggaaaacgccttaaacggcatccccgatgaattttccgacatcgactgcctcatcaacaatgccgggctggctttgggtctggacacggcggacaaggcggattttgaagattgggaaacgatgattcaaaccaatgttttgggtttgacgttcctgacgcgcaaaattttgccgcaaatggtggaacgcggcggcggttatgtgatgaatttgggttcgattgcaggcaattatgcttatgccggcagcaacgtttacggggcgaccaaggcgtttgtgcgccagttcagcctgaatttgcgcgcggagttggcggataagaacatccgcgttaccaatatcgagccgggtttgtgcggcaatacggagttttccaatgtgcgcttcaaaggcgatgacgagagggcggcgggcgtgtatgagggtgtggaatttatccgccccgaagatattgcggaaaccgcattgtggctgtaccagcggccggcgcatatgaatgtgaacacgattgaaattatgcccgtggcgcagacttttgcaggaatgaaagtgataaaaaaagccgtgcccgaagtgcgggaagactttgaaaaacagagtatgtcgctgttttcccgcatcaggtcctggttcaaatgatgcaaaatgccgtctgaagacagtttcagacggcatttttacgggtatttttacggagtaggcaataagcccgccaatttggggttgccttctttcggaatcgggcgcggattgccttccgcatcgatggcaacataagtgaacacggcttcggttacgaggtagcggtcttcggtaacgcaatcgttcatcaaagttttcacccagacgtcgactttaagctggagggaagtgttgcccacgcggacgcaatgcccgtagcagcagacgacgttgccgaccttgaccgggcggatgaagttcatttcctgaacggcgacggtaacgatgcgtccccgcgcgatttccgccgccaatatgccgccgcccaaatccatctgcgacataatccagccgccgaaaatgtcttggttgggattggtatcgcgcggcatagcgacggtacgcaggagcagttcgccttgagggcgttggcggttgccttcttcgtgctgcataaagtttccttgttttattgaaatataaatcgaacctgcacccctgcccgaaacgggaagtcgggaagtgtgtagtttaacccatttgagacatacaagggcgggcgcggaacagattcgcaaggcgtattgtagggcggggctgtagagtgggcttcagtccgccaatcccgccaaatcctaccctaagcaactgaaccgtcattcccacgaaagtgggaatctagaacgcggggtttcagtcatttccgatagattcccgccgcgtcgggggtctggattcccgcctgcgcgggaatgacgaatccatccatacggaaacctgcaccacgtcattcccacggaagtgggaatctagaatctcggggtttcagtcatttccgatagattcccgccgcgtcggaggtctggattcccgcctgcgcgggaatgacgggttttaagattacggtgttgtcggacggatttcaagattacggtgttgtcggaacgcaactgaaccgtcattcccacgaaagtgggaatctagaatctcggggtttcagtcatttccgatagattcccgccgcgtcgggggtttggattcccgcctgcgcgggaatgacgaatccatccatacggaacctgcaccacgtcattcccacgaaagtgggaatctagaacgcggggtttgggcaactgtttttatccgataagtttctgtgcggacaggtctggattcccgcctgtgcgggaatgacgaatttcaagattgcggtgttgtcggacgggttttgagattacggtgttgtcggagcgcaactgaaccgtcattcccacggaagtgggaatctagaacgcggggtttcagtcatttccgatagattcccgccgcgtcaggggtctggattcccgcctgcgcgggaatgacgaatccatccatacggaaacctgcaccacgtcattcccacggaagtgggaatctagaatctcgggggtttcagtcatttccgatagattcccgccgcgtcagggggctggattcccgcctgcgcgggaatgacgaatttcgagattacggtgttgtcgggaatgacgaatccatccatacggaaacctgcaccacgtcattcccacggaagtgggaatctagaacgcggggtttcagtcatttccgatagattcccgccgcgtcgggggtctggattcccgcctgcgcgggaatgacgaatccatccatacggaaacctgcaccacgtcattcccacggaagtgggaatctagaatctcggggtttcagtcatttccgatagattcccgccgcgtcggaggtctggattcccgcctgcgcgggaatgacgggtttcgagattgcgttgttgtcgggaatgcaactgaaccgtcattcccacggaagtgggaatctaggacgtaaaatctaaagaaaccgttttatccgataagtttctgtgcggacaggtctggattcccgcctgcgcgggaatgacgggtttcgagattacggtgtatcgggaatgatgggaaacggtgggaattgtgtaaaaaatgccgtctgaaggttcagacggcatcggtatcggggaatcagaagcggtagcgcatgcccaatgagacttcgtgggttttgaatcgggtgttttccaagcgtccccagttgtggtaacggtatccggtgtccaaggtcagcttgggcgtgatgtcgaaaccgacaccggcgatgacaccaagacccacgctgctgatgctgtggctttcgtgatagggaggtttgctgggatcagtttgtataataggacctccctgtgcagcgccttgcgttggtttagaggtaacaatcgtggttttggtttccaccgaatgaacttgatgtttaacgtgtccgtaggcgacgcgcgcgccgatatagggtttgaatttatcgttgagtttgaaatcgtaaatggcggataagccgagagaagaagaggcgtggaagctgccgtttccctgatgttttgtttgggtttctttgtagttgttgtttatctcttcagtaacttttttagtagaagaattactttctttccattttctgtaactggcataatctgccgctattctccagccgccgaaatcatagccgaccgacacccgggggtggatggaatgcgcacggatgtttctgaaataatcgcttaccgtgcttgtgttgtttgcaccggttgcttgcggataatcgtgggtaatgcgttcggcggcataagctaaatccgcctgcacataatacgggctgcggctgccgtcttcacttgccgcctgcgctgcggaagagaagagaagagaagagaagagaagagaagagaagagaagagaagagaagagaagagaagagaagagaagagaagagaaggttttttgggggctggattcattttcgactccgtattcggttttaactgattaaaaagaacaattttcaatgatgttgcaggagcggactatatcaggtttgtggcgatgtttcaacacaatatagcggatgaacaaaaaagagaacgattctctaaggtgctgaagcaccgagtgaatcggttccgtactatctgtactgtctgcggcttcgtcgccttgtcctgatttttgttaatccactataaagaccgtcgggcatctgcagccgtcattcccgcgaaagtgggaatctagaaatgaaaagcagcaggaatttatcggaaacgaccgaaaccgaacggactggattcccgcctgcgcgggaatgacgggattttaggtttctgattttggttttctgtttttgagggaatgacgggatgtaggttcttaggaatgacgtggtgcaggtttccgtgcggatggattcgtcattcccgcgcaggcgggaatctagaccttagaacaacagcaatattcaaagattatctgaaagtctgagattctagattcccactttcgtgggaatgacggttcagttgctacggttactgtcaggtttcgtttatgttggaatttcgggaaacttatgaatcgtcattcccgcgcaggcgggaatctagaccttagaacaacagcaatattcaaagattatctgaaagtccgagattctagattcccacgaaagtgggaatccaggatgtaaaatctcaagaaaccgttttatccgataagttcctgcactgacagacctagattcccgcctgcgcgggaatgacgggattttaggtttctgattttggttttctgtttttgagggaatgacgggattttaggtttctgattttggttttctgtccttgtgggaatgacgggatgtaggttcgtgggaatgacgtggtgcaggtttccgtgcggatggattcgtcattcccgcgcaggcgggaatctagaccttagaacaacagcaatattcaaagattatctgaaagtccgagattctagattcccgctttcgcgggaatgacgaaaagtggtgggaatgacggttcagttgctacggttactgtcaggtttcggttatgttggaatttcgggaaacttatgaatcgtcattcccgcgcaggcgggaatctagtctgttcggtttcagttatttccgataaatgcctgttgcttttcatttctagattcccgcttttgcgggaatgacggcgacagggttgctgttatagtggattaacaaaaaccagtacggcgttgcctcgccttagctcaaagagaatgattctctaaggtgcttaagcacgagtgaatcggttccgtactatccgtactgtctgcggctcgccgccttgtcctgatttttgttaattcactatatcgcgatttttcggcatttgcctttcggggcggcttgtgtctcgtgcgtgatgttgcgtgtgggaatgttcggattgtcagaagcaatatgggagaagatgatgtatgagataaaacagccttttcatagcggatacttgcaggtgtctgaaattcatcaaatttattgggaggaatcgggcaatcccgacggtgtgccggttatttttttacatggcgggccgggcgcgggggcttcgcctgaatgtcggggttttttcaatcccgatgtgttccgcatcgtcatcatcgaccagcgcggttgcggacgttcgcgcccgtatgcttgtgcggaagacaatacgacttgggatttggtggcggatattgaaaaagtccgtgaaatgctgggtatcgggaaatggctggtgttcggcggttcgtggggcagcactttgtcgctggcttatgcccaaacccatcctgaacgggtaaagggattggtgttgcgcgggatatttttgtgcaggccgtctgaaacggtgtggctgaacgaggcgggcggtgtgagccggatttatccggaacaatggcaaaaatttgtcgcgccgattgctgaaaatcggcggaaccggctgattgaggcgtatcacggattgctgtttcatcaagatgaagaagtgtgcctgtctgccgcgaaggcttgggcggattgggaaagctatctgatccgtttcgagccggaggaagtggatgaagatgcttatgcctcgctggcaatcgcgcgtttggaaaaccattattttgtcaacggcggttggttgcagggcgatagggcgattttgaacaatatcggcaaaatacggcatatcccgactattatcgtacaggggcggtatgatttgtgtacgccgatgcagagtgcgtgggcgctgtcgaaagcctttcccgaagcggaattgagggtggttcaggcagggcatcgtgcgttcgatccgcctttggtggatgcgttggttcaggcagttgaggatattttgccccatttgttgtaaaaagttccgcataaaaaagcagcttctgtttggaagctgcttttgttttgaatggtttaacgcagttcggaatggagtttgcccaataatgcggatgcgtctttgccggcatatgcgctgccgtctttgttgagcaggacgatgcgcgagccgttggcgacaggttctgcatagacaatcagttccggctgttcggcaggtttctccgctttgcctttgcccagcaggcgtttgaacaggccgggtttttgttcggtaactgcattgctttcgttcggggctttttgaaccaggaaggcgtggcgttcggtgttttgaccgacgacggtcagcccgatgcggtcgagggcgagcacggtgcgccgccagtttctgccgtagtcgccaaagacaatcaggcttttgccttcgatacgcgccatttcgttggcggcgggaagggtaggtttttttgccgatgcgttttccgcctgctgtccgtcaacgcccaaatattgcataaagcgcgtcaggaaagcggcttcgaggttgggatcggacggggagggctgccatacggtcgtgtctttgtctttgccgccgtacacttctttcatggctttgtgggcgaagaagatgtcggaaacgccgtttttgccctgttcgatacggacgatgaatttgtcgcgctcgccggtggagtagatgccgcccaagccgactttgtcgaagaggcggcgcaagctgtcttgggggattttggcgcggttttccgcccactcggtttccatttgtccgatggcgggttcttcggatttgatgtcgaagccgttttcctgccaaaaggctttcaggagcggccagatttcggcaggagacttgccgtcgacaacgagccagcgttggctgccgtcgcgctcgaggcggacacctttgacgcttttcaatacttcggcatcggcaggctgttggacggcgggtgtgcggcgtttttccaaatcgctggcgcggacggcgcccgaaccggcaggcaggcggtagaggttgccttggtcggggttgttcaaatcaggtgggacttcaagtttgatcaggcggtgcgaccggctttggtagtcgagcttgggctgttcggttttgctgccggagcaggcggcaagcccgatgagtgcgagcgcggcaatgacgggtttgatatgggtcatcgtgtcatcctgtgtgatggatattaaagtgtttgttgcgttatgccgtccgaacggttcggacggcatggctatatttaaagttgtcctgaggctttcagggcggcgcggacttttgcttgtccgttttccgtcagcggaacgagcggcaggcggacgtgcggttcgcatctgcccagggcggataccgcccatttcggtgcggcggggctgggttcgcagaacatggtgtcgtaaatcggaatcagtcggtcgttgagttcgcgtgcaagggcgatatcgccttgaagcgcggcgcggcacatatcggcaaagagcttgggcgcggcgttggcggctacggtaatcacgccgtgtccgccgcagagcatgaacggcagggcggtgtggtcgtcgccggaaaggacgacgaagccttcgggcgcgcggttgatgagttcgatgttgctgccgatgttgccgctggcttctttcacgccgacgatgttggggatttcggcaaggcgcaggatagtgtcgttagtcatgctgacgacggtacggccgggcacgttgtagataatcatcggaatcgaagtggcttcggcgatggttttgaaatgttggtaaatgccttcttgggagggcttgttgtaataggggacgacggagagggtgtagtccgccccggctttttcggcggcttgggaaagggcgatggcttcgacggtgttgtttgcccctgtgccggcgatgacggggacgcgtttggcaacgtgtttgacgacggcttcgatgacggcggtgtgttcttcgacggagagggtggcggattcgcctgtcgtgccgacggcaacgatgccgtccgtgccgttttcaatgtgccagtcgattaagtcgcggagttgttcgtaatggatgctgccgtcttgattcatcggggtaatcagggcaaccaagctaccttgtaacatacagaaccttttatcagttgtggtgtaggggcggtaatgcttccgattgtagcctactttaccgcaggtgtgaaatccggcgggttgcagatgtggggcgtttgcgccgaaaggtatggtggaaattgatttttcctgtttgaaatcattttattatattcgccggtttatgccggtgccgtcggatttatagtggattaacaaaaaccagtacggtgttgcctcgccttagctcaaagagaacgattctctaaggtgctgaagcaccaagtgaatcggttccgtactatttgtactgtctgcggcttcgccgccttgtcctgatttttgttaatccactataaaatgtggtaaacgtgtggaccagacggatgccgtctgaaatgcaaattgaagccgtgcggcagattcgctacaatccgcgcttggatttttcaacctttaaaataaggaaatacaatgagcggtcagttgggcaaaggtgcggatgcgcctgatttggtgtacggtttggaagacaggccgccgttcggtaatgcgctcttgagcgcggttacccatcttttggcgatttttgtgccgatgattacgcccgcgctgattgtgggcggcgcgctggaattgccggtggagatgacggcgtatctcgtgtcgatggcgatggttgcgtcgggtgtcggcacttatttgcaggtcaaccgcttcgggccggtcggttcggggatgctgtccatccagtcggtgaatttttcgttcgttaccgtgatgattgcgctgggcgcggggatgaaagagggcggtttgactaaggatgcgatgatttcgacgctcttgggcgtatcgtttgtcggcgcgtttttggtgtgtttctcggcgtggcttctgccgtatttgaaaaaagtgattacgccgacggtcagcggcgtggtcgtgatgctcattggtttgagtttggtacacgtcggcattaccgatttcggcggcggcttcggcgcgaaggcggacggcacgttcggctcgatggaaaacttggggctggcatcgctggtgttgctgattgtgttggtgttcaactgcatgaaaaacccgctgttgcgcatgagcggcattgcggtcgggctgattgccggctatatcgtcgcgctgtttttgggcaaggtggatttttccgcgctgcaaaacctgccgctggttacgctgcccgtaccgtttaaatacggttttgctttcgactggcacgcgtttattgtggcgggcgcgattttcttgttgagcgtgtttgaggcggtcggcgatttaaccgcgacggcaatggtgtccgaccagccgattgaaggcgaggaatacaccaaacgcctgcgcggcggcgtgttggctgacggcttggtgtcggtgattgcgacggctttgggttcgctgccgctgacgacgtttgcgcaaaacaacggcgtgattcagatgaccggcgtggcttcgcgccatgtgggcaaatatattgccgtgattttggtgctgttgggtctgttccccgttgtcggtcgcgcgtttacgacgattccgagtccggtgttgggcggcgcgatggttttgatgttcggcttaattgcgattgcgggcgtgcggattttggtcagtcacggcatccgcaggcgcgaagcggtgattgcggcaacgtcggtcggtttgggcttgggtgtcgcgtttgagccggaagtgtttaaaaacctgcccgtcttgttccaaaactctatttccgccggcggcattacggcagtcttgctgaatttggtcttgcccgaagataaaaccgaggcggcggtcaagtttgataccgaccacttggaacactgattttgaaaatgaatgccgtctgaaacagaatccctgtttcagacggcattgtttttgaggcttatactttttcgttttttaatacgcgttgtcggcgtgtttcacttaataccattccggcagacacggagacgttcatgctttcgactgtgccgaacatgggtatagacaccagcatgtcgcaatgttcgcgcgtgaggcggcgcataccgtcgccttcgttgcccattacccacgccgcgctgtcgggcagattgcaatggtaaaggtcggactcgccgctcatatcggtgccgataatccaaatgccgtattctttcaattcgcgcagggtgcgggcgaggttggttacggtgatataggggacggtttccgccgcaccgcaggcgactttgctgacggtggcgttcagccccgcgcttttgtctttcggtgcgatgacggcgtgtacgcccattgcgtcggcggtacgcaggcacgcgccgaggttgtgcggatcggtgatgccgtcgagtatcagcagcagcggcggttcgctgaggttttccaatacgtcttcgaggtggacgtggtttttggaggcatcgataaatccgaccacgccctgatggcgcgcgcctttgctgatggcgttgaggcggtcggcatcggcaaaatatacgcggatgttttcgtttgccgccttttccaacacttcgcgcgtgcgtgcgtctgatttgccttcttggatgtagagttcgacgatggatttggggttttgccacaatcgggcgttgacggcgtggaagccgtagatgggtctttggtttgccatgatggtgctttgtaaaaagggttcagacagcattatagcaatttgccggtatgccgtctgaaagggttaaaacaggtaggcgatgtatttcaccaacaggataaacaagatggatacggcgcagccgattttgaacgccgtgccgacgacaagccccaacagcgtacccaagcccgctttacctgcctgaagcatattgcgccgttcgatcagttcgcctgccgccgcgccgataaagggaccgagtattagtccgggaagggagaaaaatatgccgatgatgctgccggccaatgcgccgcgaacggcgagcttgcccgctccggtatattttgtcccccatatgcctgccacatagtccgccagtatgccggcaaggctgatgagtccgaccgtccacaaaacgcccgcgccgtagatttggtagccgccggcataggcaagcagccatgttccggcaaacatcaatgccaatccgggcagggcggggtaaacgatgcccgccgtgccgacggctatcagggcgagggcgaggatgacggtcagtacggtcataggttcaaccttttcttttgttttgaaaaaaacggcttaacacggcgcggcattcttcttgcaggattccgccccgtatggcggtgtgcgtattgaggcgtttgtcggcaaacaggttgacgatgctgcctgccgcgccggttttgggttctgccgccccgtagatcacacgcctgattcgtgcctgtatcagtgcggacgcgcacatggcgcagggttcgagggtgatatatatgtcgcatccgtcaaggcggtagttttgtatttctctgcctgcctgtgccaaggcgttgatttcggcgtgtcggctgacattgcagtcggcaatgcaggtgttgtgtgccgatgcgatgattttgccgtctgaaacgatgactgccccgacgggtatttcgccgtcggcggaggattgttctgcttggcgcagtgcttcgcacatgaagtgttccatttcttcctgcggcggaaaggcggcgacgggcggatggttttttaactcggcaagcaggcgggctttatgcgcttgggacatttcttgcggcggcgtgccgtccagcagcgactcgagttgccacagtgtgcttttcgtgagggtcaaacccgatgctttgagcagcagaaaggctttgaccgaaccgttttgccgcagttcttcgagtgtacggataccgagcctgtgcagggcggcgacggttttgggggcgagcggcggtgtggtcagcatggtttatgcgccgaaaaaccgttttgccgcctcaatcaggcgtgtgcatgaagtgcagtctgaaaacgggtcggcaacgcagtctaaaggtgttttgcgcaaccaagtcagttggcgtttggcaagttggcgggtggcggcaatgcctttctcgacaaatgccgggaaatcggtttttccatccagatatttccatgcctgacggtagccgacgcagcggatggcgggggagtaggcggtcaggccgggatagcggcggcgcaggttttctacttcgccgataaagccctgttcaagcatcaggtggaaacgcagggcgatgttttcatgcaggcgggcacggttttcgggaatcagggcggcggtatgcaaatcaaaagggagcgtatgggaggtcaggctgccgagatgtgtgctcatcggtttgccggttaaataataaacttccaaagcgcgtccgatacgctggctgtcgttcggtttcagacggcatgcggtttcagggtcgactttttgcagggtgcggtagaggaaatccaagccgtacatctgtttttgttcgtccaagtcggcacgcaggcaggcgtcggcttcgggcaaatcgttcaaaccttgggtcagggcgcggaaatacatcatcgtgccgccgacaataagggcaaacctgccgcgtgaggaaatttccccgaccaagcgcgtgcagtcttcgacaaagcgggcggcgctgtatgattcggtaggcgggatgatgtcgataaggtggtgcgggacaaaggcgcgttcggaggcggacggtttcgccgtgccgatgtccatatcgcggtaaaccagcgcggaatcgaggctgatgatttcgacaggcagggtttcggcaattttgagggcgagcgcggttttgcctccggcggtcggcccgagcagggcaaaggctttcggggtcggcataacgtttcaggtttggaaaaatacggattatagcggaaagcgtgccgacgttatattttggtttgcggaagcacgccgacggcaagggggcgtgtttaccgtatgcctttatatagtggattaacaaaaaccagtacggtgttgcctcgccttagctcaaagagaacgattctctaaggtgctgaagcaccgagtgaatcggttccgtactatctgtactgtctgcggcttcgtcgccttgtcctgatttttgttaatccactataaaatttcaaaccgacgcgccgggttttcaatatgcccgcgcccgatgccgccttgtccgcaggcatcagcggcagtgtccgattttttggggaatgcccgtcccgggcgtatttaaaggttcggcggtgcggcgttttcctgcggcaaggcttcagacggcatctctggtgcgtccgttagacaaggcgtgcgcttggggcgataatggcgttttgcttttttgaaagccttgcaatgtcccgaaacctgcttgtccgctggcttgccgtctgcctcatcccgttggcgacgcttgccgttttcgccgccaatccgcccgaagacaaactccagcatctgatcaacggcatcatccttgcctgcgaagcgacgtttttgtttaaattcgtccttttcgacaccatcaagcatcatttgaaacaagagtttgatttgaaacgtcaaactatgttgctgtttattccgattattttgctgattgtgtatttgttccactattttggcgcgttttagcccgtttccgttatttctatgaatactcctccttttgtctgttggattttttgcaaggtcatcgacaatttcggcgacatcggcgtttcgtggcggctcgcccgtgttttgcaccgcgaactcggttggcaggtgcatttgtggacggacgatgtgtccgccttgcgtgcgctttgccctgatttgcccgatgttccctgcgttcatcaggatattcatgtccgcacttggcattccgatgcggcagatattgataccgcgcctgttcccgatgtcgtcatcgaaacttttgcctgcgacctgcccgaaaatgtgctgcacattatccgccgacacaagccgctttggctgaattgggaatatttgagcgcggaggaaagcaatgaaaggctgcatctgatgccttcgccgcaggagggtgttcaaaaatatttttggtttatgggtttcagcgaaaaaagcggcgggttgatacgcgaacgtgattactgcgaagccgtccgtttcgatactgaagccctgcgagagcggctgatgctgcccgaaaaaaacgcctccgaatggctgcttttcggctatcggagcgatgtttgggcaaagtggctggaaatgtggcgacaggcaggcagcccgatgacactgttgctggcggggacgcaaatcatcgacagcctcaaacaaagcggcgttattccgcaagatgccctgcaaaacgacggcgatgtttttcagacggcatccgtccgcctcgtcaaaatccctttcgtgccgcaacaggacttcgaccaactgctgcaccttgccgactgcgccgtcatccgcggcgaagacagtttcgtgcgcgcccagcttgcgggcaaacccttcttttggcacatctacccgcaagacgagaatgtccatctcgacaaactccacgccttttgggataaggcacacggtttctacacgcccgaaaccgtgtcggcacaccgccgtctttcggacgacctcaacggcggagaggctttatccgcaacacaacgcctcgaatgttggcaaaccctgcaacaacatcaaaacggctggcggcaaggcgcggaggattggagccgttatcttttcgggcagccgtcagctcctgaaaaactcgctgcctttgtttcaaagcatcaaaaaatacgctagaatagcgcgttttacgacaaccgatttgattggaaaatcacaatgaaaacagcacaagaactgcgcgccggcaatgtatttatggtcggcaacgatcctatggtcgttcaaaaaaccgaatacatcaaaggcggccgctcttccgccaaagtcagcatgaaactgaaaaacctgctgaccggcgcggcttccgaaaccatttacaaagccgacgacaaattcgacgtggtcatcctgtcccgcaaaaactgtacgtacagctactttgccgacccgatgtacgtctttatggacgaagaattcaaccaatacgaaatcgaagctgacaacatcggcgacgcgttgaaattcatcgttgacggtatggaagaccaatgcgaagtaaccttctacgaaggcaaccctatctccgtagaactgcccaccatcatcgtgcgcgaagtcgagtacaccgagcctgccgtcaaaggcgatacttccggcaaagtgatgaaaaccgcccgcctggtcggtggcaccgaaatccaagtgatgtcttacatcgaaaacggcgataaagtcgaaatcgacacccgcaccggcgaattccgcaaacgcgcctgatttgccgcattgaaaaatgccgtctgaaaacgtttcagacggcattttttttatattcgccccgtgtttggattgaagtagatgtttttttcgtaaacgacaatacgcgtgattttgccattttcgtcaaaatggatgtctaaaaacggtttgtcgggattgcgttcacggttggacagccggaagagtgattggttttcaagcatttctccgtgtattttcagatagccgggcaattggctgatgtattggaaattgccgccaagtccgttgttgtgccggctcgaataggcaggggttgccgaaacttcaaaataacgcgtgcgtttcggctcctcgccttgtccgcgggtttcttgactgccctgtatcagcaacagcgtcgcttctcggaggcggcgttcctgttccatcaaggcattttgtgcctgccggctgatcgtgcgctttccgtaacgcaagtcttcaattgccagtatgattttctgatggtagtcgggatcttcagggcggatgtcgggaaacagcagccgctgtatgttgtcatagccaccgtcgggtaagccgaaacgggtttccagttcgtgatgggaaagggcaaacagacagtccgagtcaatgtgttcggcgatttgctgcatgagatcgtcaatgccggtggcggggtgcaggctggtgcaatttgacggcggcgcgctttctgcctgcttgacgttatcaggggcggatgcggtcggttgcaaatcggtttgggaaggagctgatgacgcggaggacgaagcagcggatgcaccgacttctttggttttatcgtctttgctcggagaacacgcggtcagcatgattgcggtaagccataagagaagtgatgaggttttgtttttcattctattgtttccagtattaaagaggccgtctgaaaacctaccgtttcatttttcagacggcctgttgttaatagaaccgaagaacctgttaatgccgacaaggttctcaacctgtcttacccgacgcggtaaaacgccaggctgcccaaaaggttggggaaatgtttgacctgtctgttgcccgtcatcacggcgcgctcgaggatgcggatgttgtttttggcgcacaataaatcaaagtctttgagcgtgcaccaatggatattgggcgtgtcgtaccaatggtagggcatacgttcggaaaccggcatatgtccgccgagtgcgatttggacgcggttgcgccagtagccgaaattcgggaagctgacaatcgcctgtttggcaacgcgcatcaggcagcgcaggattttttcggtattctgcatcgcttggatggtttggctcaacacaatcacatcaaaactttgatcgttgaatgcggttaaaccttcttccaaatcggcttggataacatttacgccgcgcgacatcgcggcgatgacgctatttgtgtcgatttcgatgccgtagccgctgcattttttgtgttcgaccaatgcggcaagcagttcgccgtcgccgcagcccaagtccaagacgcggctgccttcgggtatccggtcgtaaatcagttgcaaatcatcgcgcaggttcattgctgacattccttataaacgttgttcatataggcggcgaccgcacgcatataggcttcgtcttccattaaaaaggcatcgtgcccgtgtgcggatttgacttcgatatactgcacggatttttgggcggcaatcagtgccttgaccagttcgtgcgaacgttcgggtgcgaaacgccagtcggtgctgaagctggcgacaaagaatttcgctttcacattttgcagggcgcgggtcaggctgtcgccgaaatctgccgccggatcgaaatagtccaaagccttggtcatgagcaggtaagtgttggcgtcgaaccgtccgacgaatttgtcgccctgatagcgaagataggattccacttcaaattcaacaccaaagccgtattgataaccgttggaacgcaaatcgcgtccgaattttttgcctaaaccgtcttcggcaagataagtgatgtgtcccatcatgcgggcaatccgcaagccccgtgcaggaacggtattgtggctgcggtaatgtccttcattgaaatcagggtcggtcaaaattgcctgacgcgccacatcgttaaacgcgatattttgcgtggacagtttcggcgcagacgcaatcactaaagcatggcgcacgcgctcgggataggaaatcgtccactgcaaggcctgcataccgcccaagctgccaccgacaatcgccgcccattgttcgataccgagatagtcggcaagcgcggcttgggattttacccagtccttcaccgtaaccaccggaaaatccgcgccgtattccctgcccgtttcaggattaatcgacaaaggcccgctgctgccgtcgcagccgcccagattattcaaaccgaccacgaaaaaacgttccgtatcaatcggtttgccaggtccgaccatattgtcccaccagcccgtatatttatcttccgccgaatgcctgcccgcaacatgatggttgcccgacagcgcgtggcagattaaaaccgcattgtttttttcagcattcagctcgccgtaggtttcaatcatcagatcgaaacgcggcaaagttttaccgttttccaaaaccagcggcatctcaaacggaattttttggggcattacaatgcccaccgaggcattttgactcatatcctgttccaacaaatgcggcgaaaagcgttattatatcgcaaacggcatgactttttgacacggtcggacaagcagccggacgcgtttgaccctcatccgccgcacacgaatcatactttttcagacgacctccaccgcttcccgacatgataggcagacttttccgtatttttttctttttcgcacttgccgcgttgattatcaaccgccttttcagccgcaggcaaaaacgcgccctgcgcgaagtcgccgaaatcagcgcatgggtactgctcggtgcagccgccgcgatgctgttttggtatctgtttatgctgtatttcaaacacattccggattcgtattgacggaaaaaatgccgtctgaaacgcatttttctgtttcagacggcatatttgatgaaaagggcttgcggtaggaggtgctttatagtggattaactttaaaccagtacggcgttgcctcgccttgccgtactatttgtactgtctgcggcttcgtcgccttgtcctgatttttgttaatccactatacaaccgaagcaggaagggcagggggtcagcgttggcgcgctttaaaacgcggattgcttttgcagatgacgtaaactttgcccctgcgcctgacgatttggcagtcgcggtggcgttgtttggcggttttgagtgaagacagaacctgcattatttgtcctttctaaacgatgacattacggattggaaacgttggttgaatttgctggcacggccttcggtgttgacgttgcgctgtttgccagtatagacgggatgggatgcggaagaagtatccagcgaaaacagcggatattctttgccgtctgtccaaaccatcgtttttccgtgtgtttcggcacaggagcggattaaccagccttcattggcgctgctatcgaaaaaaaggacggttcggtaattgtcgggatgaatattcggtttcatatattgccttgctttcagtgttataacataacaaactctagcatagtttagaagggctgtacaaggaaatttaactatttttgtaatatattagaaattttcatgataaatctgaaaattttgaaattgactcatgtttggcgcaactttattatgttgcctgaaacatcatataaaagataataaaaggtacgcagccatgaattacgcaaaagaaatcaatgcgttaaataacagcctttccgatttgaaaggcgacatcaacgtttcattcgaatttttcccgccgaaaaacgaacaaatggaaaccatgctgtgggattccatccatcgcctgcaaaccttgcacccgaaatttgtttccgtaacttacggtgcaaactcaggcgagcgcgaccgcacacacggcatcgtcaaacgcatcaaacaggaaaccggcttggaagccgcgcctcacctgaccggtatcgacgcttctcccgacgaattgcgccaaattgccaaagattattgggacagcggcatccgccgcattgtcgccctgcgcggagacgagccggccggttatgagaaaaaaccgttttacgccgaagacttggttaagctattacgctccgtcgccgacttcgacatctctgtagcagcatatcccgaagtgcatcccgaagcgaaatccgcacaagccgacctgattaatttgaaacgcaaaatcgatgcgggcgcgaaccacgtcatcacccaattcttcttcgatgtggaacgctacctgcgcttccgcgaccgctgcgtgatgttgggtatcgatgtggaaatcgtccccggtattttgcctgttaccaacttcaagcagctcggtaaaatggctcaagtaaccaacgtcaaaatcccaagctggctgtcgcaaatgtatgaaggtttggacgacgaccaaggtacgcgcaatctggtggcggcaagtatcgccatcgatatggtcaaagtcctgtcccgcgaaggcgtgaaagatttccacttctatacgcttaaccgcagcgagctgacttacgccatttgccatattttaggcgtgcgcccttaaagccgtatcaaacagtttcagacggcatctaaggtgtctaaaaagcaaaacaccgccccatccgagccattctgatttacaataccggccgattcggattgaaccggtccttacaaaatccaactggagagttcaacatgacaacattacatttctcaggcttcccgcgtgtcggcgccttccgcgaattgaaattcgcacaagaaaaatactggcgcaaagaaatcagcgagcaagaattgctggctgttgctaaagacttgcgcgagaaaaactggaaacaccaggtcgctgccaacgccgatttcgttgccgtaggcgatttcactttctacgaccacatcctcgacctgcaagtcgccaccggcgcgattcccgcccgcttcggcttcgacagccaaaacctgtctttggaacaattcttccaactggcgcgcggtaacaaagaccaattcgctatcgaaatgaccaaatggttcgacaccaactaccactacttggtgcctgaattccacgccgataccgaattcaaagccaatgccaaacactatgttcaacaactgcaagaagcccaagccctcggtctgaaagccaaaccgaccgttgtaggtccgttgactttcctgtgggtgggtaaagaaaaaggcgccgtcgaattcgaccgtctgagcctgttgcctaaactgttgcctgtttacgttgaaatcctgactgctttggttgaagccggtgccgagtggattcaaatcgacgagcctgctttggctgtcgatttgcctaaagaatgggtggaagcctacaaagacgtttacgctactttgagcaaagtaagtgccaaaatcctgttgagcacttacttcggttctgttgccgaacacgccgcattgttgaaagccctgcctgttgacggtctgcacatcgacttggtacgcgcccccgagcaactggacgcgttcgccgactacgacaaagtcctgtctgccggcgtgattgacggccgcaacatttggcgcgccaacctgaacaaagttttggaaactgtcgagcctctgcaagccaaactgggtgaccgtttgtggatttccagctcttgctcgctgctgcacactccatttgacttgtcagttgaagaaaaactgaaagccaacaaacccgacctgtactcttggttggcattcaccctgcaaaaaacccaagaattgcgcgttctgaaagctgcattgaacgaaggccgtgattctgttgccgaagaactcgccgccagccaagctgctgccgactcccgtgccaacagcagcgaaatccatcgtgcagacgttgccaaacgcctggccgatttgcctgccaacgcagaccaacgcaaatctccatttgccgaccgtatcaaagcgcaacaagcatggttgaacctacctctgctaccgactaccaacatcggttctttcccgcaaaccaccgaaatccgccaggcacgctcagccttcaaaaaaggcgaactgtctgccgccgattacgaagccgcgatgaaaaaagaaatcgccttggtggttgaagagcaagaaaaactggacttggacgtactggtacacggcgaagccgagcgtaacgacatggttgaatacttcggcgaattgttgagcggttttgcattcactcaatacggctgggtacaaagctacggctcacgctgcgtgaaaccaccgattatctttggcgacgtaagccgtcctgaagccatgaccgtggcttggtctacttacgcacaaagcctgaccaaacgcccgatgaaaggtatgttgaccggccctgtaaccattctgcaatggtctttcgtccgcaacgacattcctcgctctaccgtgtgcaaacaaatcgcactggctctgaacgacgaagtattggatctggaaaaagccggcatcaaagtcatccaaattgacgaacctgccatccgcgaaggcttgccgctgaaacgcgccgattgggatgcctacctgaactgggcgggcgaatccttccgcctgtcctctgccggttgcgaagacagcacccaaatccacactcatatgtgttactccgagttcaacgatatcctgcctgcgattgctgcaatggatgcggacgtgatcaccatcgagacttcacgttccgacatggaactcttgaccgcgttcggcgaattccaatacccgaacgacatcggcccgggggtttacgacatccacagcccgcgcgtaccgacagaagccgaagtggagcacctgttgcgcaaagccatcgaggttgtaccggttgaacgtctgtgggttaacccggactgcggcctgaaaacacgcggctggaaagaaactctggaacaactccaagtaatgatgaacgtaacccgaaaactgcgtgccgaattggcgaaataagccgagaccgtatgaataaataccgtctgaaagcctttcagacggtattttgtcctgatttgcggcgcaagggcgcagttgccggaaaatcttttcattgcagcttgtttttttctaattcggctttatatgtgggaaacaggcaaatcggagttgtgtttgatagttttaaataatttatattatttgaactataaattatacaaatcattttgcatggggtagaatgcccagcgattcacaattatttctcaaaccaatctattaaggagcttaaaatggctttgcaagatcgtaccggtcaaaaagtaccttccgtagtattccgcacccgcgtcggcgacacttggaaagatgtgtctaccgatgatttgttcaaaggcaaaaaagtagtcgtattctccctgcccggtgcatttaccccgacttgttcttcttcacacctgccgcgttacaacgaattgttcggcgcgttcaaagaaaacggcgttgacgcaatctactgcgtatctgtaaacgatacgttcgtaatgaacgcttgggctgccgaagaagaatccgacaacatctacatgattcctgacggcaacggcgaatttaccgaaggtatgggtatgctggtcggtaaagaagacttgggcttcggtaaacgctcttggcgttactccatgctggttaacgacggcgtggttgaaaaaatgttcatcgaacctgaagaaccgggcgatccgttcaaagtatccgatgcagatactatgctgcaattcgttgctcccgattggaaggctcaagagtctgtggcaattttcactaaaccaggttgccaattctgcgctaaagccaaacaagctttgcaagacaaaggtttgtcttacgaagaaatcgtattgggcaaagatgcaaccgtcacttccgttcgcgccattaccggcaagatgactgcccctcaagtcttcatcggcggtaaatacatcggcggcagcgaagatttggaagcttacttggctaaaaactgatagctgtttgcttaaggcggtttaattaaactgtctgatataccggatagagttattcgggcggttctacactaccgctccgaataactctatatttataagagaatttggatattgttgcactcaatcgaaattttgtttttatttatctgaatgatgtttttgattgggaaaatatttaaatgccgtctgaaaccgatatgttctgtgtcggcaatgtttcagacgaaaacggaaggacaaagattatgaaaaaaattcaagcggatgtcgtcgtaatcggcggcggtactgccggtatgggtgcgtttcgcaatgcccgtttacattcggataatgtttacctgattgaaaacaatgtgttcggcacgacctgcgcgcgcgtgggctgtatgccttccaaactcttgattgccgccgcagaggcgcgtcatcacgcattgcataccgacccgttcggcgtgcatttggacaaagacagcatcgtcgtcaacggtgaagaggtcatgcagcgcgttaaatccgagcgtgaccgttttgtcggctttgtcgttgccgatgtggaagagtggcctgccgacaagcgcattatgggttcggctaaatttatcgacgagcataccgtccaaatcgacgagcatactcaaattacggcaaaaagtttcgtgattgctaccggttcgcgtcccgtcatcctgccgcaatggcagtctttgggcaatcgtttgattatcaacgatgacgttttctcatgggatacgctgcctaagcgcgttgccgtgttcgggccgggtgttatcggtttggaactgggtcaggcattgcaccgtttgggcgtgaaagttgaaattttcggtttgggcggaatcatcggcggcatttccgaccccgtcgtttcagacgaggcgaacgccgtgttcggcgaagaattgaaactgcatctggatgctaaaaccgaggtcaaactcgatgcagacggcaatgtagaagtccattgggagcaggatggcgaaaaaggcgtatttgttgccgaatatatgctggcagccgtgggccgccgtccgaacgttgacaatatcggtttggaaaatatcaatatcgaaaaagatgcgcgcggcgtacctgttgccgacccgctgaccatgcagaccagtattccgcatatcttcatcgcaggcgatgcgtccaaccaactgcctctgctgcatgaagctgccgaccaaggcaagattgccggcgataacgcgggccgctacccgaatatcggcggcggtttgcggcgcagcaccatcggcgtggtgtttaccagtccgcaaatcggctttgtcggtctgaaatacgcgcaggttgccgcgcaataccaagccgacgaatttgtcatcggcgaagtatcgttcaaaaaccaaggccgcagccgcgtgatgctggtgaacaaaggccatatgcgcctgtatgccgaaaaagccaccggccgctttatcggcgcggaaatcgtaggccctgccgccgaacatttggcgcacctgttggcttgggcacatcaaatgaagatgaccgttccgcaaatgctggatatgccgttctaccatcccgttatcgaggaaggtctgcgtaccgcgttgcgcgatgccgatgcgaaattgaaagcctgaccgatatggcaaaacaatgccgtctgaaattttttcagacggcattttgtttttggggatggggtcggatgctgataccgtgtcgggaagggggcggcaaaactaaaaatctttcttttaatctgctgtttccacgcgtgtttgtcaaaatctatcagtttgtttttaaaatacactgttcaaaatgggataaaacaggtaaattaacgtttatgtaacccagtgtagcaatgggtttacggtttttgagtcgatatataactacagaggaattgactatgtctgccaaaccgcgtcctgtttatctggatttgccgaacatccgtctgccgatacccgggatagtttccatccttcaccgcatcagcggggtcgggctgtttattatgctgcctttcctgctgtatttcctgtccggtaccctgagtcaagagtctgcatttgaaacttaccgtgccattgtttcccatcctttggtcaagctggttttaatcggtgtattgtgggcttatctgcaccattctctcgccggtatccgctttttatttttggatgcgcacaaaggccttgagctgaatactgcgcgcaataccgctaaagccgtatttgcttctgcattggttttgactgtcgttttgggagcgttgttatggtagaacgtaaattgaccggtgcccattacggtttgcgcgattgggtgatgcaacgtgcgactgcggttattatgttgatttataccgttgcacttttagtggttctattttccctgcctaaagaatattcggcatggcaggcattttttagtcaaacttgggtaaaagtatttacccaagtgagcttcatcgccgtattcttgcacgcttgggtgggtatccgcgatttgtggatggactatatcaaacccttcggcgtgcgtttgtttttgcaggttgccaccatcgtttggctggtcggctgtctcgtgtattcagttaaagtgatttgggggtaagtatgggttttcctgttcgcaagtttgatgccgtgattgtcggcggtggtggtgcaggtttacgcgcagccctccaattatccaaatccggtctgaattgtgccgttttgtctaaagtgttcccgacccgttcgcataccgtagcggcgcagggcggtatttccgcctctctgggtaatgtgcaggaagaccgttgggactggcacatgtacgataccgtgaaaggttccgactggttgggcgaccaagatgcgattgagtttatgtgccgcgccgcgcctgaagccgtaattgagttggaacacatgggtatgccttttgaccgtgtggaaagcggtaaaatttatcagcgtcctttcggcggccatactgccgaacacggtaaacgcgcggtagaacgcgcctgtgcggttgccgaccgtacaggtcatgcgatgctgcatactttgtaccaacaaaacgtccgtgccaatacgcaattctttgtggaatggacggcacaagatttgattcgtgatgaaaacggcgatgtcgtcggcgtaaccgccatggaaatggaaaccggcgaagtttatattttccacgctaaagctgtgatgtttgctaccggcggcggcggtcgtatttatgcgtcttctaccaatgcctatatgaataccggcgatggtttgggtatttgtgcgcgtgcaggtatcccgttggaagacatggaattctggcaattccacccgaccggcgtggcgggtgcgggcgtgttgattaccgaaggcgtacgcggcgagggcggtattctgttgaatgccgacggcgaacgctttatggaacgctatgcgccgaccgtaaaagacttggcttctcgcgacgttgtttcccgcgcgatggcgatggaaatctacgaaggtcgcggctgcggtaaaaacaaagaccatgtcttactgaaaatcgaccatatcggcgcagaaaaaattatggaaaaactgccgggcatccgcgagatttccattcagttcgccggtatcgatccgattaaagacccgattcccgttgtgccgactacccactatatgatgggcggcattccgaccaattaccacggcgaagttgtcgttccgcaaggtgaagattacgaagtgcctgtaaaaggtctgtatgcggcaggtgagtgcgcttgtgcttccgtacacggtgcgaaccgcttgggtaccaactccctgttggacttggtggtattcggtaaagctgccggcgacagcatgattaaattcatcaaagagcaaagcgactggaaacctttgcctgctaatgcaggtgagttgacccgccaacgtatcgagcgtttggacaaccaaaccgatggtgaaaacgttgatgcattgcgtcgcgaactgcaacgctctgtacaactgcacgccggcgtgttccgtactgatgagattctgagcaaaggcgttcgagaagtcatggcgattgccgagcgtgtgaaacgtaccgaaatcaaagacaagagcaaagtgtggaataccgcgcgtatcgaggctttggaattggataacctgattgaagtggcgaaagcgactttggtgtctgccgaagcacgtaaagaatcacgcggtgcgcacgcttcagacgaccatcctgagcgcgatgatgaaaactggatgaaacatacgctgtaccattcagatatcaataccttgtcctacaaaccggtgcacaccaagcctttgagcgtggaatacatcaaaccggccaagcgcgtttattgatgcgttttcagacagtcttcgcctcaaaggtcgtctgaaatctaaccatacccacattgaactgcttgaatttataatacaaaatcattgggcagttgatgagaaaaggaacacttctcatggaaaaaatgagttttgaaatttaccgttacaacccggatgttgatgccaagccttatatgcagcgttacgagttggaattggaaccgaccgacgtgaaacttttggatgctttggtacgcctgaaagcacaagacgataccttgtctttccgccgctcctgccgcgaaggcatttgcggatcggacggtatgaacatcaacggcaaaaacggcttggcgtgtttgaccgatctgcgtggcttgaaacagccagttaaaatccgtcctctgccaggtctgcctgttatccgcgacctgattgtggatatgacccagttcttcaaacaataccattccgtcaaaccttatgttgtcaacgataatccgattgatgcggacaaagagcgtctgcaaactcaggaagagcgtaaagagttggacggtttgtacgagtgtattttgtgcgcctgctgttcgactgcctgcccgtcattttggtggaaccctgataaattcgtcggtccgtccggtttgctgaatgcttaccgtttcattgcggacagccgtgataccatcactaatgagcgtttggataatctgaacgacccataccgtttgttccgttgccacaccattatgaactgcgtagacgtatgtcctaaacacttgaatccgacccgagccatcggtaagattaaagagattatgttgaaacgggccgtttaagaaatgatggtttttgacgatattgccaaacggaaaatccgttttcaaacccgccggggattgttggaattagatttaatcttcggcaggtttatggaaaaagaattcgagcatttgagcgataaagagctgtccgagttttccgaaatccttgaatttcaagatcaagaattgcttgccttgattaacgggcattcggaaacggacaaagggcaccttatcccgatgcttgaaaaaatcagacgggcatgaggcatctgaaatctgcctgcaggcagatttcaaaatgcaaaagccgtctgaaggcaaagaacgtgctgcggatgcagtaacgtgggttataacttgcaaaggagcaataatatgtccaaatcaatcaaactcaacgtaccgggtcaggcaggtttggagctgccggtattggaagccagcatcgggcacgatgtggttgacattcgggggctgacaaaaaatacaggtttgttttccttcgaccccggatttgtttcaaccgcaagctgtgagtctaaaattacttacatcgacggcgatcaaggcttgctttattatcgcggataccccatcgagcagctggccgaaaagtccgattatttggaagtctgctacctgttgatttacggcgaactgccgactcccgagcaaaaggcagaatttgacaataccgtccgccgccacacgatggtgcatgaacagctgacttggttcttccgggggttccgccgcgacgcgcatccgatggcgatgatggtcggcgtggtcggcgcactgtctgcgttctaccaagacagcttggacattagcaatcccgaacaccgcaaaatcgcgatttaccgcctgatttctaaaatcccgaccattgcggcaatgtgctaccgctattcaaacggtctgccgttcaattatccgaagaataatctttcttattccgaaaacttccttcatatgatgttcgccacgccgtgtgaagactacaaacccaatcccgttttggcacgcgcgctcgaccgcatctttattttgcatgccgaccacgagcaaaacgcctcaacttcaaccgtccgtctggcagggtcttcgggtgcgaacccgtttgcctgtattgctgccggtatcgcctgcctgtggggtgcttcgcacggcggtgcgaacgaagccgtgttgaaaatgttggacgaaatcggcgatgtgtctaatgttgccgcatacatggaaggtgtgaaacaacgcaaataccgtctgatgggcttcggtcaccgcgtgtaccgcaatatggatccgcgtgccagcattatgcgcgaaacctgctatgaagttttgaaggaattgggcttggaagacagtccgaaattcaaactggcgatggaattggaacagattgcgctgaaagacccgttctttatcgaacgcaaactgtatccaaacgtcgatttctattccggcatcgtcctgtccgcgctgggcatcccgaccgaaatgtttaccgtcatcttcgccctgtcgcgcagcgtgggctggatttcgcactggcacgagatgattagcgatccttcgctgaaaatcggccgcccgcgccagctttataccggttcggaacgccgcgattatgtgccgccaggcgagaggtaacatacattaatatattgtcaaacaggcaatatcagagaaccggattgtttcccgaatccgtctgattgtagtcggatgaaatcaagacaagcaatccggtttaaaatagggtagaataaaatgtcttttcaggcggcatcagtttagccgtcaggacgcggacttctaccctttgtttatattttaaagaaaagagcgcacgccatgatggacgaaaaactcaatttctcttacctgttcggttcaaacgcaccttacattgaggaattgtacgaggcttttttggaaaaccccgatgcggttgatgaaaaatggaagcagtatttcaccgatttgagcaaacagccggggacggttgctgtcgatgtcgcacacacaccgattcgcgaatcatttgttactttggcgaaaaagaaaattgcatctgccgttgcgggcggtgcggatgaggcaatgctgaaaaagcaagtcagcgttttacggctgatttccgcctatcgtatccaaggcgtgggtgcagcccaacttgatccgctcaaacgtatccccccgcgcgatattgaagccctcgatccgaaattccacggtctgtcagatgccgatatggcgcttcaattcaatatgggcgagggcgattttgccaatcgcggcaaactgcctttgtcccaaatcatcagcaacctcaaacaaacctactgcggccacatcgcattggaatatatctatattcccaataccgaagagcgccgctgggtacgcaattattttgaaagcgtattgtccacaccgcattacaatgccgatcaaaaacgccgtatcttgaaagagatgactgctgccgagactttggaacgttatctgcataccaaatatgtcggtcagaaacgtttcggtgtcgaaggcggcgaaagcgcgattgccggtttgaactacctgattcaaaacgccggtaaagacggtgtggaagaggtcatcatcggtatggcgcaccgtggccgtctgaatgttttggtgaacattttgggcaaaaaacccggcgatttgtttgccgaatttgaaggtcgtgccgaaatcaaactgcccagcggcgacgtgaaataccatatgggcttcagctccgatattgccacgccgcacggcccgatgcacgtttctttggcgttcaacccgtcacacttggaaatcgtcaacccggtggtggaaggttctgcgcgcgccaaacaaaaacgtttgggcgaaaacggccgcgacaaagtcttgccggtattgattcacggcgactccgcatttatcggtctgggagtcaaccaagcgacattcaacctgtctaaaacgcgcggttataccaccggcggtacggttcatatcgtcatcaacaaccaaatcggctttaccacttccgatatccgcgatacccgttcaaccgtacactgtaccgatatcgcaaaaatggtttccgccccggttatccatgtgaacggcgatgatcccgaacgcgtttgctttgctatccaagccgctttggattaccgcaaaaaattccataaagacatcgtgattgacgttgtctgctaccgtaaatggggtcacaacgagggcgatgatccgaccttgacccaaccgatgatgtacaaaaaagtatcgcaacaccccggtgcgcgtgctttgtacaccgagcaactgattgccgaaggcgtggtaacccaagccgaggctgacggttacatccaagcttaccgtgatgctttggacaaaggcgagcacgtcgagcaaacaacgttgagcaacttccaacgcacgcaaatcgactggagcaaataccaaggcaaagattggcgcgaacacatcgaaaccggtttgcctgccgcagatattgaacgtctcactgagaagtttaccgccgtaccggaaggctttgccctgcatccgactgcaaaacgtgtgattgaagcgcgtaaagccatggcatccggcaaacaggccatagattggggtatggccgaaaccttggcatacgccagcctcgtaaccaaaggtcacggcgtgcgtatttccggcgaggactcgggacgcggcacgttctcgcaccgccacgccgtattgcacgatcaaaaacgcgaaaaatgggacgacggtacttatgttcctctgcgccatatgggcgaaggcatgggcgagttcctggttatcgactccattttgaacgaagaagccgtgatggcgttcgagtacggctttgcctgctccgcacctgacaaactgaccatttgggaagctcaattcggtgacttcgccaacggcgcgcaagtgactattgaccaattcctgtcttcaggcgaaaccaagtggggtcgtttgtgcggtctgactaccatcctgccgcacggctacgacggtcaaggccccgagcactcttctgcacgcgtagaacgttggttgcaactgtgttctgagaacaatatgcaagtcattatgccgtctgaagcgtcgcaaatgttccacctcttgcaacgtcaagtcttgggttcataccgcaaaccgctggtgattttcatgtccaaacgcctgttgcgcttcaaaggtgcaatgagcccgctggaaaacttcaccgaaggttcgaccttccgtccggttatcggcgataccgcagaacgcgcaagcaacgacagcgtgaaacgcgtggtattgtgtgccggtcaggtttactatgacttggaagccggccgtgccgagcgtaaactggaagatgatgttgctattgtccgcgttgagcagctgtatccgttcccatatgacgaggttaaagctgaactggcgaaatatccgaacgcaaaatctgtggtttgggcacaagaagagccgaaaaaccaaggcgcgttctaccaaatccgccaccgcatcgaagatgttattagcgaagagcaaaaactgtcttatgccggtcgtccaagcagcgcatcgcctgcagtgggctactcaagcaaacacattgctcaattgaaacaattggttgaagacgctttggcattgtaaaccaagtagcattccgtctgagtctgctcagatggaatgcccatatgcagaattaaaaacacacaacaggccgtctgaaagggccattggagacacaaaatgattattgatgtaaaagtacctatgttgtctgaaagcgtatctgaaggcacgctcttggaatggaagaaaaaagttggcgaagccgttgcccgtgacgaaatcctgatcgatatcgaaacggacaaagtggttttggaagtaccttctccacaagccggcgtattggttgaaatcgtagctcaagacggtgaaaccgttgttgccgaccaagttttggcgcgcgtcgatacagctgctactgccgctgctgaagccccagccgccgctcctgcagaagctgccccagctgccgctcctgctgctacacaaaacaacgccgctatgcctgctgccgccaaactggctgccgagaccggtgttgacgtgaacgcattgcaaggttccggccgtgacggtcgcgtattgaaagaagacgtacaaaatgccgctgccaaacctgccggagccgctgctcctgctgttgcacttcctgccggcgcacgtcctgaagaacgcgtaccaatgagccgcctgcgtgcccgtgttgcagaacgcctcttggcttctcaacaagaaaacgccattctgactacattcaacgaagtcaacatgaaaccaatcatggacttgcgtgcgaagtacaaagaaaaattcgagaaagaacacggcgtgaaactgggctttatgtccttcttcgttaaagccgctgttgccgccctgaaaaaatacccggttgtgaatgcttctgttgacggcaaagacatcgtgtaccacggctacttcgacatcggtatcgcaattggcagcccacgcggtttggttgtgccaattctgcgtgatgccgaccaaatgagcattgccgacatcgaacaagcaattgttgattacgcgaaaaaagccaaagacggcaaaatcgctatcgaagatctgaccggcggtacattcagtattaccaacggcggtactttcggttctatgatgtctaccccgatcatcaacccacctcaatctgcgattttgggtatgcacgccactaaagagcgcgctgtggttgaaaacggccaagttgttgtccgtccgatgatgtatctggctctgtcttacgaccaccgtatcattgacggccgcgaagctgtattgaccttggtagccattaaagacgcgttggaagacccggcccgcctgttgttggatctgtaatcgtttcagacggccttttatttgttaatgaaaaggccgtctgaatttttatagtggattaaatttaaaccagtacggcgttgcctcgccttgccgtactatctgtactgtctgcggcttcgtcgccttgtcctgatttaaatttaatccactatatttagatgtagcgtaatgtagtatcgtgctacaataggctcaacgaacgattgaggccgtctgaaacatttgattcgaatgaatcggcagatatggactttcagacggccttttcttaaaaccatcaaaacgcagtcattcaaaataaaaaagaaacaaaaagtatcgtttttattttgagatactgttaaaagcaaaggatgacacgatgtctcaatatgatgtagtagtgattggtgcaggcccgggtggatacgttgccgccatccgtgccgcgcaactgggtttcaaaaccgcttgcgtcgatgcaggcgttaacaaagcaggcaatgcccctgcattgggcggtacttgcttgaacgtaggctgtatcccttctaaagccctgttgcaatccagcgaacatttccacgctgcgcaacacgagtttgccgaacacggtatcactgtcggcgacgtaaaattcgacgcggccaaaatgattgagcgcaaagatgccatcgtgaccaagctgaccggcggcgtcaaattcctgttccaaaaaaataaagtaaccagcctgttcggtacggcttcctttgccggtaaaaatggcgatgcttaccaaatcgaagtcgataacaaaggcgagaaaaccgttatcgaagccaaacacgtcatcgtagccaccggttccgtaccgcgtccgctgccacaagtcgctatcgacaatgtgaacgtattggacaacgaaggtgcattgaacctgaccgaagtacctgccaaactcggcgtgatcggttccggcgtgattggtttggaaatgggttccgtatggaaccgcgtgggtgcggaagttaccattcttgaagccgcgccgactttcctggctgccgccgaccaacaaatcgccaaagaagccttcaaatacttcaccaaagagcaaggtctgagcatcgaattgggcgtgaaaatcggcgacatcaagtctgaaggcaaaggtgtttccgttgcttacgaaactgctgctggcgaagccaaaaccgaagtattcgacaaactgatcgttgccatcggccgtattccaaacaccaaaggcctgaacgcggaagccgtaggcttggaaaaagacgagcgcggctttatcaaagtagatggcgaatgccgtaccaacctgcctaacgtatgggcaatcggcgacgtggttcgcggcccgatgttggcacacaaagccagcgacgaaggcgttgccgttgccgaacgcattgccggtcaaaaaccgcatatcgacttcaacaacgtaccgttcgtgatttacaccgatcctgaaatcgcttgggtgggtaaaaccgaagagcagctcaaagccgaaggcgtggagtacaaaaaaggtacttcaggttttggtgcgaatggtcgcgcattggcaatgggcaaagccaaaggtacggttaaagtgttggcagatgccaaaaccgaccgcatcttgggcgtacacatgattggtccggttgtcagcgaattggttaccgaaggcgtgactgcgctcgaattcttcgccagcagcgaagacatcgcccgcattatccatgcccacccaaccttgtccgaagtggttcacgaagctgcattggcggccgacaaacgcgctttgcacggttgatagacattaaggccgtctgaaatttttcagacggccttaaggccttcgacaaattgaatgttccgagagctccgttttctgatttataattccgtcagacaaacaaacagcatttacattcattatgaacaaagaaatagtcggtattttctttataccggcgggcatcatcagcatgtgtatggccgcattgtggcagatgtatgtgatgatgaccgaaacttatacgctcaaccgtttcaaagataaagaattggtttggcgcgtggcattgttgtttatcagtttcagccttgccgtttatctgctctgtccgaattcgcgtaaaaaaggcatcgtcttttttattctcgggggaggcggtgcagccatgtatctgctggcgcggatgtggttgcctttcagcaagtgaaacgacgattttccgaccgccgaaaggtagtctgaaacgcacgggcttgccatttggaggcagactcggggcattccactaatctaaaggagaaatccatgaatttacacgagtatcaggctaaagaactgctggctagctacggtttgcccgtacaaggcggtattttggcacacaacggcgaagaagccgctgcagcttacgacaaattgggcggcaaattcgctgttgtcaaagcacaagtacacgccggcggccgcggtaaagcgggcggcgtaaaagtcgttaaaagccgcgaagaagctaaagaagtggctgaaagcctgattggcaccaacttggtaacttaccaaaccgatgccaacggccaacctgtcaacagtgttttggtttgcgaagacatgtatccggttcaaaccgagctgtacttgggcgcagtggttgaccgttctacccgccgcattacattcatggcctctaccgaaggcggcgtggaaatcgaaaaagttgctgccgaaactcctgaaaaaatcttcaaagtaaccgttgatccgctggtcggcctgcaaccttgccaagctcgcgaagttgcgttccaactgggcttgaaagacaaacaaatcaacgagttcgtcaaactgatgaccggtgcgtacaaagcgtttgtcgaaaatgacttcgccctgtttgaagtcaacccgctggcagttcgcgaaaacggcgcgctcgcctgcgtggacggcaaaatcggcatcgacagcaacgcgctctaccgcctgccgaaaatcgccgaattgcgcgacaaatctcaagaaaacgaacgcgagttgaaagcttctgaatttgacctgaactatgttgccctggaaggcaacatcggctgtatggtgaacggtgccggtttggcgatggccactatggacatcatcaaactgaaaggcggccaacctgccaacttcttggacgttggcggcggcgcaaccaaagaccgcgtggttgaagcgttcaaactgattctggaagacaaatccgttcaaggcgtattgatcaacatcttcggcggtatcgtacgttgcgacatgattgcggaagccatcgtggcagccgttaaagaaatcaacgtcaacgttcctgtcgttgttcgtttggaaggcaacaacgccgaactcggcgcgaaaatcctgaacgaatcaggtctgaaactgacttctgcagacggcctgaatgacgcagccgaaaaaattgttgcagccgtaaacgcctaaggagaaaagaatgagcgtattgattaataaagacactaaagtattggttcaaggtttcaccggtaaaaacggtactttccactccgaacaagctctggcttacggcactaaagttgtcggcggcgttaccccgggcaaaggcggtcaaacccacctgaacctgcccgtgttcaacaccatgaaagaagccgttaaagaaaccggcgcggatgcatccgtgatttacgttcctgctccgtttgtgttggattctatcgttgaagcagttgattcaggcgtaggcttggtcgttgtgattaccgaaggcgtgccgactttggacatgctcaaagccaaacgctacttggaaaccaacggtaacggaacacgtttggtcggccctaactgcccgggcgtgattactccgggcgagtgcaaaatcggcattatgccgggccacatccatactcccggccgcatcggcatcatttcccgttccggtacattgacttacgaagccgtggcacaaaccaccaaactgggcttgggtcaatcaacctgtatcggtatcggcggcgacccgattccgggtatgaaccaaatcgacgcactgaaacttttccaagaagacccggataccgacgccatcatcatgatcggtgaaattggcggtactgcggaagaagaagcagccgaatacatccaatccaacgtaagcaaacctgttgtcggctatatcgccggtgttaccgcacctaaaggcaaacgcatgggtcacgccggtgcgattatctccggcggcaaaggtactgcggaagaaaaattcgccgctttcgaaaaagccggtatcgcttacacccgcagccctgccgagttgggcactaccatgctggaagtgttgaaagcaaaaggtttggcataatcaggtttgacaactgattgaacatcaaatgccgtctgaaaccggaaatcgggtttcagacggcattttgtttgtcatttcaaaaagaggcagcctcaacatacccacattatttttgcccttttggggcagtcagagacctttgcaaaattccccaaaatcccctaaattccctaaattcccaccaagacatttaggggattttggggaattttgcaaaggtctcgggctaagtgtgcctgtttgcgcctaaaaggcggcccggatgcctgattatcgggtatcctgggaggattaagggggtattggggtaaaattagtggatatttgaaacgaaaacagccgaaaacctgtgtttgggtttcggctgtcgggagggaaaggaattttgcaaagctctcgtattggctttgaagttccgtgtaattcacaggtagggcgtgtggcacagccacgcacgcggtcggttgggtatgcaggctacggctttctctgttgaaactgcaacacgtcagctaccaaccgtgtgcgtagcgcacacggttggttgggatacaagttactgtttgttcttaaatggagtaccaacatcaagggcttttgataatcctgaaaatattaaatattcagtttcagtttttattttaggagaaatatttgcataatttctatctttaaagcaccaatggatatatggtttcgtttcatcttctgggttatctaaataagcaataacattcaagtcaaataaaaattgcaaaaactcattagcagtactcataaatttaggtatttccactgatgttgtttgtaagtgctttttcaaacgttcaaatgcttttaaaaaatcactatatttaaatctatctttcccgtttaaaaattcaaaaaatttcaggaaattttgataatcactttgactataataaaacaaaagatgatctttgatttcaccaagtaaatatatcgagtattctctttgaaaagaagtattatcaaaatcttctgctacgacataatcttccttacttttcttatttttttgtagcaaagtaagcatctgaagaatatcgcgaggtcgataatacgattttcttaggaagctaataaatgaagttaaatttttatactcatcatgtaaattaggagcattccatggaaaataataatcccatgagttgcctttttctaaactatcttgtttttcttgctgggttctcaaaagatgatcaaaaacgccaaaaatctttgaacttctataagatttataatccgtcctccagtctaaaaatactgaattatcttgaagtttggtattttgattttgtaaacctaatgaatcaaagatatcaggtctaatcaataacacaactctcatccttcccttactatctttaatggaagggaagatatcattatttaacatccatatggcgttagcaagaccttttacacactcatgatattcatcaaatggaatctgtgatggtctaatatctatcccatcaataaacaaaatatgattatcttttagctttaactgagataaagcatctttaaattttctttcaataaaacctaaatttgcttggaatttactttctgtaaaagttatttgttgggattcctcttcacctagtttaacaaattttccaaaaatcatttccgcagcttcttttgaattttctattaaagttattgcttgtacaatttccggatcaaaagcgccataataatattcatttatagcctcatctaaggctttaaatttattaaatattgaagataatattccgttttctttacatttgatttgatttgatatcaacagatataaaatgactttccaaatacttgtaaaatctgaaacagttaagtgtcttgctttctttagctgaataaattttgaataatcggtttcacgaacaaacttagtagtggcatgtatgtttttatagaagttattagttaaataaacagcatatgctgtctttccagttcccttttctccgattaaaaacgaaatatttggttcacataattcatccaaatattctccttttacaaatattcggttaaataaatctttattttctcttcttctgtagtttgcagcatccacaaatccaaattctaatgtttttaacggtttcatcttaataatctcctatttaattttgaattaaacttacctcaaaaccaccttcaaatacttcccagtataactccccttaactttcgccacctgttcaggactacctttagcaataatcctccccccgccatctccgccttccggccccaagtccacaatccaatccgctgttttaatcacatccagattatgctcgataatcactatcgagttgcctttgcctttcagacggcctatgacttccagcagcagggcgatgtcggcgaagtgcaggccggtggtgggttcgtcgaggatgtagagcgttctgccggtgtcgcgtttggagagttccaaggcgagtttcacgcgttgggcttcgccgccggagagggtggtggcggactgtccgaggcggatatagcctaggcctacgtccatcagggtttgcagtttgcgcgatacggtggggacggcgtcgaaaaattcgcgggcttcttcgacggtcatgtcgaggacttggctgatgtttttgcctttgtattggatttcgagcgtttcgcggttgtagcgtttgccgtggcagacttcgcaggggacgtacacgtcgggcaggaagtgcatttcgactttaatcacgccgtcgccttggcaggcttcgcagcggccgcctttgacattgaaggagaatctgccgacgttgtagccgcgttcgcgagagagggggacgccggcgaagagttcgcggataggggtgaacaggccggtgtaggtggcggggttggagcgaggagtacggccgatgggggactgatcgacgttgatgactttgtcgaggtgttcgaggccgtggatgtcgtcgaatggggcgggttcttcttgggcgcggttgagttcgcgggcggtaattttggcgagggtgtcgttaatcagggtggatttgccgctgccggacacgccggtgatgcaggtaatcaaaccgagcggcagctcaagggtaacgtttttgagattgttgccgcgtgcgcctttgaggacgagcatccggtcgggattgacgggcgtgcgttcagacggcacggcaatggattttttgccgctgaggtattgtccggtaacggagttttcgcattgggcgacgttttcgggcgtgtcggcaatcagtacgttgcctccgtgttcgcctgcgccggggcccatatcgaccacgaaatcggcttcgcggatggcgtcttcgtcgtgttcgaccacaatcacgctgttgcccaaatcgcgcaggcgtttgagggtggccagcaggcggtcattgtcacgctggtgcaggccgatggagggttcgtccagtacatacatcacgccggtcaggccgctgccgatttggctggcgaggcggatgcgctgggcttcgccgccggagagggtttcggcggagcggcttaaattcaggtaatccagcccgacgttaatcaggaagccgaggcgttcggtgatttctttgaggattttttcggcgatttgttttttgttgccgtctaaatccagtgtttcaaagaattggtgggttttggtgagcggccaggcggaaacttcgtgcaacggctcaccgctgacgtaaacgtagcgggcttctttgcgcaaacgtgcgccgccgcagcttgggcaggcgcggtggttttggtattcgcgcagtttttcgcgcacggtttcgctgtcggtttcgcggtagcggcgttcgagattggggatgatgccttcaaaggcgtggctgcggttgaaggtggtgccgcgttcggacaggtaagtgaaatcaatgacttctttgcctgagccgtgcagcacaacttttttcactttttcaggtagtgtttcccaagcagcctgcacatcgaaaccgtaatgccgcgccaatgattgaatcatttggaaatagaattggttgcgcttgtcccaaccgtcaatcgcacctgttgccagcgacaattcgggatgggcgaccactttttcggggtcgaagaaattggtgttgcccaagccgtcgcaagtcgggcaggaacccatcgggttgttgaacgaaaaaaggcgaggctctaattcgggcaggctgtacgaacacacggggcaggcgaaacgtgcggaaaaccaatgttcttcgccgctgtccatctccatcgccagcgcacgctcgttgccgtggcgcagcgcggtttcaaaactttccgccagccgctgcttgatgtccgccttcactttcacgcggtcgatgaccacgtcgatattgtgcttgatgtttttttccagcttcggcacttcgtccaactgatagacctcgccgtccacgcgcacccgcgcaaaaccctgcgcctgcaagtcggcaaagaaatcgacaaactcgcccttacgctcgcgcacggtgggggcaagaatcatcacacgcgtgtcttccggcagtttcaatacggcatcgaccatctgcgatacggtttggctcgacagcggcagcttgtgttcgggacaatacggggtaccgacacgggcgtataaaagacgcagatagtcgtggatttcagttaccgtaccgacggtggagcgtgggttgtggctggtggatttttgctcgatggaaattgcaggcgacagaccttcaattaaatcgacatcgggtttgtccatcatctgcaaaaactgccgcgcataggcggaaaggctctcgacataacgccgttgcccttcggcatacagcgtgtcaaacgccagcgacgacttgccgctgcccgacaatcctgttaccaccacgagtttgtggcgcggaatgtctaaatcgatgtttttcaaattatgcgtgcgcgcgccgcggatgcggatggtgtcgttgtcgtgcgaatgttggggatgatggttgcacataatggatgccgcctgaaaaataaaggaaaaccggtattgtagcactttctcggatgccgtctgaagccgcgttcagacggcatttgccagcggagtacggcagattccgctataatgtcggcaattttaacccgcttgaacaaaaggatgacaaatgaaccgtctttacccccacccgattatcgcccgtgagggctggccgattattggcggcggtttggctttgagcctgctggtgtcgatatgttgcggctggtggtctttgccgttttgggtgtttaccgtatttgcattgcagtttttccgcgaccctgcgcgtgagattccgctaaatcctgaagcggtgttgagcccggttgacggccgtatcgtggtggtcgaacgcgcacgcgatccgtatcgtgatgtcgatgctttgaaaatcagtatttttatgaacgtgttcaacgtgcattcgcaaaaatcgcctgccgattgtacggtaacgaaagtggtctataacaaaggcaaattcgtgaatgcggatttggacaaagccagcacggaaaacgaacgtaatgcggtgttggcgactacggcttcaggtcgtgaaattacttttgttcaagtggccggtttggtggcgcgccgtattttgtgctacacccaagcaggtgcgaaactgtcccgcggcgaacgttatggctttatccgcttcggttcgcgcgtggatatgtatctgcctgtcgatgcgcaggcgcaagtggcgattggcgataaagtaaccggcgtcagcactgtattggcgcgtttgccgctgactgcgccgcaaactgaatctgagcctgaatctgagcctgctttacaaactgctccggttgaaacagcggcaaacccatctgccgaacaacggcaaatcgaggcagcggcggctaagattcaggcggctgtgcaagatgtgttgaaagattaattttgcggactgaaatagaaaatatcagtaccatcattcacacgaatgaggaagtttggttttttgaatttttgctaatgttcacaccgtcattcccacgaaagtgggaatctagaaacttaacgttacgacgatttatcggaaacgactgaaaccggacggactggattcccgcctgcgcgggaatgacgacttattagttacctaacacttaaaaaacagaaacctttccgcgtcattcccacgaaagtgggaatccgggaacttaacgttacagcgatttatcggaaacggctgaaaccgaacgaattggattcccgcctgcgcgggaatgacaactcattagttacctaaaacttaaaaaacggaaacctttacgccgtcattcccacgaaagtgggaatccgggaacttaacgttacagtgatttatcggaaacggctgaaaccgaacgaattggattcccgcctgcgcgggaatgacaactcattagttacctaaaacttaaaaaacagaaacctttacgccgtcattcccacgaaagtgggaatctagaacccaaatgctaaggcgatttatcggaaacggctgaaaccgaatgaattggattcccgcctgcgcaggaatgacaactcattagttacctaaaacttaaaaaacagaaacctttacaccgtcattcccacgaaagtgggaatctagaacccaaatgctaaggcgatttatcggaaacggctgaaaccgaatgaattggattctcgcctgcgcgggaatgacgacccattagttacctaaaatttaaaaaacagaaacctttccgcgtcattcccatgaaagtgggaatctagaacccaaatgctaaggcgatttatcggaaacggctgaaaccgaacgaattggattcccgcctgcgcgggaatgacgggatcttgggtttctgcttttgatttttctgcttttgcgagaatgacggcgtgaaagtaagaatgatgaaacaaaaaaaatgggaatgatggcatagtggtttgttctttgtctttgccatatttcctaacaaattgattaaaaagaaaaaaggttttcagaatgccgtctgaaaaccttttttgtttgcctgtccgattttaaaacttcacgttcacgccgccggtaaagctgcggcccatttgcggcgtatcagagagaaagctgctgtgggcgtaaacggattggttgagcaggttgtcggctttgacgtaccaattccactcgccatagcgcgtattgcggcggtagtttgcgccgaggttgagcatatggtgtccgggcgtgcgcgtttcgtagcgggcgagtttgttttgggcgaacacgcggtagtagtccaaattggcatcgatacggtcggtcagcgaggctttcaggtggaagccgaggcgcgcagccggaacacggggggcattttggtcgtcctgtgcgatgaaaggacggttgccgtaggcatcttctctgccgggtagggaaggcaggtttttcagacggcctcgtacatagtcgccggaaacgccgatgcggtagcgsggtgtcggtttgaagtagatttcgccttccgcgccgtagaagtcggcgccggattggttgtagcgcacgagcttcatttcgctgtcgtcttcgatggatttggggccgcgtccgtcgtttaaggtttgggcgtaaatgtagttaccgaagcggttgcggtagagtgccagattgtattgccagcggtcgccttcgtagcccagcgcgagttcgatattgttggaacgctctttgttgaggtgtttgttgccgacttcaaaggtgttggtggcgacgtgtttgccgtgtgcgtacagctcttgcgttgacggcaggcgttcctgatgggaggcggtcaggctgagtttgtgttgtggcgtgaaataccagttgcccgaaagtgcgaatgagcgggcggtttggcggtgcgcgccgaggtcgggcagggggtggttgtagtagttttcccgatcaatcaatgctttgtcgtactgaatggaggctttttgtttttccacgcgtacgcctccttcaagcgtgaagttgtcccagtttgcctgttctacaccgaaaaagctgtaatgttgcactttgttgtcaagcagcatcggttgtttaaccgcttcggatatggcagataaagcactggatttttgttgtaaatattgcacgccccagctgcctttcagacgacctatgggttggtggcgcaactcgatgcgggcgttttgcgtttggttgttaaaaaagttttcgactgcatcgcctgctttttcgtcgtggcggtagtcgttgcggttcaggtgtacgcgcagggcttcaaaaccggggaacggttgcttccattcggcacggagttcgtagcgtttgttgcgcaggtctatccacggtctgccgctgtgggtgtgtgcgtgtgcattatcgtcgtcgtggaagccgcagctcaagcccggattgtcgtaatcgatgtcttcttcggtcaacaggtgcggataaagctgtaaatagcgtttgttaatcaagctcttttgccagatgatgtcggcgtggcaatcatcgtattcgtggctgtgggcaggcagaccatattggtcgcgacggtcgctgtacgctacgccgataaaacctttttcgccaacccaagacagcccgatgctgcccgtttgcgaatcggcgtggctgtcgggcaggcgtttcagattgcggtaacgcggtacggcgtaatcccccgatttgcggtacagcccttccgtgtgcaatacaaagtttttgcccaaaccgatattgatgccgccggacgtgagtttttccagattgccgctgctcaaacgcaatccgagttcgcccgatacgccgttttcaggcattttttcggggattttgccatcggcaacatcgaccagccccgccacattgcccgagctgtacaagagcgtaaccggcccgcgcaggatttcgacctgttgcgacaaggcggtatctaccataatggcgtgatcgggcgaaaaatccgccatatcgcctgtttcgccgtgatggttcaacactttaayccgcctgcctgtttgaccgcgaatgacgggagcagacgcgccgccgccgtattgcgaagcgtggatgcccggtacgccgtctaaagcgtcgcccaagttgacggctttttggcgcaaggtatcgccggagatgattttgtcggaggcggtcgaagtgtgcaacagccccgacgtggcgcgcggacggcttttgccgacgacgctgaccgtttccaaatccaccgattgctcagtttcatgcgcttgggcgaggaggggtgtgttgattaaaagaattgataaaacaatgggtttgagtgtagtttgtgccattttggcttctcgtcgcatttcaaaagtttgttattatataacattacattttttatatcataagattttgagaacactcagagggcataggcaaaagtttttcaaatgaaacggttgcggcatcgggcggtgtccatttgtatccgccgtccttcgggggcgcggttgatgttgacgcagattccgctgtgtttgcccattatgttcggctgcgggataaccaaaatttatgagtgcataaaaacggcacgttcccgaacggtcgaaaaggtggcaaaatggcgtacttgtcagaacgcgaggctctgcgccaggttcacgagggcgcatcgggcacgctaagatataagagggtatggatgggggtatcggaaatgcagttaataacaaacaaattataaatcaataggttaatcacaaaatgcttttgtttatcgacaattacgacagttttacttacaacatcgtccagtatttcactgaattggggcaggaagttgccgtgcgccgcaacgatgatattacgttggaggaaatcgaggcattgaatccgcaatatctcgttatcggccccggcccgtgttcgcccaaagaagcggggatttccgtggcggcgatgcgccatttcgccggccggctgccgattatgggcgtgtgcctcgggcatcagacgataggcgaggcgttcggcggcaggatagtccgcgccaaaacgctgatgcacggtaaggtgtcgcccgtgtcccattcgggcaagggtatgtttaagggtttgcccaatccggttacctgtacgcgttatcacagcctcgttatcgatcggaatacgatgcccgaatgtttggaagtaacggcttggactgaggacggcgagattatgggtgtgcgccataaggaatatgccgtcgagggcgtgcagttccaccccgaagccctcttgaccgagcacggacatgatatgttaaacaattttttaatcgaatttcaaaacttcaaaccgcaaaaaatctgacgtgatgccgtctgaagcccttcagacggcattttcgtccgaatattgaacggaggacaaaaaatgattacaccgcaacaggccatcgaacgattaatcagcaataacgagttgttttacgatgaaatgaccgacttgatgcgtcagattatgagaggacaggttctgccggagcagatagcggccattttgacaggattgcgtatcaaggttgaaaccgtttccgaaattaccgcagctgcagccgtcatgcgcgagtttgcgacaaaagtgccgctggagaatgcagaggggctggtcgatatcgtcggtacgggcggggatggcgcgaaaaccttcaatatttcgacgacttcgatgtttgttgccgcagcggcaggcgcgaaggttgccaaacacggaggccggtcggtctcttcctccagcggtgcggctgacgtggtggagcagatgggcgcaaacctcaacctgactcccgaacaggttgcccaaagtatcaggcagaccggcatcgggtttatgttcgcgcccaatcaccacagtgccatgcgccatgtcgcccctgtacgccgttcgctcggtttccgaagtattttcaacatattgggtccgttaacgaatcctgcgggcgcgccgaaccagcttttgggcgtgttccacaccgatttgtgcggcattttgtcgcgggtcttgcaacaacttggttcaaaacacgttttggttgtttgcggggagggcggtttggatgaaattacactgacgggcaaaacacgcgttgccgagctcaaagacggaaaaatcagcgaatacgacatccgcccagaagatttcggtatcgaaacccgccgcaatttggatgaaatcaaagttgccaatactcaggaatctttgttgaaaatgaatgaggtgctggaaggaagagaaggggctgcgcgcgatatcgtattgctcaacaccgccgccgccctgtatgccggaaatgtcgctgcttcgctttcagacggcatatctgccgcacgggaagccatcgattcaggcagggccaaatcgaaaaaagaggagtttgtcggttttcaaccacaacaaagatgccattttcttggaaagatggagcttgggtgatgccgccatgattatggaacttttgtggcaaaacataagcacttcacgaagagaacttaccaaactgtttttatataaaaacttggggctgtactagataaccagaccaaattcccattaactaattgtcttaaaatctgaatttgagattctatttaaaatgccattggcatttctttaaatgcagccccaaatgctctttgggaatgccgttaaacttacgtaaatggctaaattcactaatatcaagcacatcataactacgaaaggtatccgtgtatacaatgccatcaggcttaactttctttcggataattggcaacaatgtcgctgattgcgcattaggaacaacgacggtataaaccttatatattgcgtccctaagaagggacgattaacaaaaattaacgtcctttactttctacaagtaacagggcttttttttgcccgtttttgaggattcgcaccatggaagataagcaagggatgacaaaggcggttgccggcgtgatgacggacgcgctagcggacggcaggaagccgacaaccgcttcaaatcttccccccttatctaacagggggggacagaaaccgaaacggcaggcagggttcaggaagtcttcgaatgttacgaaacgtacataacggacggtaaaggaaacctgttaggcgttcctcttcggcgcggtgtatcagattcggctttcattgatcaaattagcttttcatttcatgaaaaaacctttttcgataaatacggcgttcgtgtaagtcttttggaagacgaagattttattcgcgccgcgtccatgctcgccgaagaagttttcggtttcggtatctacaaagaatccaaaggttcgggcggtcgtttctatgagcgctgttggttgatgggttcggaagacgccctatacggtcgcgtccattttggcggccaacaaaataccattcttttcgaactgaccggcaccggttgcggcgtcgcaaaagaaggctgggaatcacgacttttcgcattcctgactaatgcaatccgcccaaaaatcacacgcgttgacatcgcaaaagactttttcaacggcgaatacagcccgaaccaagcccgtgaagaccgaaataaaggtatgtttacctgtcatcacgtcaaaccaaaaggcgaatgtttggggtcagattgggaagaagacgatgaagccaaaatgaccaaaggcaagacctatggtatcggctcccgtgaatcgtccaaatatgtccgcgtctatgaaaaaggcaagcagttgggcgataaaacaagcacatggacgcgatttgaaattgaattcaaagcaaaagacatcgttatccctttcgaagttttgcagaatccgggcgaatatttcggcggcgcatatccgatttgcgaacgattcgcccaaaaggcaacgcgcatacacgcggttaaggaagataaggtcatttcagccgaccgctaccttgaatgggtaaaaaaacagttcggacgtgcggcaaacggtctgaaattcatttttcccgaattggacaaagccaaactgtttgaactgattgagccgagtcatcacaagctgcccaagtctttggctcccgaagcctacgactgcgcctttttgaaagctcaagccattcatgaacagcccgcattcaaaccgtacaaagacccttactatatgtacgaatattacgagaatcttgaaaaacagcttgaacagcaaaaacacgtcaacaatgaagaaagctataacaacttcatttacgacaaattcgcaagactaccgatttcatgggcttaaagtgtctgcccgaaagacgtttaatcacacaaggaaaccaaaaaatgaacatccaacttcaaggccacatcgtcggcgttaaaaaaatcaacggacaaatcgaaggcaagagcttcgactattgctgcctgattgtcgccacacccttagacagctcccaaggcaacgcattgggcagctctactactgaatacgatttcggcggctctgccaatttcgagcagttccgaaacgcccaatttccgatcgaagcaaacctgaacgtagaaatcgtcactacgggcaaaacccaaaaactgaaagtcatcggttttcaactcgtgaagaaaggctgattgaatgcagaaagtctatgttgtccagtccgtatcaacaggggactttctgtatctctctcctgaaacgggcgacatcggacataccaaattaatcaccaatgccgattatttctacgacttcgaagaagcgattaacgcaggtttggaagaaatcggcaaccaatacgaatttgtcgtattcggatttttgaaagactgattttcggatgttcggcggtcgtctgaaaaacgctccatccattaccgccaaacactttttgaaggaaaatatcatgaaatttattaacacctgccgtaaatacggcgcaaaactggctgttgtaacagctgctcccctggctttggccgcacatgcaaatgcaacgttgcccgatacggcaaaaaacgctttggaagccgcaaaagcggacggtatggaagccggttggattgtagtgggcattttcgccgcgctttttgtattttccatcgttaagagagtgatgaagtaagacggcatgtactaccaagtcggaaataaatgtcttgagaagcaccaggctgaaaacctttatttcagcttggtagtaccaagaatcaaagaaaacggacagattgtcaggccggaatataacggcagcctgtggaagatgtcggacggtcagccgctaaggcttttattggcggaatgcagtccgaaagacaacctgcaaagcggtcttgaaacaggctggatagtattcggcatcctcgcgtccgtttactttgtttccctgctgaaaaaggttttgaaatgatggatttttatttttatctcggcgtttccgtacccgtattaatcggggcggttctgtttaagaattgagcgcatgaagttatggtgtcaaaatcaggctttcaaaacaatcattgaaaggcagaaccatgaacaagccgtttatcactcaggcgcagttggcactttataaatatcagccgtccagcaagtattttgggcaatcgatggcggttatagcgcaatctgaatttgttgaatttgcgaagattaataagtctgaaaatgttattgattgtttctcttttttctggaatagaagaattaaacatgatatttggctaatctcattttctgataattcagaaatggtaattaaagaatccctgaaagatggtcataaaatatacaaatttgaattttgcgaaattgtcgataattgcaattttgatgatgtattcgtttgaagcgaatgcaaatgcagtaaaaatatctgaaactgtttcagttgataccggacaaggtgcgaaaattcataagtttgtacctaaaaatagtaaaacttattcatctgatttaataaaaacggtagatttaacacacatccctacgggcgcaaaagcccgaatcaacgccaaaataaccgccagcgtatcccgcgccggcgtattggcgggggtcggcaaacttgcccgcttaggcgcgaaattcagcacaagggcggttccctatgtcggaacagcccttttagcccacgacgtatacgaaactttcaaagaagacatacaggcacgaggctaccaatacgaccccgaaaccgacaaatttgcaaaggtctcaggctaagtgcgcctgttgccgcctaaaaggtaccccggatgcctgattatcgggtatccggggaggattaagggggtatttgggtaaaattaggaggtatttggggtgaaaacagccgaaaacctgtgttggggtttcggctgtcgggagggaaaggaattttgcaaaggtctcttttcgtcattcccgccacttttcgtcattcccgcgaaagcgggaatctagaatctcggactttcagataatctttgaatattgctgttgttctaaggtctagattcccgcctgcgcgggaatgacgatgcaggtatttctgacgattcccggctatgatgttgaggcagaaatcgaaaaattcgtttggatggatgctgtgatttggcagatgccgggctggtggatgcacgagccttggacagtgaaaaaatacatagacggagtattaaccgctggacacggcaaactctaccaaagcgacggcagacacagcgtcaatccgactgagggctacggcacaggcggcttgttgcaaggcaaaaaacatatgctttcactgacttggaatgcgccgattgaggcgtttacccgcgaaggcgatttctttgaaggcaaaggcgttgatgttttgtatatgcacttccacaaagccaacgagtttttgggtatgacccgcctgccgacattcttatgtaacgatgtggttaaaaatccgcaagtggaaaaatacttggcagattatcaggcacacttggaaaaagtgttcggctaattaaaaatccatcttcaacacggagatggattttgtttgtttcgttgattttgtgtcagtttcagatgtaggtgcttattcggacgggccgtctgaaaatgtttgccccaatgcaaaaaaatcactgcaaaccttcataaacggggtttgcagtgattttttcaaatcaaacagattgaaaacctgcgccgaattgttcagacggcattattttttcagttcggacagaatgtcatctacggttttcttcgcatctccgaaacacatcacgctgttttcgttgaagaacagtgggttttgtacacctgcgtagccggtattcatcgagcgtttgaagacgacgacttcttttgccttccacacttccaacacgggcatacccgcaatcgggctgttcgggtcggtttgggcggcggggttgacggtgtcgttcgcaccgatgaccaagaccacatcggtttcggggaagtcgtcgttgatttcgtccatttccaaaacgatgtcgtaggggactttggcttcggcgagcagtacgttcatatgaccgggcaggcggccggcgacggggtggatgccgaagcgtacttcggtgccgtttttacgtaaaagctcggtgatttcggcaacggggtattgcgcttgtgcgactgccataccgtagcccggggtaatgatgacattgtttgcgcctttcagcatttcggcaatatcggcagctttgacttctcggtattcccctatctcttggctgccggaagataatgtgccgctgtcgctgccgaaaccaccggcaattaccgagacaaacgagcggttcatggctttgcacataatgtaggacagaatcgcgccgcttgagccgaccagcgcgccggtaacgatgagcaggtcgttggagagcatgaagcctgccgctgcggccgcccagccggagtaggagttgagcatggacacgaccacgggcatatctgcgccgccgatggaggcaaccaagtgccagccgaatgcgagggcaatcagggtcataatcagcaggatgaagccgctgccgtcaatgccgacaaatacgagcagcaacacaaacgatacggcaagtgccagtgcgttgagcttgtgtttggcgggcagttgcagcgggctgctgctgattttgccgttgagtttgccgaatgcgaccagcgagccggtaaaggttaccgcgccgatgaagatgcctaaatacacttcgaccagatggatggtgtgcatatcgtgcgaaacgttgcccggcgcgatatagctgttgaagccgaccaaaaccgccgctaggccgacgaagctgtgcagcagggcaatcagttcgggcatttcggtcatttccacctttttggctttgtagatgccgattgccgcgccgatgagcatggcgatgatgatccagcccagtccgtgggtattgtcggaaaaaacagttacaaaaagggcgaccgccataccggcgataccggaatagcagccctgtttggcggtttcctgtttggacagccccgccagtgagaagatgaataaaattgcggcaacgatatacgccgctgttacgagtcctgaagacatagaaattctccgattttcgatgatttgttttcaatgccgtctgaaaaattgacgttcgtgttttcagacggcatctgtttcaagcagccgcgacaaacagcccgacggtgcaggcaaatccgcctgcccacatcagtgagcgcatagcggctttgtcggcgatatagcaccagataaaggcgaggcggaacaggatgaacaggcaggcaagcgtgttgatggtcgattgcgccgcattgccggttgcgtgtgccgtcaaaacggcggcggcaaacggtgcaaaggcttcaaaaccgttttgctgtgcggcgtgggcacgggcggctgcgccttgcgtgtgcgctagaaaaccgcgcggattgtggttgtctttaaaccggaatccgcccgcttttttggcatacgccgcacaaaaaagcggcaataggcaggcaatcagaatacaccaataggcgaaagtcatggcttaccctttcttaaacatattcagcatacgccgtgttaccgcaaagccgccgaagatgttgatgccggcaatcaggatggcaacaaacgacagcagcgaaacgaagccgttgccctgaccgatttgcagcagcgcgccgacgacgatgatgccggagatggcgttggttaccgacatcagcggtgtgtgcagcgagtggctgacgttccagacgacgtagtagccgatgacgcaggcgagaacgaacacgataaagtggttcaggaatgctgcgggtgcgaccgcgccgacccacagtaccaagacggcggcgatgacggcgggcgcgagttttttccacaggggaacgggttttggctcgggcttggcggcaggcacggctttttcagacggcgtttgctgcggctgggcggaaacttgaatcggcggaggcgggaaggtgatttcgccgtcgtgggtaacggtcatgttgcggataatcacgtcttcgaagtccaacgtgatttcgccgtctttgttcgggcttaacagcttggtcaggttgaccaagttggtggcgtaaagctgggaagactgtccggcaaggcggtttgccatgtcggtgtagccgatgattttcacgccgttgccggttacggacaattcgcccgggcgggtgagttcgcagttgccgcccgtcgccgccgccaaatcgacgatgacggagccggatttcatgctttccaccatttctttggtaatcagcttgggcgcgggtttgcccggaatggcggcggtggtgatgatgatgtccacttctttcgcctgctcggcaaagagcttcatctcggctgcgataaattcgtcgctcatcactttggcgtagccgtctccgctgccgcccgattcttgtgggaagtcgagtttcaggaacttgccgcccatcgattcgatttgttccgccacttccaagcgggtatcgaacgcgcgtaccactgcgccgagcgagtttgccgtaccgatcgccgccaaacctgccacacctgcaccaatcaccaaaacctgcgcgggcggcactttgccggcggcggtaatttgaccggtgaagaaacggccgaaggcgttggcggcttcaattacggcgcggtagccgctgatgtttgccatcgaagacaaagcgtccaaagcctgcgcgcgcgaaatgcggggcaccatatccatcgccagcgcgttcactttcttggcgcgcaaggcttcgaccaaagcctcgttttggcgcggccacaggaagctgacgatggtttgaccttcgttcaaaagcggcagttcctgttcggacggcgcgttgaccttataaatcaaagggcagacccaaaccgccgctttgtcggcaacggttgcgcctgctgtttggtaagcggcatcgtccaaacttgccgccaaacctgcaccgctttcgacaacggtttcaaagcccagtttgcccagcagggcgacggtggcgggcgtacaggcgacgcgggtttcgccggataatgactcgcgtgggataccgattttcatctctgaatcctttttcgggttgtttatatgtatcgtgggttaaatttaaatcggggcggggcggagcaacgccgtaccggtttaaagccgactcacttcaaatgttaatatattttagataatccccttataacgaattttcatcaggctggcaatagttgcggcattttcccgtgttgtccgacacatactgccgtttgtgtttgaaatcgttttccgattgcagtcccgcccgccgtaacattctttgccgtttcactatataatccgcattttttgagccgccgttatgccgcacgccctcgtcctccaatttccctccgccgcagccctgccttccgacttccccttacgcctgcccgaacctgattgcgccgatgaaaagcgtatgcgttttatcgttgaagaagggttttctttaagcgaaaaagacgcggcgttgcttggcagccgtcaaatcgaccacgccgtgttgccggatatggatttcgacgaactcggtttgattgtcagcgatatggattcgacgctgattaccatcgaatgcgtcgatgaaattgcggcaggcgtgggtttaaaaaacaaagtagcggaaattaccgagcgttcgatgcgcggcgaactcgatttcgaacagtctttacgcagccgcgtcgcgctgttggcgggattggacgaacgggttttggcggacgtttatgaaaacgttttgaagctctcgcccggtgcggaatttttgttggacgaatgcaaaaggcacgatgtgaaattcctgctggtgtcgggcggcttcacgttttttaccgaaaggctgcaacaacgcctcggcttcgaataccaacacgccaatgttttggaaattgaaaacggcaggctgaccggccgtctgaaaggcagaatcatcgacgcgcaggcaaaggcagatttgttgcgcgaataccgcagccgcctcggattgcagccgcatcaggtgttggcggtgggcgacggtgcgaacgatattccgatgctcaaagaagcgggcataggcgtggcttaccgtgccaaaccgaaagcgcgggccgccgccgatgcctgtatcaacttcggcggtttggagcgtgtacgcggcctgttcggataggcggataggaaacggatgtcgtccgaaaggttttcagacggcatttgaacggcaggaacgacagtgggacgcagaaaactttggtttgccctggcagcagcgggcgttatcggcggtttggtcggcattgtgctgacggaactgatgcacttcatacagcatacggcatacggttatggcgcggacggcgtgtacacttcgttccgcgaaggcgtggcacaggcttccggtatgcggcgcgttgccgtgctgacgctgtgcggcgcggtcgcaggcagcggctggtggttgctgaaacgtttcggcaagccgcaaatcgaaatcaaagccgccttgaaacagccgttgcaggggctgccgtttctgacgacggttttccatgttctgctgcaaatcataacggtcggactcggttcgccgctcggacgcgaagtcgccccgcgcgaaatgaccgccgcgtttgcttttgccggcggcaaacgcttgggtttggatgaaggcgaaatgcggctactgattgcttgcgcttcgggtgcgggtttggcggccgtgtataacgtgccgctcgcctccacacttttcattctcgaagccatgctgggcgtgtggacgcagcaagccgtcgccgctgcattgttaacttcagtcatcgccaccgccgtcgcgcgcatcggcttgggcgacgtgcagcaatatcatccggccaaccttaccgtcaatacttcattactttggttttccgccgtcatcggcccgatactgggcgtagccgccgtctttttccagcgtaccgcccaaaagttcccctttatcaagcgcgacaatatcaaaattattcccttggccgtctgtatgtttgcactcatcggcgtgatttccgtttggtttcccgaaattttgggcaatggcaaagcaggcaatcaactgacctttggcggattgaccgattggcaacacagccttgggctgaccgccgtcaaatggctggtcgtcttaatggcgcttgccgtcggcgcatacggcggtctgattaccccgtccatgatgctcggcagtaccatcgcctttgctgctgccaccgcgtggaacagtgtttttcctgaaatgtcctctgaaagcgcagccattgtcggcgccgcagttttcctcggtgtttcccttaaaatgcccctgaccgccatagcctttattttggagctcacctacgcccctgttgccttgctcatgccattatgtacaggcatggcaggtgcagtatgggtggcaaagaaaatgggatttaaataggcaaaagcaaaaggccgtctgaaaccaagtttcagacggccttttacaataaaattgttaacaatatttgcaaaaacctactgccaaaaatgcgaaactgggggataataccgccctgaaaattcatcccatactgattaaaccttcaacaaaggaaatccaaatgtcttccatcaaacgcgccctgatcagcctatccgacaagacaggcgcagtcgaatttgcccaaaccctgcacaaactcggtgtcgaaattctttctaccggcggtacagcaaaactcttggctgatgcaggcgttcccgttatcgaagttgccgactataccggttttcccgaaatgctcgacggccgcgtgaaaaccctgcatccgaaaatccacggcggtattctcggtcgtcgcgatttggacgaacacgtcgccaagatggaagaacacggcatcggcaatatcgacctcgtgtgcgtcaacctctacctcttcgctgccaccatcgccaaaccaaactgcacgctggaagacgcgattgaaaacatcgacatcggcggcccgaccatggtgcgctctgccgcgaaaaactggaaacacgtcgccatcgttaccgacaccgccgatttcccggccatagctgccgaactcgaagccaacaacggcgcattgagcgacaaaacccgtttcaacctctcgcgcaaagcattcagccataccgcccaatacgacggtatgatttccaattacctgacctcgctttcagacgacgtcttgagcggcacgcccgaaatcgccggattccccggccggttcaatcaaagctggattaaagtgcaagacatgcgctacggcgaaaacccgcatcagcgcgccgcgttctaccgcgatattgaccccgccgcaggcagcctcgctgcatacaaacaactgcaaggcaaagaattgtcttacaacaacatcgccgatgccgatgccgcatgggaagccgtcaaatccttcgacgtgcccgcctgcgtgattgtgaaacacgccaatccgtgcggcgtagccatcgcctccaataccttggatgcctacaaactcgcctacgccaccgacaccaccagcgcgttcggcggcatcatcgctttcaaccgcgaagttgacggcgcaaccgtcaaacaaattaccgacaaccagtttatggaagtcctcatggcgcctaagttcaccgccgaagccctcgaaatcgccgccgccaagaaaaacgtgcgcgtattggaagtgccgcttgaggcaggcgcaaaccgcttcgaactcaaacgcgtcggcggcggactgttggtgcaaacgcccgacatccaccgcatcagccgcgccgatttgaaagtcgtctccaaacgccaaccgaccgagcaggaatggaacgatttgctgttcgtctggaacgtcgccaaatacgtcaaatccaacgccatcgtattcggcaaaggcggtcaaacctacggcatcggcgcaggccaaatgagccgcgtggacagcacccgcatcgccgcccgcaaagcgcaagatgccggtctcgacctcaacggcgcgtgtgccgcatccgatgccttcttccccttccgcgacggcgtggacgtgattgccgaacagggcatcaaagccatcatccatccggcaggctcgatgcgcgatcaggaagttttcgacgcagccgacgaacacggcatcgccatggtcgtaaccggcatccgccatttccgccattgatgcagataaacaaggtaatgccgtctgaagggctttcagacggtattttgcgctattttgcgaaggtagggatgacggttcgggtattcctgacagggtggattttcaaggtgttgtatagggtgtaggaggattcgtaaaaggtgggatgcagggtgtgcttcagcccgctgcatcaaaaatttttggagaaccggcgggagtcggcggttttggtttcggcggggacggtggaaatgggtaacattgacggaatcgacggaagcggtggactgaagcccacccttgtatattggaatcaccgtatcatagcaacaaaccgcccagccgccacccgcgcccacccaaggcacacaaccgttgcgtagctcagggagcggcagggcaacccatcgacacaaccggacagttgccggacaacacaaccgaatgcaaggcaggtttatgatgagtacccaataccattacgcaggtatagtgaattaaatctaaaccagtacagcgttggttcgccttagctcaaagagaacgattctctaaggtgctgaagcaccaagtgaatcggtttcgtactatttgtactgtctgcggctcgccgccttgtcctgatttttgttaattcactatatcgacatcgccaaacgaaacttcgtcatcgccgtttcgtctttgtctaaaaccaaaaccgaaaccaacaaccccaaaggtatcgcccatactatcgaataccttaaaaaacacaaggtcgccctcgtcgtgacggaaagtaccggcggtctcgaaatccccgccgccaaagccatccgccgagcagggccgtgattatcgccaacccgcgtcagacgcatcagtttgcccaatcgcagccgctgaccaaaaccgacgccaaagatgccaaaatgcccgccttcttcgcacagatgacggcacagaaagaagattcgcaaaccatgccctaccacccgcccaccgaagtggaagaagtgttggaagccttggttaaccgccgcaaccaactggtggatatgcggactgccgagaaaaaccgtctgcattaggttcatgaaacgcaagtcgaaagcgtcaaacaactgattgcccattttgaccggctgattgacgaattggacaaacaaatcgacaaccacacccacacgcattttgacggcaaagcccaagtggcagagcaaatcaaaggcatcggttcgataacgacggctacgctgatggcgatgttgcccgaattggggcggctgtcgcacaaacggatagcgagtctagtcggcattgccccacacccgagggagagcggggaaaccaaattcaaaagccgctgctttggcggaaggtctgcggtgcgtaaggcactgtatatggctaccgtggcagcgacacgttttgaaccgcttattcgggatttctaccaacgcctgccgtccgagggtaagccgtataaggttgccgttacggcatgtatgcgcaaactgctgacgatatcgaatgcccggatgcgtgattattttgccgaaaacgataccgccgaaaacggtatctaaacggcttgatttgagttttggtatttttgcccgacggggtgaaaaatacagttgcttttttatgtctgtccgtttcgcaaaaaacatcggcttaatactatatattgtgttttatgggtttgagatgcgccgggcgttgattgcgaaaattaagattgctcaaaaggagctgggcttggatgacggtacctatcgcgcggtgttggagcgtgtgacgggcaagcggtcgtgtgcggatatggatgtttccgaacttgagtctgttgtcgctgatatgcggtcgcacggatttaagcctaaagcaaaaggtaacccacacggcaaaccgcatctgcgtcggacatcatcagcggcaatgttggacaaagtcgaagccctgctgaccgtcggcggcaaacattggaactatgcacacgcaatggcgcggcggatgtttggtaaggataaggtcgaatatttagacgatacgcagctacataaactggttgctgcgttgcagattgcggaaaacaggaaaacggaaaaagcgggtggggatgatggggttcgaaaaagttgaacatttattgccggataccgtgttggacattgtggatgtcatcggactggcagcgacggaacagctggtcaaggcgattggcggggcgcggtttaaatttggtaagggcaaggtggacaccgagcgtttggcaattttggtcgaagccatcggcgaagtgaaaacacatgagctgttgcaggtatatggtggcgaggaattgtatgtcccacggtgcggcaaggcgttaatacagttgagaaaccataggttttatcaggagtttgtcaaattgcgcgatattgataagaagagcgggcttatggcgatgacgaagctatgccctaaatacggcatctcttcacgaacgggatatacgattatcaatgaaatgagccgacctgcggcacagcaggcagctttattttaggcagtgatgtgtgaccaggctttggccgtctgtattcagacggtcttttttttggtttgcaggggtgaaacatctaccgttcgggacgatgggttaaagacggtttaatggggttttcaaatgttatagtggattaacaaaaaccagtacggcgttgcctcgccttagctcaaagagaacgattctctaaggtgctgaagcaccaagtgaatcggttccgtactatctgtactgtctgcggcttcgtcgccttgtcctgatttttgttaatccactatatgcaatcaatattttttggagatgatgaatgggcaaaaccgtaaccttaaccgctggacacagcaacaccgacccgggtgcggtcaacggaagcgaccgtgaggcggacttggcgcaggatatgcgcaacattgtggcttcaatcctgcgtaacgattacggcctgaccgttaaaaccgacggcacgggcaaaggcaatatgccgctgcgcgatgcggtcaagctgattcgcggctcggatgtggcgattgagttccacaccaatgcggcggcgaacaaaacggcgacaggcatcgaagccttgtccacgccgaaaaataaacgctggtgtcaggtgctgggcaaagccgttgccaagaaaaccggctggaaactgcgcggcgaagacggctttaagccggataacgcagggcaacattcgcgcctggcttatgcgcaggcaggcggcattgtgtttgagccttttttcatcagcaacgacactgatttggccttgtttaagacgaccaaatggggcatctgccgcgcgattgcggacgcgattgcgatggaattgggagcggcgaaggtatgaaaaagtctttgattgctttatgtgttgcccattgtgcaaagttgaaaaacgattttggcgtaccaccgttacctgaaatcaaaatcacgccaagccctgttcgggtaggctctttgaaacaacatccgagcctgcgcttgggtaaatcaggcgtggcggctgctaaacgtgcggcgcgcaaacgcaagaatcgtcgttaatcatgggacaggttgcgttttacgaaaagatgattgggctgtggtcggccaaaagccgtgaggcaagcgaacaggcggacttggctgcgtttgaatttgcggagggcgaactggccaattatcgggaaatgctgaaacggcacctgcaaaccaaaagtgtggaatagcaatgcgtattttggatatttttaaaaacccggcgacaggcaatgtgtcgcactcgaaactgtgggcaaacgttgcctgcgcggctgggacgtttaagtttgtgatgttgcccgatccgtcggcggaaatttgggcggtgtatttgggcattgtcggcggctatgcggtggcgcgttcatttgtcagcgtgaagcgtcaggaggtcgagaatgaatctcgtgaaactgctggcgaataactggcaaccgattgccattatcgcgcttgtcggcacgggcttggctgtgtcgcaccatcaaggctacaagtcggcatttgcgaagcagcaggcggtcatcgacaagatggagcgcgacaaggcgcaagccctgctgttgtcggctcaaaactatgcgcgcgaactggaactggcacgcgcggaagctaaaaaatatgaagtcaaggcgcacgctgtcggcatggctttggcgaaaaaacaggcggaagtcagccgtctgaaaacggaaagagacctttgcaaaattcctttccctcccgacagccgaaacccaaacacaggttttcggctgttttcgccccaaataccgcctaattttacccaaatacccccttaatcctccccggatacccgataatcaggcatccgggctgccttttaggcggcagcgggcgcacttaacctgttggccgctttcaacaggttcaaacacatcgccttcaggtggctttgcgcactcactttaatcagtccgaaataggctgcccgcgcatagcggaatttacggtgcagcgtaccgaagctctgttcgaccacatatagtggattaaatttaaaccagtacggcgttgcctcgccttgccgtactatttgtactgtctgcggcttcgtcgccttgtcctgatttaaatttaatccactataacgggtcttcgataaatatcggttacgcttggtttgcacttccgacagcgggcggttgcggcaggctttgctcataatgccgtccaacaactgatgttcttccagatgttgccggttttccgcactgtcatagcctttatcggcatagacggtcgtaccttcgggtaacccttccaacaacggcgacaggtgtttgcactcatgggcattggcgggggtgatgtgcagtttctcgatatagccttccgcatcggtacgggtatgttgtttgtaaccgagtttgtagaggccgtttttcttgatccaacgggcatcgctgtccttactcggtgtggtttggccgctgatttgtccttcttcatcgacttctatggcctgacgctgttcgctgccggcggtctgaataatggtggcgtcaatgacggcggcggatgctttctctacttttaagcctttttcggtcagttggcagttaatcagttccaacagttcggacagggtgtcgtcttgcgccagccagttgcggtagcggcataaggtgctgtaatcggggatgctcagttcgtcaaaacggcaaaacaggttgaaatcgatgcgggtgatgaggctgtgttcgagttcgggatcggagaggctgtgccattgtccgagcaggacggctttgaacatggatagcaggggataggcgggacggccgcggtggtctcggaggtaacgggttttttgacggttcaggtactgctcgatcggctgccaatcaatcacttggtccaacttcaatagcgggaaacggttgatgtgtttggcaatcatggcttgcgcggtttgccggaagaaggtgctcatgagaaatcccctaaatgtcttggtgggaatttaggggattttggggggattttgcaaaggtctcaggcggcaaatcgccacccttcccttcaaaccttccgcctgtcccaacagcagacaggcgaaaaagcccttaccactgataaccgacagatgcggaagcaccgaaatggccgcgcgaattgccggaagccgtgcctttgataatccaatttccgccgtcggaaatactggagtagccgatggcgtaaccggcttcgccgcgataagtgccgccgccgatcgccatcatactcttgccgggcaaatacgcctgaaccagacctgcggttgcaatcgcttgggcgatgcccgcacgcgcgttgccgtccacattgtcgatgcggttgttcaagttttgcgccacgcctttaagttgtgcgacgtttgtaacatccccctctttaacgcccggggcgacattggtaatgcggacgggtttgttgtccttcttgctgccgacattcaatgcgtccccatccacgctcaaagtgggcgcatccgcccccgcgccgagcgaaacgctggaaaactgcggggtcatcgaagtggcgatgtcgatatttttaccgttgcgggtaatctcgatgttgttgccggcattaatgttgacggtttcatccatctttcccttgctcggcgaaacattgccgctgatgactttgcccgaagaacctgcaaccgctttggaatccaaattccaaccgctgttttgcagctgattgacgtttagggcatcgccgacatttacatcatacataacagtgatgttgccttgatcatctttacttacagtcgcagttgtacctttaccactagcaaaggttacatttgtgcctgatgtaacggtttcaaacttgtcagcttgacctgtttgaccattagcggttgttgttttcattctccaaccagccttgtttactgcatcaatcacttcttttgcagtcactaagccttcgccttcgtctgtagaagaaccattctcgcctttgtctttaccagtaaccaacttaccgtctttttctttaataacagaagtcttcgcaccgattttaacttcggttttcttgccgttgtctttgctttccacattaacagtcgttgttttcgtatctgcgctcaagaactcgactgtgtcgtaagtgcggacgaaatcaacgttatcggaagctgttgtaccgggtttaacgcctttaatgttccagccagcgtttaatacgtctttaacgcttgccgcacgttttttctcgtcatcggtaacgttgtcgttggttacgtttgtggtcgctccggtattcagcagcgtatcggtcaaagtcgaaccaataccgttcagatgaaccgtggtgtcgccgttcgtcccagccgtttctttcgcaaaattcaagcctttggtgtcgcttgtgatgttgactttattgccgtttgcgctaaacgataatttttcagttccaacactggtcagatctgtgaggtcttttttcagcgagtaggtgaagtttgtgccgttttgtttgattttcaggttgtcgccggctttgagggtgatttctctggctgttagtactcctttctcgttgaaatatactgcccaatctgaattttcttctactttttctttttctcccgtgccttctttatcggaattgactatcaacacggcaacagtgcgttgtacggggtctaaatataaatcttcttcttgctcttcattgttagcacttgcctgaaccgttgcaaacaacagtgtcgccaatacggcggtcttcacggttgcggaggcgcgtttggtgtggttgcgtgtgagctcggatacgacgacccaggcattgagggcactattccaaatgatgcggtatattttgttcattttgttttttcttttggtttgtttgaatggttaaatcggggtttgggggcggatggtgcggcatccgcccggtttttgggggttgggggttttctgataaattcccccaacttaaaatctcgtcattcccgcgaaggcgggaatctgggacgtggaatctaaggaaactgttttattcggtaagtttccgtgccgacgggtctggattcccgcttttgcgggaatgacggcggtggggtttctgttttttctgatagattcctgtggtttttctatggattcaatcattcctgataaattcccataatctaaaatctcgtcattcccgcgaaagcgggaatctaggacgtggaatctaaggaaactgttttatccggtaagtttccgtgccgacgggtctggattcccgcttttgcgggaatgacggtcggtggggtttctgttttttccgataaagtcctgccgcgttgtgttgctggattcccgcctgcgcgggaatgacggcggtgggggtttctgttttttctgatagattcctgtggtttttctatggattcaatcattcctgataaattcccataatctaaaatctcgtcattcccgcgaaggcgggaatctaggacgtggaatctaaggaaactgttttatccggtaagattccgtgccgacgggtctggattcccgcttttgcgggaatgacggcggtggggtttctgttttttccgatagattcctgttgcgttgcgtttttggattcccgcttttgcgggaatgacgcggtgggggtttctgttttttctgatagattcctgtggtttttctatggattcaatcattcctgataaattcccataatctaaaatctcgtcattcccgcgaaggcgggaatctaggacgtggaatctaaggaaactgttttatccggtaagattccgtgccgacgggtctggattcccgcttttgcgggaatgatggcggtgggggtttctgttttttccgataaagtcctgccgcgttgtgtttctggattcccgcttttgcgggaatgacgcggtgggggtttctgtttttgctgatagattcctgtggtttttctatggattgaatcattcctgataaattcccataatctaaaatctcgtcattcccgcgaaggcgggaatctaggacgtggaatctaaggaaactgttttatccggtaagtttccgtgccgacgggtctggattcccgctttcgcgggaatgacggcggtggggtttctgtttttgctgatagattcctgtggtttttcggttgctggattcccgcttttgcgggaatgacggcggtggggtttcggttttttccgataaattcctgttgcgttgcgtttttggattcccgcttttgcgggaatgacggtcggtggggtttcggttttttccgataaagtcctgctgcgttgtgttgctggattcccgcctgcgcgggaatgacggccgccggacggcaaacgaccatacacaattattgacaaccccatttattgcgaaagtcagcctaggagaatcgatctaattgtcaacattcccttatgatcaaagggattacactttattttacgcaaatgcgggggggggggtgatttttgacgttttttgccgaaaatttacattcggacgacgaaaaggaaaaagccgtgtcgcatctgtgcaacacggcttggcgggcgcaaacggatatagtggattaacaaaaaccagtacggcgttgcctcgccttagctcaaagagaacgattctttaacaagtgaattggttccgtactatttgtactgtctgcggcttcgtcgccttgtcatgatttttgttaatccactataaaacggtgttccctgccgccgcaggcggaacgccggatgacggggttttccctaagggtgcggctgccgctatatcacgaaatccaacaggtagaaatcttctttgcccacgccgcattcggggcatttccagtcgtcggggatgtcttcaaacttggttccgggggcgatgccgtgttcggggtcgccgtgttcttcatcgtaaatccagccgcaggggccgcacatatattgcgccatttgtgtttccttgttttttgtatagtgggttaacaaaaaccggtacggcgttgcctcgccttagctcgaagagaacgattctctaaagtactgaagcacccgtactatttgtactgtctgcggcttcgccgccttgccctgatttttgttcatccgctataaatcagggtttgggagaatggtgcggtatccgcccggtttttttggggttggtttttttcgatagattcctgtggtttttcgattactggattcccacttccgtgggaatgacggtttggaggtttcggttttttcgatgaattcctgttgcgttagggggggggctggattcccgcttttgcgggaatgacggtttgagggtttctgttttttccgatggattcctgttacgttgggggctggattcccgcttttgcgggaatgacggtttgagggtttctgttttttccgatggattcctgttacgttgggggctggattcccgcttttgcgggaatgacggtttgagggtttctgttttttccgatggattcctgttgcgttgggggctggattcccgcttttgcgggaatgacggtttgagggtttctgttttttccgatggattcctgttgcgttgggggctggattcccgctttcgcgggaatgacgcggtgggggtttcggtttttccgcctgtttattttgcggcttcgattgccgctatttctttgcgtaggtgtttgatagcgggggttacgatggcaacaaacattgcttcgcggacgcgcctttgggcgggactgcgcatcaggtagccttttgcgccggaatgcagggcggcggattgggcggcggcaagtgccagtacggcggcggcttcgcgcagcttgagggtagcaaggttgtcgggcgtgccgctccaagccaagccggcgagccgttcggtttctgcccacgcgccgtccagccttgttttgaggctgtcgtagccgtcgttgaggtagttgttgacttcggcgttgacgacgttggcgaggcggatgatgccgaggctgccgtcgattacgcccgcgccgatgccgatttgcaggaggataaagcctgctttgatgctttggatgtagtcggcaaactgttcgggcgcggcgatgatgtcttcgtcggggataaatacgtctttgaaattcaggctgaaggtgcgcgtaccttcgagggcgcaaaattcggggcagttttgcaggcttacgccttcccattgtccgcctgtgatgaacataacgtagccgtcgccgatttgggcggtattcgcccagatgtggtcttcaccgatgttggacacccacggcagcgcgccgttgactgtgtagccgccttccacgcgttcggcttggaggttgtgtttttcgatgtcggcaaggtgtttgacggtattggacatgcccgtacccgccaatactttgccttgcaggatgtcggcaaggtatttgtctttgacggcccggttgggcgtttggtgcagataccacgcgcaagccgcctgacaccacgcactgaaagaggttgcgccgcattctttgccgatttcgcgcaatacggcgatttgcgttgccaaacccaagccgttgccgccttcggcttctgtaccgactgcgccgaatccaccgattgcgccgagttcgcgcataaatgcttcggggtagtatcctttgcggtcgatgtcgtccactatgggtttgagcttggttttgacgaattcggcaacgttggcaatcagggtttgggcgttcatctttgttccttaaggtttgcggggaaatcgggggcgcgcctgatgcgcggctgcttccctgccgcttaggcggcttgtttttgtttgagggggtgtttttgaaaaaccgcccgatattcgggcggtttgccgtatcaggcgtaagcctgcaattcggggttgatttcggtttgtccgaggttgttgacgtagttgcacagggttgccaaggctacgcccatcacgacttcgactgcctgctgctggttgtagcccgcatcgaaaaatgctttgagttcctcgtcggataccgcgccttttttcgccattacggcttgggtgaaggcggcgagcgcgccgagtttggcatcgtcaaattcgcctgctgccaaagcgcgcgcggctttgacggattgttcggacaggagttttttcagggttgcgagtttggtgtgccctgccacgcaaaaaccgcattggttggtacgggcggcgatgatctggatgacttcgacttcgccggcggtcaggctgttggcggcgttgagcttgccgacttcttggtaaaacgccaaggcttcgggggcgtttgataatacgccgataaggttggggataaagccgttgttttgaagtaccgcctcgacgcgcgctttggcggcttcgggggcggtttcgagggtgtgtacggttaaacgtgccattttctttccttgttcgcaaatattgggtacgggcgcatggtatgcatttcggaacggaataggaaagactgattggttatgtgctgcaaacaaaaggttataagaaatgccgtctgaacatttttcagacggcatgatggaaaagaaaacgcgcttatcggcccccgcgcccgaaatattgcgccaatgcggcttggggattggctgcctcaaccgtttcgggcaattcggtatagccgcgcgataaaaggtggcgtgcataaaggctgttgccctttgcgccgaaccagacggaaaccgccaagcccaatacgttaaacgccgagtctgtggcgggcgtgtcgccgtaaaccagttgggcaaacacagccagcacgaatatcgcgcccgtcagccccagccccaaaccccacattcttttgaaacacgcccacagcgtgccgaacaagagccccggccatgaccagccttgtttgacggcttggggcggcagggcgggatgggtgtagattttgtatggtttcatcgtgtttccttttcggttgaaaccctgccctttgggaaggtaggatcagactttatagtggattaaatttaaaccagtacggcgttacctcgccttgccgtactatctgtactgtctgcggcttcgttgccttgtcctgatttaaatttaatccactatatttgggaggcgcgcgcgcctgtgccggcatacggcttgaaagcgattacccgatggggaacttcaaacccgacaatgccgtctgaacggtgtcttgccttcagacggcattgcctgccttcaaagcggacgcgcttattccgcccagtttttctttttgctggttttgcctacgcccgggttgaagctgttggtcgggtcaagtttgcggtaaaactgtttgagcgcgggcttggcttcgtacaaatggccgacgttgtgttcggctggatattgcgcgccgcgttgatccaagagatgcagcatttcgtgttccaatgccatgcagtcgttgccttttttgatgatgtaatcctgatggaaaacgtggcacatgaaatgtccgtagtagagcttgtggatgattttattgtcgatttccggcggcagtttttcaaaccagtcgcggtcgtcgcggcgcagggcgatgtcaagcgcgaccaagtcctccacttcgtcgtcgtgtacggcacggtagcggatggcggctgaggcgacggcgaaacggtgcagcatcgcggcttgggtttcttcggcgttgcactcgaaaaacgcgccgccgtgatgtgcaaaatactctttcaggaacgcgcgcgcctcatccacgccttttccgcccattttcagaatcaggtggtgttcgtatttgtcgcggtaatcgcgcatggatttgggcagatggtcaggcaggaatttgctgacgaactgcattgccttgtcggaaaaatgtttgggcaggaagctgacttttttgccgaacctgtccacgcgtgccttcaaatcaaataatttcggcagttggtgcgtaccgaattttttgatgacgtaaaacgtatctttgccgtacacgtcggcaatgtcgaaagcgtggcggtggatgtattcgccggaaacgggcaggctttcaaattcgcccaaggcggcgcggcggatgtcggtcagctcgttgatgtcgttcgtgccgatgtagaacacggccgtttgtttttcttgcggaaaggtatccaagcggacggcgaataccatcagcttgcccgcgcagcccgaggcttcgtaatggcgcgctgggtcggcattgaaacgcgcggcggtcggttcgtccacttggcggacatgttcgcaataggcgtggtcgtgtcctttgcccgcgtcttgcgtgatgtctttgttttgataatgatgaccttgaagattggtcaggatttcttcgggcgtgttgcccaagtctatgcccaagtggttgaccagttccaacctgccttcttcgttgatttgggcgaacaacgccatttcggtgtaggccgggccgcgctgtaccaacgcgccgccagagttgttgcacacgccgcccaagacggacgcgccgatacaggatgagccgataaccgaatgcggttcgcgccccaaaggtttcagcagcaattcgagctggttcagggtcgagccgggcaggcagacgacttgttcgttgttgttgatggtttggatgatgttcatccgcatggtgttcacaatcacgatgtcgcggtcgtaatcgttgccgtcgggggtcgagccgcccgtcaaaccggtattcgccgcctgcgtaatcacaatcacgtctgcttcgacgcacgcctgcagaattttccacatttccagaatgcttccggggcgaaccaccgccaacgccttaccctcgccgaagcggtaaccttggcggtattgttcggttttcgcggggtcggtgatgatgtatttttcgcctacggtttgggtcagtcttgacagtaattgtgatgcgctcatggcagtttccttaaaattgtcggcaggtgcattgcacattggaattgttttcacattgtagttatacgttatggcaaagtaaagaaaatgccgtctgaacggctttcagacggcatcggtgcgatacgggaacgccggaacatcgaagctccggcgtttcaaatagggcggcgggccaaacccccggcactggcgcattggagtgggctgctggcttccgcccctgacccggtgttccgatttgccatgcggggagacccgcctcagagaaacggcattataacgggttttctgaaaaactcaaccgttttgatacggtcatacgccggaaacaccacctaaaatttatatttgataatattgtcaacaatttctcaaagcgttattttgtttctataagggtatttcctgtttcggcattgaaaagtatcaaaaattgaactacattatcgccttttcaaactcgcctgaaaccgacttttcagacggcattcaaataaaaactgccaaacacggacacaccatgaccacgactaccgcccctcagcgtattcgggaaatcccctacaactatacttcctacaccgaccgcgaaatcgtcatccgattattgggcgacgaagcgtggcaaatcctgcaagacctgcgcggtcaacgcaaaaccgggcgttcggcgcggatgctgtttgaagtgttgggtgatatttgggtggtcgtgcgcaatccgtatctggtcgatgacttgctggagcacccaaaacgccgcgccgcgctggtacgtgaaatgcgccaccgcttaaatgaaatccgcaaacgccgcgacgataatcggcaagtggatgtgttggttgccgcagcagaaaaagcagtcgagcgttttgatagcagttttgatgaaaccagccaaaaacggcggcagattttggagcgtttgagcaaaatcaccaagccgcacaatattatgttcgacgggctggcgcgggtaacgcacgttaccgatgcaaccgactggcgcgtggagtatccgtttgtcgtcgtcaatcccgacacggaggctgaaatcgcgcctttggtgcgcgccttaatcgagctggatttggtcattattccgcgcggcggcggcacgggttataccggcggcgcgattcctttggacgcaaacagcgcagtcatcaataccgaaaaactcgacaagcatcgtggtgttgaatacgttgagctggcaggcttggacggcaagcatccgattatccggtgcggcgcgggcgtggttacgcggcgggtggaagaaaccgcgcatcaggcaggtttggtgttcgccgtcgatccgacttctgccgacgcgtcatgcgtgggcggtaatgtggcgatgaacgcgggcggcaaaaaagccgtgctgtgggggacggcgttggacaacctcgcctactggaacatggttaaccctcaaggcgaatggctgcgtatcgagcgcgtgcgccacaatttcggcaaaatccacgacgaagaaaccgccgtgttcgacgttcacacgctggattcagacggcatcaatatcgttaaaaccgaacgcttggaaatccccggccacaaattccgcaaagtcggtttgggcaaagacgttaccgacaaattcttgagcggcctgcccggcgtgcaaaaagaaggtacagacggcatcatcaccagcgttgccttcgtgttgcataaaatgccgaaatacacgcgcaccgtgtgtatggagtttttcggtacggtcgccaccgccacgccatctattgtcgaaatccgcgactttttgcttgcccatgaaagcgtgcggctggcgggtttggaacatttggactggcgttatgtccgcgccgtcggctacgccaccaaagcggcgggcaagggacgaccgaaaatggttttgctggcagacgtggtttcagacgacgaagccgccgtagaggcagccgccgaacacatctgtgaactcgcacgcgcccgcgacggcgaaggctttatcgccgtatcgcccgaagcccgcaaaaccttctggctcgaccgcagccgcaccgccgccatcgccaaacataccaacgcctttaaaatcaacgaagacgtggtcatcccgctcgaaaggctcggcgagtattcggacggcatcgaacgcatcaacattgagctttccatccaaaacaagctcaaactctgtgccgccttggagcaatatctttcgggcaaactccccatcgacaaaatgggcactgacctgccgaccgccgaactgttgggcgaacgcggcaaacacgccctggcccacgtttccgccgtcaaaacgcgttgggaatggctgctcgccaatcttgacacgccgcttgccgactacaaagcccgctacggcgcagccgtccacgccgcacccgaagccaaaaacaatgaaagctgctttattgccttccgcgatttccgcctgcgcgtgtctgtcaaagcggacgtaatgaaaccgctttctgaaatcttcagcggcaaaaccgacaccaaaattatccaaggcttgggaaaaatccacgcaaaaaccgtacgcagccgcgtctttgtcgccctgcatatgcacgccggcgacggtaacgttcacaccaatattccggttaactcagacgatgccgaaatgcttcagacggcataccgctcagtcgaacgcattatgaaaatcgcccgttcgcttaacggcgtgatttccggcgaacacggcatcggcattaccaagctcgaatttttaagcgacgaagaaatgcagccgttttgggactacaaaaaccaagtcgatccgaaacacaccttcaaccgtcacaaactgatgaaaggctcggacttacgcaacgcctacacgccgtccttcgagctgttgggcgcggaatcgctgattatggaaaaatcaaacctcggcacgattgccgattccgtcaaagactgcctgcgctgcggcaaatgcaaacccgtctgctctactcacgttccgcgtgccaacctgctgtacagcccccgcaacaaaatcctcggcgtgggcttattgatcgaagccttcttatacgaagaacaaacccgccgcggcgtttccatcaaacactttgaagaactcatggacatcggcgaccactgcaccgtgtgccaccgctgcgtcaaaccctgccccgtcaacatcgacttcggcgacgttaccgtagccgtccgcaactatcttgccgattccggccacaaacgatttgcgcctgccgcagctatgggtatggcgtttttgaacgccaccggcccgaaaaccatcaaagcccttcgcgccgccatgatacagatcggcttcccagcgcagaatttcgcctacaaaatcggcaaacttcttccaatcggcacgaaaaagcaaaaagccgaacccaaggcaaccgtcggcaaagccccgattaaagaacaggttatccatttcatcaaccgcccactgcccaaaaacgtacccgccaaaacaccgcgctccttattgggcatcgaagacggcaaaagcatccccatcatccgcaaccccgccgcgcccgaagatgccgaagccgtgttctacttcccgggttgcggctctgagcgtctgttcagccaaatcggacttgccgttcaagccatgctctggcacgtcggcgtacaaaccgtcctgccgcccggctatatgtgttgcggctatccgcaagacgcaggcggcaataaggcaaaagccgaagaaatgagcaccaacaaccgcgtggctttccaccgtatggcgaacaccctcaactacctcgacatcaaaaccgtcgtcgtcagttgcggcacttgttacgaccagctcgaaaaataccgctttgaagaaatcttccccggctgccgaatcatcgacatccacgaatacctgctcgaaaaaggcgtgaaactcgacggcgtaaaaggtcagcaatacctctaccacgacccctgccatacccccatcaaaaccatgaacgccacccaaatggccagcagcctgatggggcagaaagtcgttttaagcgaccgctgctgcggcgaatccggtatgtttgccgtcaaacggccagacatcgccactcaggtcaagttccgcaaacaagaggaaatcgagaaaaacctcaaagagctgccgcagggcgaacccgtcaaaatgctgacctcctgccccgcctgcctgcaaggcttgagccgctacgccgacgacaacaatatgcctgccgactacatcgtcatcgaaatggcgaaatacatcctcggcgaaaactggctggatgagtttgtaaaaaaagccaacaacggcggtgtagagaaagtgttgctgtaacaacggacacggaaatgccgtctgaacgccgaaagccttcagacggcattgtttgaaccaaatatagtggattaacaaaaatcagaacaaggcgacgaagccgcagacagtacaaatagtacggcaaggcgaggcaacgctgtactggtttaaatttaatccactatacctacccaaatcatgattgacagacaaacaaacgaacccaaacaaaaaacccgaatcatccttgcccctatgcagggtctggtcgatgacgtgatgcgcgacctgctgacgcgtattggcggctacgacgaatgcgtcagcgaatttgtacgcattacccataccgtgcattcccgatccatatggttaaaatatgtccccgaaatcgccaacggaaacaaaacgttttccggcacgccttgcaccgtccaacttttgggcagcgatgcggacaatatggcggcgaatgcgctggaagccgtccgcttcggtgcgaacaaaatcgatttgaacttcggctgccccgcgcccaccgtcaacaaacacaaaggcggcgcaatccttttaaaagagccggaactgatattccacatcgtcaaaacgctgcgcggacgtttgcccgcacatattccgctcaccgcaaaaatgcggctcggttacgaagacaaaagccgggctttggaatgcgcctgtgcgattgccgaagggggcgcatgcggactgaccgtacacgcgcgtaccaaagccgagggttacgaaccgccggcgcattgggaatggataaggaaaatccgagacagcgtcaatattcccgttaccgccaacggcgacgttttcagcctgcaagactatatcggcatcaaaacaatcagcggctgcaacagcgtgatgctcggtcgcggcgcggtcatccgccccgatttggcgcggcaaatcaagcaatacgagaacggcgggccggtcaaagacacggattttgccgaagtttccaaatggatacggcagtttttcgagctgtgcctgacaaaagaggcaaacaacaaatatccgctggcgcggctgaaacagtggctgggtatgatgaagaaagaatttgcagcagcacaaaatctgttcgaccgcgtccgaacggttaaggatgcggacgaagttcggaacatcttggctgaatttgagcgagaaatgaatacttgaatatgtatagtggattaacaaaaaccggtacggcgttgcctcgccttagctcaaagagaacgattctctaaggtgctgaagcaccaagtgaatcggttccgtactatttgtactgtctgcggcttcgtcgccgtgtcctgatttttgttaatccactatatccgctccaaagcaaatgccgtctgaaaacctttcagacggcatttgttgtctttattgccgtttttcgtccgtatccggatttttgtttttcagcttcgcacccaagcccaaacgcctttcataatccgattgcggagtatcgtcttcctgcataccgaacgcgccggcattgacccacagcgacagcagcgcgacgacaaaggcgcaaaagccaatcacataccaaaacattgcccctcccgatttgttaaaatcatatcaaatacagtgccgaatttatcacaaacgcacgggcaaatatagtgaattaaatttaaatcaggacaaggcggcgagccgaagacagtacaaatagagacctttgcaaaattccccaaaatcccctaaattcccaccaagacatttaggagcaccttcttccagcaaaccgcccaagccatgattgccaaacacatcgaccgtttcccactattgaagttggaccaggtgattgattggcagccgatcgagcagtacctgaaccgtcaaaaaacccgttacctccgagaccaccgcggtcgtcccgcctgtcccctgttgtccatgttcaaagccgtcctgctcggacaatggcacagcctctccgatcccgaactcgaacacagcctcatcacccgcatcgatttcaacctgttttgccgtttcgacgaactgagcagtatagtggattaacaaaaaccagtacggcgttgcctcgccttgccgtactatttgtactgtctgcggcttcgtcgctttgtcctgatttttgttaatccactatactttatgccgctaccgcaactggctggcgcaagacgacaccctgtccgaattgctcaaactgattaactgccaactgaccgaaaaaggtttaaaaatagagaaagcatccgccgccgtcgttgacgccaccattattcagaccgccggcagcaaacagcgccaggccatagaagttgacgaagaaggacaaatcagcagccaaaccacaccgagtaaggacagcgatgcccgttggatcaagaaaaacggcctctacaaactcggttacaaacaacatacccgtaccgatgcggaaggctatatcgagaaactgcacatcacccccgccaatgcccatgagtgcaaacacctgtcgccgttgttggaaggtctgcccaaaggtacgaccgtctatgccgacaaaggctatgacagtgcggaaaaccggcaacatctgaaagaacatcggctgctggacggcattatgcgcaaagcctgccgcaaccgtccgctgacggaaacgcaaaccaaacgcaaccggtatttgtcgaagacccgttatgtggttgaacaaagcttcggtacgctgcaccgtaaattccgctacgctcgggcagcctatttcggactgatttgcgcccgctgccgcctaaaaggcagcccggatgcctgattatcgggtatccggggaggattaagggggtatttgggtaaaattaggaggtatttggggagaaaacagctgaaaacctgtgtttgggtttcggctgtcgggagggaaaggaattttgcaaaggtctcagagtgagtttattttggggcggcggcaggtcgggggcaagcggcgtggggcttggttgtggtttttaggtttttgggggtaaaaaatgccgtctgaacttttcagacggcgtttgttttttctatccaatcgaggaactgccgccatttttccagcggcatatcggcccgacgggtttcggtatcgggttcggcttcccagcggcctacctgtatgtagtgcttcaccccgacgatttgcgccaactcggcctgtgtcagtttgcagcggttgcgaagggtgcggaggttgtaaggcgtgtagccgagttccatgtcgttgcggtttattttgtttcgcatatttttttgactgcccggcggcaggtttcggtaaggatggcggcaaatcgggcttcgtctgccggtttgccgtcgaaaaaaataaaatcgtaaagggtgatgccgttttcggaatggcggtaatgcctgcccgggcattcgccgtctgtctgcctgtggattttggcaatcaggcggggatagcggcaatgggtaatgaaacggcttgcgccgtcttgcccgataatccattcggggtagcggttgaatagtgcggctctgttcattttgttcgtgggataaagcccctcgcggggcttgtggtcaggcaaatttgaatatcagtgccaacacggcggcgatggcggtaaccagcccggtggccgctatcatgggataccagcgggactcttgggctatttttacggattcggcgttgattttgtgcgcgtcggcaatgattttggcgatttcggcatctatttttctcagactggagtgtttcatttcttgttcgattatgttcatcgtacttcctttcgtttttggcggttgccgccgcttgtcggatggtaggatgtctgccatgtgtatatattgataccttttaggttttattgcaagtgttttgggcggcggcttcgtatgcttggcggtggcggcggctgtaccattcggcgagttcgcgccgctcttggaggcggtagctgtcggcggtcaggtagtggtgcaggcttgagaagccggcgcgttggagggcggcgcggctgatgtggccgagggcgaggtctgttgtgagggtgtcttttccggcggtcaggctgatgttggtgaagaggtggcggaatccgtgcattgtgtgtttggatttgccgggggtgctgccgtcatagcccagtcgtcggatggcgttgtgggcgaatttgatgctgatgtggtcgggatggggggcgggtttgcgccgtgggcggatgccggggaaaaggtggatgttgtcgccggtctgtgtgtgcagctctcggagtatttctaccgcccagtccgacagtaggacggtaaaggggtgtttggtcttcatgtcggcggcggggatgtgccataaccgggcggtgaggtcgatgtcttgccagcgggcggaaagcagtgcggacggacgggatgacttccccggtttccccatcaatccgcgccgcctcgatttttccgttggcgcgcagcatttccaccgcctgccgcaccgacatcaaccgcttgccgttgcgcctcatcgcctccaccaaaaccgccgaaatcaatttggcttcttccggtttaagctccgtcttgcccgcatcgctgcgccgtttgcgcgtcggcttgacgctgaccgcctccagcttgcggtatagcgtggcaaggctgatgcccaattcctgcgcctgctgcttaagatatgcagagcgtgcgccgcgttccattgcttccgcctgattctcgactgccttaagacgctcaatcattgccggattcatcgccttctcccgtttcaccgcccaaccattccggcacattgtctgtcggtgcttcagtcggcagggcatagctttcgcgcagttgctcgcagtccaaaataatttgattgagcgtgccgaccatctttgcctgatggctgatcccgtgtgcctcactgtgcgcattaagttggtcgaacaaatctttcagacggctcacttgactgcggataccgacctcaaggcttgttaactgcatcgccaactcgctgcctacgtcttccgccttcggctctctgacaacggtttgcttcttagccagcttctcggccagctcatcaattttggctgttttggttttcatcacttcgtctttggcggcgaggttttcgcggctttcgcgcagggcgacgcgcagctcgcgcaccgtcattcggtccacatcgtcaaaggtcatgccgttgacttcttccccttcggccaaacccaccagcgtaacgtcttcttcgaccagcagctcaagcagcttcgacttgcccaaatccatcagcttcggcgcggctttctgcatttgcggggtcgcaaagcggcgagtggctgacatcagacgtgatgtttctgcgatacccagcccaaattggcttttcacaatttccataaaccgtccgtgttccgtatgctcttttaaaataatcagcgcacgtcccagttcgaacatgccttccatcgtctgccgtactgcttgacgaccgcgttcaacccaacgctcttcgctataagtctcgccgttaccccactgctccatcaccagcacactgcgcatcgctgcctgattgcttactttgtcggttgcgataatttcaatttctgtattcattttttatctccaaagtttccgacgtcggaaactttcaaaatccgttaatccacatcgacccgcttgccgatttcggcaatcttgctttgcagccgttcatgctgctgcctgaaccgctctgcgatttgcagggttttgatgccgtaggcgtagttgccgttttcaagtttgatgaccaatcccgaggcaaccaaatcatcaatatccctgctgacttgcgatggcgtcagccccagtccgaccgataaatccttattgctcagaccgataatcggatgctcgtcaagcgcgataaagaccctcaatagccgttgtacccttttactttctgccatccgcatcctccttatttcagtcccagcttcttggcaatttcgtgccccttgccgtaattgcctttgcgctgtccgccgatcaccagatacacatcgcgcggcttaaagccgttctctcttgcccactgcgccagcgtctggccgtttttggcaaaattttctttcaattcgtctgccgtaagcatttctttggcctgtacgcgggaaaatttcagtatccgtccgtacggttggttaatacactcatgattaatcatcgcttttctccttcatccccagcaaaaccgccgcttcgtggcttttgccaaaattgcctttcagcttgccgcgcaagaggtgctccaccgtggtgcgctccagattgaaatatttcgcccaatgcgccttgcacaccccgttgcgcttaaaccacccggccgcgctctcgcgcgtttgcggataggaaataggcttgaaattcaaaggtttttccatattatttatgcctttcgtgtgatataatgtgtttgtttttaggtctctttgcacgataaacatccggtctgttgtgcagcagcagggtcttggcttgttttaaagtaaacaagctttttctcgtagctgggtgtatgtgatccatcatgagctgtcgcgcatgagccttcaaagtgttcattttttcgtcctttctcgtgatgatttagggtgtttgtgtttcgatgtggaaattataggaagaattcttcctattttgcaaggaatatttatgaataactcttccttttttggcaaccgattgaaagaagaaagaaaaaaattaaaaatgactcaagctgaaatcgctgaaaaatgtggggtttcaggaagaatgtggggggattatgaacgtggcatcagccagccaaaagcggaacttttcttccaatttgaaaaggtgggtatagacgttcaatacgtcatgcacggcagacgcggcgaaacagcggtcatgccgtctgaaaccctgaacgccgaagaacaagaactgctggtcttgttccgcgaggcggcagctgccgaccgtgaaatgattctgatggttgcgcgcagggcagagaaaaaagcccaaactgcgcttggtaaagtgagtaatggataaaatggatcaattcgaattgtgccaaaaagaacatgtcaatccatttgccttgtcaaagcaatatctattggttgtaacattcgtcaaatccagcagtaaaaattttcaggcagcattactttgggcaagaagtgccaaattatttgagaatcttgagattggaaaagaaaccatctattgctgcgctttcgataaaacagcagaacaggctgggatggccggggtatttttgaattatattgaaaattggaatggcaaacagatttacatcaatggccgaatccatagtggcagtatttatgatttgttaggggttttagactgctatcaaaaatcacagtcctgtcccaaccctaaaagccactgttgctttgtttcagacgacatttttctatggcatggatcaagaccaacgtttgaaatcagtcttgatctaactggaaagaaaaaagaaacatcctctgcaaagaaatttgtgatgccttgtattaatttccgtcaccataggattgaaaaagaaacctacttaggaaattggaatgaacaaattgccgcattggcagtaaaacaaaatatagattggtgtccaagttttgatattgagaattttagacagtatgaataattactatctatataggaattgcagcagcgatgtgttatgggtcaaacgtatccaacgccaaatcgacggcagcctactcttgatttctgacaattcaacctatccacccatgcccttggcactggcggaacaccccgatattcaaatcatcgggcaggtagtgcaggtatcaaaagacttgaactagacacaatcaaaaagggaaatagaatgaaaatactcgctttattaattgccgctacctgtgctttatctgcgtgtggcagccaatctgaagaacaaccggcatctgcacaaccccaagagcaggcacaatccgaattaaaaaccatgccggtaagctataccgactatcaatcagcagccaataaagggctgaatgaccaaaaaaccggtctgacccttcctgaacatgttgtccctatcgacaatgcggaaggaaagaatctgctgcatgacttttcagacggcctcacaatcttaaccgttgataccgataaagccgacaaaattactgctgtccgagtagtctggaatacagatgcaatgcctcaaaaagcggaaaaactgtccaaagctgccgcagccttgattgcggcaaccgctccggaagaccgcacaatgctgcgtgataccggcgaccaaatcgaaatggcgattgacagccataatgcgcaaaaagagccaacccgagaatgggcgcgtggtgggattgcttataaagtcactgttaccaatttaccgagcgtggttttgacggcaaaagctgagtaaatctattaagtagaaaaaatagaaagggaaatgatgattgagaaaagtatttctattgtagatggaaaggaatactccgtttttgctgtatcacacgagtttcgttatacctttgatgagcctattttagtcgctgacttgattagttctctaaaagcttatgaaacactgacaagtagttatcttccagcaattttgaatcagctgtttgatgtcaaaatccaaaaaatcaaagtagctgtatctgaaattgaaagaggatctttccttgaaaaactgattttcaatttattcttcaaagatgaagatgcttataatgaattttgtcttaaaatacgaaaatttctaggaacagaaaatcaggacggaagtattaatatgtccaaaatcattatgtttgcaatgactacacttttaggggtaggtgctggttatctcttgtttaaaaacccgccacaagagaagcaggcaataaccaacaacatcgttaccgtcattaatgctgatagttctgtcgcactggatggtgaacatttggtttcagtggtaaaagaagtaacaggaagcagcaagcaaaaaactgcagaaaatgtggcaaaagtatatgctccagcaagtaaaaataatggcagtattacccttgggacagatgatgttcggattgaacctgttgcacaacaaactgtagcaactttgcctaaagatgtggacttacgtgatacgccattgactgaagattacaccgatattgatgtgcaaattcgtgctactgaccgtgataaaaattcagggtggtatgcagtcatagaccaaattgttccatcacgtgttcgattagaactgcctgaagatattgatttgaataggctggctaacaatgctactatccgtgcaaatgtaacagttgagtttgacttaaagcaaaatggctctcgtaagcctaaaaaaatcatcctcacatctctctctactgattaagttttaacccgtattaaaggcttagtcagacggcctttcctacaatccctgtattgatttttaattcaatacagggatttttccatgtcagacaagttcaaccaattcatcaaccgcgtcctctctcacgagggtggttacgccaaccatcccaaagaccccggcggcgaaaccaattggggcatcactaagcgcaccgcacaggcaaacggctacaacggctccatgcgtgccatgacgcgtgaacaggcaatcagcatttaccgtaaagcgttttgggagcgttaccgcgccgaccaaatgccggaagcggtcgcgttccaattttttgatgcctgcgtcaaccacggttacggcaatgccgcccgtatgctgcaacgcgccgcaggcgtaccggacgacggcgttatcggagcagtcagcctcaaagccatcaattcccttcccgaaaacgaccttttattgcggttcaacgccgagcgtctggtcttttataccaagctcggtacgttcacctctttcggcaagggctgggtacgccgtgtggcgcaaaacctgattcacgcgtctgcagataacactgattaaagggagataaaccatgtcaaaaaagtcactcatcgccctaatgaccgcagccatgcagcccgatttcagccacagcgacctaggcattcgctacgccatgccgactcagggatgttggacgcaagcccaccgcaagagcggggtagccgccgcgaaacgcgcagccaaaaaaaagcgtcacaaataaccgcctttttccgatggctgggcggcttggtctctaatccggccacaggaaaaatcagccataccaaactatgggcaaacgtcgccgcagccgccatgacttggaagttcgtgcaggcggcggacgcgcccgaatggctctagtgggcttatggcgcattggtcggcgggtatgcattaatcaaacgcggcatcgcggcgattccgcagttggcagaaatcaaaaaatccgcaaatcaggaaggggggcggcaatgattgaatttgtccgagccaaaaaacggctgctttgggcatttgtgcttttgcttgtgtggacgtgcggttaccgatacgccgccgacaaggccgaagcgaaacaaaccgccctgattgccacctatcggcattcttctatggttgcggcggaacaatatgccttgcagcttaaaaaagcgcaggacgaaaggcagcggtggtacgacttttcccaaaaacaaggaagaaagcccgtgaaaaaacagtatccgccgcaaacgaaaaaagccggctatctgaaaaccaaggaagaactgcttgcggaattggcttgccttaaagcggaaatggttgccctaaaaaagcccgatgccttaatccatgggaaagaagtgcggcagaaagaacgcaactcgtcgcagggttaaggcaatgccatccgttgaactgctgttggagattgtccttctattaccaattggccgtccaatcggcagaagacaaatatgccgatttgaaacggcatatccatgatatttatcgacgacataagggaagatacggctaccggaggattgcggcagccatccgtcacgcaggaacaccggtcaatcacaagaaagtcagccgtctgatggcgaagacggggctgaaggcagtgatacggcggcgcaaataccgctcgttcaaaggagaagtcggcaaaattgcgccgaatatcctgcgacgctgtttccatgcagaaaagccgaatgagaaatgggtaacggacgttaccgagttcaatgtaggcggagaaaagatatacctttctccgattatggatttgtttaacggggaaatcgtcagttaccgtattcaaatccgcccgactttcgatttggccggcgagatactgaaaggtgcgccggagaaaccgggatcgtctgaaaagccgatactgcattcggatcaaggttggcaatatcagatgttttttatcaaaagcagttgaaaggcaacggtctggttcagagtatgtcccgcaagggaaactgcttggacaatgcggcaatggaaagtttcttcggaacgttgaaatcggaatgtttccatacgtgcaaatatgattccgttaccgaatcgtaagcggcactgcacgaatatatccgttactacaacaacgatagaatcaagttgaaattaaaaggactgagccctgttcagtacagaactcagtccctgaaagccgcttgattaaactgtccgactttttggggtcagttcggcttcggcatttttttatccgttttgggggtaacttgtttggaaagctgcaagcttataaataaaggattacatttaagttttgggtaacctttttaaaaaaatgcgtgatgacttttgcatttttaaggcgttttttggggtaattcgtgaaaagttaccccaaaagttaccccataaatggcgaaaactcaagcatacgccagcatcctgcaacacaaaaaagccttgaaactgttgaagttcaaggcttttttgtgttgcaggatgctgctgaaaatagggtatggtggaggcggggggaatcgaacccccgtccgaaagtcctctacaaagcgttctacatacttagttgtgtctatttgaaaatcttatttccatcatgccgaccaacaggccttttggaaaccagttaccttaagtcttatttcctgccaagtaacccggtaggaaaccagtcaatgtaagatgacgttgcggtggctttcgccacacagcccattgaccgactgctgcaacggctagccttaagcggctaaagcgtaagtttcgtcgtttgcgactatttgaattcagtgttttacgggaatctgagaccccggtatgcccgcatctgcttcgcaaccctcgtcgaaaccaaggtcgcccccagaaatggtttgcaaattatacggatattgtgcggtgctgccaagtctgtcggagaaatttgtcagtcttgctgccttaatttgcgtttgagcaggatgcggacgcagccgtcgttgccttcccggggttcggcgtaggcgagtacgtcggggtgttgcatcagccagtttcgggtcatatttttcagaacgggtttgtagcctttggaacctaatccgctgccgtggatgatttcgccgcatacgccgcgtttttgggtgaatgcgatgaattcgttgaggactttttgggcttcttcctgtgtgtagccgtgcaggtcgacatcggtaacgacgggatagtatccgtttttcaggcgttggatgtcgttttttccctgtccgtttttgctgaagctggcgggcgggtcgttgtatgtgctgccgatgtagaagtagttttcttcgtcggcgcggttgtctttgggacggactttgatgggggttttgtcgggcggcgcataatattgctgccggttttttaatggggagagttgtccgactgcttgtgaaaaatcgaaatcctgttcttgtttttgcttgtttttttcggctgcctgtttttctgccgcttctttttgggcttgtttgcccagttgtttgaggatgttttggaagtcggtattcatattttttcctgttatttgtccgatggctgtttcgggcggggttttaatttgccggaatgtttgccaatcgggggaggatgattttgttgcctgcgtatgttttttgaaagtgtgattgtatatcaaaaagaaatgcggcaaccgtcggcagtgttgattgccggaaatgcggaccggtcgaaccgatatgcccgaacgcctgataaagttttaaaaacctgccttgcgaagcaggctgacgtgttttgccaatcttgaattgccggaaacgcgaaacacggaaatctgatgttttatagtggattaacaaaaatcaggacaaggcgacgaagccgcagacagtacagatagtacggaaccgattcacttggtgcttcagcaccttagagaatcgttctctttgagctaaggcgagaacgctgtactggtttttgttaatccactataaatgttccgatacgaactgcaaaatattggttttgtttctgacaggcaaaagcactgtttatttggctgtcaaaaggatggttaaggaaagttatgcgcccctgaagcgggccccagataaggatggttgcgccgacggcttcagacggcattttggcggcggtgttgggttttgtatccggtttgccgttgtgttttgtgatgatgattttgggcgcggtttttctgttttgatgtgtgaaatgccgtctgaaaggcggttcagacggcatagcggtcatttttgtgcggtcaggcggtcgaatatgccgccgtcggcgaagtaggttttcatgatgttgtcccatccgccgaattttttttcgggagagaaggtgtctaagtctgggaagtcggctttgtgtcttgccaatacttcggggttgcgggggcgcaggtagagtgaggcggcgagttcttgcgccggttcgctccaaaggtattcgagataggcgcgggcggttttttgcgtgccttttttcgcgacgacgctgttgacgacggcgacggggctttcggcggaaatggtgtagctcggatagacgatttcaaactgtccttgggtcagttttttgctgacgtagttggcttcgttttcaaaagtgatgagtacgtcgccgatgttgcgttgtgtgaaggtggtggtggcggcgcgtccgccgttttcaaaaacgggggtgtttttgaggatggatgcgacgagtttttgggcttcctgttcgttgccgttggtggttttcagaccgtaaccgtatgcgccgaggaaggcgtagcgtccgttgcccgaggttttgggattggcgatgacgatgttaacgccgtctttggcaaggtcgttccaatcgcggatctgtttggggttgttttttcggacaaggaaaaccatagtgctggtgtagggcgcggcgtggtcggggagggcttgttgccagcctttttctaccagtccttttttttcgagcaggtcgatgtcggaggattggttcatggttacgacatcggcttgaaggccgttggctacggataatgcctgtttgctggagccgccgtgggactgttggatgctgacggatgtgccggggtgttcggattggtatgttttgataaataaggggttgtattctttgtaaaaatcccgtgccacatcgtatgaggcgttgagcagggtaatgttttttccgtcggattcggtattggccggggcattttgtccggacggatggtttgaatcggctgcggggctgcaggcggtgagcagggctgcggtatagagtgccggtgcgtaggttttcatatgcttgtcctgtcggttggtagatggggcaactttatacggctgtctgcgcttgtggaaataatgtttgatttgaagattatcagttttggttataaggacggatcagaggtgtttccgcatcagttcgcatttgattttgatgctggggtcaagctgcaatactgccgaaccgagcgattcgtagcggttgagaaggtaaaacgggacggagttgagcgatgcgtagagtttcagaaagctcaaaccggatttgtgggcgatggtttccgcctgatgaagtagggcagtgcccagtccgaggttgtggaacagggggtggacgtaaagtgcatcgagttgtgcttcttggcagtcgatttggaaaaatccctgtatgttgcctttgtattcggcaacccaaagtgctttgtcgggatcggaaatggtcggcaggtagctttctgtgtttagcaagccttcccatacttttagggcgtgttcgttgtagctgaggatgcaggtgtattggacggagtgcaggtggactttgaagatgtctttgcagtcttgcacggtggcggggcgtaacagtgtcagcaggctcatggcggtatgtcggcggcttcagacggcatctgtgccgttggtcggattatagggactgatgcagtttttttgcttcttgaaatgcggtgtccgaatcggtggttaaaacggtaaagtgtcccattttccgccctttgtgcgcggtttttttgccgtaaaggtgcaggtgtgcattcggatggctttgcaagggcagccaatccggttcgccgccgtcttcctgccaaacgtcgcccaaaatatttgccatacagcaagaactcagtaatttggtatcggcaggcggcaggttgcacataatgcgtacctgctgctggaactggtctgctgcgcaggcatctatcgtatggtgtccggaattgtgcgggcgcggggcgatttcgttgacgaccaattcatgcgtgtcaccgacaacaaacatttctaccgccaatacgccgacataatccaattcgtccgccaagcgttgcgccatctgccgcgcctgttgctgcacgtcggcactcagtcgcgcggggacgatggaataagccaagatgccgttttcgtggatgttttcggcagggtcgaaagtttgcacgttgtcattgttcaaacggcatacgattacggaaatttcactgcgcaaatccaccattttttccaaaacgcaatccacgccgccgtgttcggcaaacgcggctttgagttcatccaatgtttttacgcggatttgacctttgccgtcgtagcccaacgtagccgttttcaggatgccgggcaaaaattgcgcgcttgcttcagtgatgtcttcagccttacaaaccacttgatacggcgcggtttgcaatcccgctttgcgtatccatgccttttcctgaatgcggttttgtgcaatcgccacacaatcgccgctaggggaaacattggtatgttttgccaaaaagcgcatcgcatcggcattgacgttttcaaattcagtggtcaccgccgcgcattttgccaattcgtccaaagcagcttggtcgttaaacggcgcgcacaaatggcggtcggcaaattctgctgccggcgcgtccggatcggggtcgagaacggttactttgtagcccatggttttggcggcaacggtaaacattctgcctaattgtccgccgccgaggatgccaagcatggcgggcggagaaagagatatgtttttcatgctgactcttcaaattgtacaagttgatagctataactaattcttgacggatgtcttgtatcgctggaattaccagtttcagaaatacagaatactttttccataaatttttctgcttttagaaattccagtattctgtttttttcatccttataagcaccgcggtctgtaccccatgcaagaataatcatatcagcatcttccaaacatcctttaaatttggaaaaatcggtttgggtgtttgccctaattcctgtttgctgtgtagagtaactggaaaaaatatttaacattttgaagttggtaaaaccgtacatatccaagaaacgtgcaagttgggtaagggttttgtcgcttctttcatcatttgctttacttggattaattcctatagcgacagctgagaaatttttaggattttctgtgttgccgctccatctaaccgttaggatttctcgatttttttcattatctgtatagagaccgtctttggtagtcggtctgagtgtttggcgaagctcataaagtttttcataagtcatttatccaacccttcctgtaccatttgcgcggcgtgtatgacggctcgggctttgttttgtgtttcctgccattcggaggccggatcggagtcggcaaccacgcccgcgccgctttggacgtatagcgtgttgttttttactacggcggtgcggatggcgattgccaaatccatgtcgttgttgaaaccccatacgccgacggcaccgccgtagatgccgcgtttgctcggttcgacttcttcgatgatttccatggcgcggactttgggtgcgccggagagtgtgccggcagggaaggtagcggcgaggatgtccatgttggtcatgccgtctttcagacggccttcgacgttggaaacgatgtgcattacatgggagtatttttcaatcaccattttgtcggtaactttgacttcgccggttttactgatgcggccgacgtcgttgcgtcctaagtcaatcaacatgacgtgttcggcgatttctttggcatcgcttaacaaatcttgttcgttggcaaggtcttcggcgggggttttgccgcgcaggcgcgtgccggcgatggggcggacgataacgtcgttgcgttcgcgtcggacgaggatttcgggcgaggagccgacgatgtggaaatcgccgaaatcgtagtaaaagagataaggcgaagggttgagcgtacgcagggcgcggtagagggcgagcgggctgtcggtgaattccatgctcatgcgctggctggggacaacctgcatgcagtcgcctgcgaagatgtagtctttgattttgttaacgcaggctttgaacggctcttcgccgaattcgctgacggcttcggtgtgtttgctgccgagcgagagcgggatggcgcagctttggcgcaactgggtgcggatgtcttcgaggcgttcgcgggcgcgttcgtagccgtcgggctgcgacggatcggcgtaaacgacgagatggattttgccgctcaaattgtcgatcaccgccaattcttgcgacagcatcagcaagatgtcgggcgtgccgagcgggtcggctttggtggtgtttttcaggcggtgggcgaagtgttcaaaattgtagatggtttcgtaaccgaagtagccgaccagtccgccggtaaagcgcggcaggcttgggatttcgggtgttttgaagcggttgtggaaggcttcgataaagggcagggggttgccgtcgtgttgctcgacaatttcgccgttttgataaacatcgacgtgtttgccgctggctttgagatagtggctgcaaggcaggccgataaaagaatagcggccgaaacgttcgccaccgacaacggattcgagcaggtaggtataggggcggttggcgagtttgagatagagggaaagcggcgtatccaaatcggcaaggagttcttgcacgagcgggatgcggttgtagccttgggcggcttgggcttggtattcttgtttgctgatcatttctgctttcccaaagggcggtttcggacggcgcggcaacgggcgcgagtatagcattttatcggaattgttgacagtctgaccggagatgcccttggattcggatttcaagtgcaacactagtgtattagtggttggaacagattcaagaataaaacacttggcgtttcgtagccaagtgtttttcttggtcggtggttcaactcatcttgaaccctgcgtatctcccgatcactgatgttacggaaatcggtttgtttggggaagtattgccggatgagtccgttggtgttctcattcagccctttctcccaagaatggtaagggcgacaaaaataagtctccgctttcaatgctttggttattttggtgtgttggtagaactctttgccgttatccatggtgatggtgtgcaccctgtctttatgtgcctttaatgccctaacagctgcccgggcagtgtcttcggctttgaggctatccaatttgcagatgatggtgtagcgggtaacgcgttcgaccaaggtcaataatgcgcttttctgtcctttgccgacaatggtgtcggcttcccaatcgccgatacgggatttctggtcgacgatagcgggtcggttttctatgccgacacggttgggtactttgcctctggtccatgtgctgccgtagcgtttgcggtagggtttgctgcatattctgagatgttgccacaacgtgctgccgttgcttttgtcttggcgaaggtagcggtaaatggtgctgtggtggagcgtgatctggtggtgtttgcacaggtaggcgcatacttgttcgggactgagtttgcggcggataagggggtcgatgtgctgaatcagctgcgaatcgagcttatagggttgtcgcttacgctgtttgatagtctggctttgccgctgggctttttcggcgctgtattgctgcccttgggtgcggtgccgtctgatttcgcggctgatggtgcttttgtggcggttcagctgtttggcgatttcggtaacggtgcagtggcgggacaggtattggatgtggtatcgttcgccttgggtcagttgcgtgtagctcatggcaatctttcttgcaggaaaggccgtatgctaccgcatactggcctttttctgttagggaaagttgcacttcaaatgcgaatccgccgccgtctgaaacgccaaacgggcttcagacggcatttttgacggcggaggtctatgagccgcaggttttcggcttgttcgccagaatattgatgactttgcgttcggctttttgcggctcgattttgatttcgctctcgtcttcttcgctgccgtctgaaaaacgttcgggcattttttcgctgtcaaacgccaaatcgccgccgtgtttcaggctttgaccgcgttccaatccgacaaagtcgaagagttcggtatcggcaaggtgggaagggacgacgttttgcagggcggagaacatcgattcgatgcggccggggaagcgtttgtcccaatcgcgcagcatatcgccgatgacttggcgttgcaggttgggttgcgagccgcagaggttgcacgggatgatggggaattgttttaattcggcgtatttgattaagtctttttctttcacatacgccagcgggcggatgacgatgtgttcgccgttgtcgctcaccagcttgggcggcatggctttgagtttgccgccgtaaaacatatttaaaaacaaggtggcgaggatgtcgtcgcggtggtgtcccaaggcgattttggtgcagcccaattcttttgcagtgcggtagaggatgccgcggcgcaggcggctgcacagcgaacaagtcgttttgccttcgtctaatacgcgtttgacggtggagtaggtgtcttcttcaacgattttgtagggaacgccgatgctttcgagataggtcggcaatacttcttcggggaagcccggctgcttttggtcgagattgacggcaaccagttggaaatcaatcggcgcgctggcttggagctggcgcaggatgtctaacagggcatagctgtctttgccgccggagaggcagaccatgattttgtcgtccggctcgatcatattgaaatcgttaatcgcgtcgccgacggcgtggcgcaggcgtttgctgagtttgttgttttcgagttcttgtttggtttttttggacatggcggtttgggtttgaaaattagaaaggcggcattgtaaccgattggcggggcggcaatgccgtctgaagggcttcagacggcatcggcggcttattctgcattttcggttttaaagaagagatgaaccgctttgaagataccgccgtttgggacggtcagtgttttttgtgcggcggagaatttaatcacggtaagggcggtaaagttttccgaatcttgaacgctgtcgagtacgatgccggcctcttcgccgtccgccgtcagcagggttcctgcttcgacggccgaatttcccgacaataccgccaagccgcgtttgacctgcccccgatactgggcacgggcaatgatttcctgtcccggatagcagccttttttgaagtgtacgccgccgatgatgtgctggttgagcatttgggcgacggcggtttctttggtagccgcgcatatccacggataaccgctacggatttcgtgcagccgccacgcgttttcggcggcggcatcataaggcggcaaggcgtttttgggggcgatgtgcaaaatgccccgatgtggcaggacgacggaacagatgccgtctgaaccgcattcggcggtaaaggcgaggctgggttcttgcgcggcaagcggttcggcggatgcttctaattccgcgccgacggcgtaatcttcaaggatttcaaaaacggctttggcgcgtaacacaaacatccgcaaacgtttgaccgttgcttcaagcaggtcttgcgccataatcagcagcaaatcgccgcctcggttgacgacaatcatattggcgatgacgcggcctttgggcgtgttgtaagtcgcataacacgcctgcccggtctgaaggtggttgatgtcgttggaaagctgtccgtgcaggaaggtttggcggtcttcgccgctgacgcgcaccacgccgaaaaagggcagtaaggttttcatcatttgcgtactctgaaatataaaggaaatctgtttatgcagttgccgcgtctctcttcacggcggttattttgatttcgacgcgccactccggacgggcgagccgtgcttccacgcaggcgcgggcgggcgttctgccggcggcaacccaagcgtcccacacgccgttcatttccgcatagtcgcccatatcgcgcagatagatgaccgcatccaaaacgtgcgctttgtccgagccgcattccgccagccagcggtcgatttgggcaagcacgtcggcagtctgttcggcagccgtttcaccgttttcgggaaccatgccggagaggaaaatcaagccgtttgcgccgacggcttcggaatagcggggcgttgtgccgaaatatcggatatccatatcggtttccttcgataaaggggatatatggtaacattgcgcttgaccgatttccatgttttgcatgacgaaaaatgagtaaacacacttatccgataacacctgccgtgcgcgttttgcgtgaaaacggcatcgaatttgaaccttttacctatgcctatgaggaacacggcggcacggcgcagtttgcccgactattcggcaaagacgaacacttggtcattaaaaccattgttttgcaagatgaaaacggtaaggggctgattgtcttgatgcacggcgacaagcagatttcaacccgcaatctggcgcggcatttgggtgcgaaacacatcgaacccgccacgcccgtacaggcaaacaagtggacgggctatctggtcggcggcacaacgccgttcggcatccggacaaagttggatatttacgtcgaacagtcggtgatggatttggaaaccatctatatcaacggcggaaaacgcgggttcattatcggcatccgtcccggagatttaaatattttgaacccgaaaacaatacaggcggcggtttgacgggaaagtataaaggaacaatatggacaaagatttgtatgccgtattgggcgtgtcgccgcaggcgggagcggacgaaatcaaacgcgcctaccgcaagctggcgatgaaatatcatcccgaccgcaatccgggcaatccgaaggcggaagaaaagttcaaagaaatccaacgggcttacgatacgctttccgacctgtcgaaacggatgcaatacgacgcgtccttcagacggcatgaggaacgcgggcggcaggaagaggcattccgccgcgaacaggcgcgcagggagcagttttaccgcgaacagatgcgccgcgaacaggcgttcagacaggcgtttgaacggcaggcatcacgttcgtgccatacttacgaaccgtccggcggcggaagcgggcgcaactatgtcctcgccgcctacatcctgttcggtttgggtgcaatcatgctgttcatgcccatagtcggcgtgattttcgcctatatgcccatagtcggcgtgattctcgcctatatgaaacggaacagtttggacagcattgtctatgccgcacataccgaatacctgattaaaaccttttggcgcacattttggctttatattttgggtgcgctgactgcccttttgggtatcggcgtgctgattattattgcaacgaacgtctggtatttctaccgcatcatcgccggctttatccgcttcaacggcggcagggcggttgcacccgagaaatggatatagtatggcttacctgttaatcagcatcgtgttcagcgtgtcggtttccattttgctgaaaatggcaaggaagaaaaaaatcgacatcgcgcaggcggtcgccgtcaattatgtggtcgcggtcatactgaccctgctggtattgaagccggatatcggcaatatcggcgcatttttgccgacgtggccgctgtttgccgctttgggcgtgctgctgccgtccgtattcgtgataatgggcaaatctgtggaagccgccggtatcgtcaaatccgacgcggcgcagcgtttgtcgctgtttttgccgattgttgccgccttgacgctgtttggcgaaaaactcagcgaaggcaaactaatcgggctgtgcctcgcatttgccgcactgttctgcctgctttggaaacacagcggtggcaaaaaatcaggaagcgcgtggcggcaggcggcattgctgctgggcgtgtgggcaggttacggcattatcgatatcctgttcaaacagcttgccaaaagcggaacggcatttgcgggcaacctgctggttgcatttgtgctggcgggtgtgctgatgtttgcctgcctgtttgccaaatcggtcagatggcgtgttgagagtgtggtcggcggcatattcttgggcggtttgaattttatgaatatcgtaacctacatcaccgcgcaccaaatgatgaaggataatccgaccttggtttttgccggtatgaatatcggcgtgattgttttgggtacgctttcgggcgcattgttctttaaggaaaaaatcaacacaatcaatacggcgggaatcgtgttggcactgtgttctatcgcctgcctgttttattggggggaagtcaaggtactgttcggcatataatccggctgattgatataacaaaatgccgtctgaagcagcatccctgcttcagacggcatttgtctgcaacgttacagatgggggttcatcaggttctcgggagagaggatgcggttgagttcttcttcgctcaacagcccgcgttccaagacaacctcgcgcacgcctttgccggtttgggcgcagattttgccgaccaaatcgccgttgtggtgtccgatatacggattcagataagtcaccaaaccgatggagttgaaaacgtaacgttcgcagatttcgcggttgaccgtaatgcctttgacgcatttgtcggacaggttgactgcggcattgcccaagagggaaatggtttcaaacatacattgggcgatgaccggctccatcacgtttaattgcagttgcccggcttcggcggcgaaggtaatcgtcgtgtcgttgccgatgactttgaagcagacttggttgaccacttcgggaatcacgggattgactttggcgggcattatggaagaaccggcctgcaattcgggcaggttgatttctttcaagccggcacgcgggccggaagagagcaggcgcaagtcgttgcagattttggagagtttgaccgccgtgcgcttcaatgcgccgtgtaccatcacatatgcgccgcagtcggaggtcgcctcaatcaggttttcggtcagtttgcaaggcaagccgctgacttcggagagttttttgaccaccagttcggcgtagcctttgggcgtgttcacgcccgtgccgattgccgttgcgcccaaattgacttccaacagcagttggcgggtgcggtcgaggttgaggatttcttcttccaacaacacttggaaagattggaattcttggccggcagtcatcggcacggcatcttgaagctgggtgcggcccattttcaaaacgtctttaaattcttcggctttggcggcaaaggcgtttttcaggacagtcagtttgtcgagcaattcgccgatgctgtaatacacggcaaggcggaagcccgtgggataggcatcgttggtcgattggctggcattgacgtgatccatcggattgacgatgtcgtagcggcctttttcgtatcccaagacttccaatgcgaggttggcgatgacttcgttggtgttcatattgaccgaagtacccgcaccgccctgatacacgtcggacgggaattggtcgaggcagcggttgttcagcagaacttcgtcgcaggctttttcaatggcggcggcgatttcgggcttgaccgcgcccaactcaccgtttgcctgtgccgtcgcctttttcaccatcaccatactgcggacaaactgcggcacgtcagaaattttttgtgtggagattttaaagttttcaatggcgcgcagggtgtggatgccccaatacacttcggcgggaatctcgcggtcgcccaataaatcgtgttcgatacggacagtcatgtttttacctttgtaagtcggataattaatattgaaaaaatgcgccatcggaaagatgccgccgcaggatgaacactataccggccggatgaaattgtccatatcgtatgccgtctgaaaacgggaaacgttgttttcgggtgttatagtggattaacaaaaatcaggacaaggcgacgaagccgcagacagtacaaatagtacggaaccgattcacttggtgcttcagcaccttagagaatcgttctctttgagctaaggcgagccaacgccgtactggtttttgttaatccactatactttccggactttccggcaagccctgcctgccgctgaaatatctttcggcggattgtgctccgccatatcggcttaccgttggcggggcggtttgatgaagacggcacaaatgccgtttgaaggacgttcagacggcatttgtgctgattcgcatcaagatttattgtttggctgcctcgatttggatgtcgatgcggacgcttttggtcataccaacgttaacgaggtagtccatgccccatttggtgcggtcgatggtggtgctgaagtcgccgccacaaacttcggttttctccatcgggctttggtagcagttgaatttttcggctttgagtttgacgggggcggttttgccgtgcatggtcaggttgccgtcaacggaaaccagttttttgccgttgaagttgaatttggtggaaacaaagcggatgtccggatattgggcggcatcgaagatgtcggctgatttcaggtggtcggtaaagtgttgcgaaccgctttgcaggttggcaatggggatggtgatgtcgattttaccgtcgcgttttgcttggtcgaactcgacggaaccggtcagaccgtaaaaaccgccgacgttggtgctggtgttgaaatggtcgatggcgaaacgggcgttggcgtgatattcgtccactttgtaggtggcggcggaggcagtactgatggcggcggctgcgagtgcggcgaagatgatttttttcatgatgataatcctttgtgtgggccggtaaaggcgtttatcctaacataggcagggatttatggcatttcctgccggtaaacggtgggtttgcaggcggttgacgaacggggcgggcggaaaagggcggatgaaaaagcgcggtgtgatccgcgctttgtttttttacaaggcggcgagtaccgcatcgcccatttcggagcaggaaacgagttttgtgccttcttcgtaaatgtcgctggtacgcaagccttgttgcagcactttttggacggcgttttcaacttgttgcgcgcgcgcttcgtcgttcaggctgtaacgcagcaacattgcgagcgagaggatggtggccagcgggttggctttgttttgtccggcgatgtcgggggcggagccgtgagacggttcgtacaggcctttgccgttttcgtccagcgaggcggaaggcagcataccgatggagccggtcagcatggaggcttcgtcggagagaatgtcgccgaagatgttgccggtggcaatgacgtcgaattgtttgggcgcacgcacgagctgcatggcggcgttgtcgacgtacatatgggaaagctcgacatcagggtactctttgccgatttcttcaaagatttcgcgccacaattcggtggtttccaaaacgttggctttgcctacggaacagacttttttgctgcgtttttgggcggattggaaggcaacatgggcaatacggcggatttcgctttcgctgtatttcatggtgttgtagccttcgcgttcgccgttttccagaacgcggatgccgcgcggttcgccgaaatagatgtcgccggtgagttcgcgcacaatcaaaatatccaaaccggcaacgatttcaggcttcagcgtggaggcgttggctaattcgggatataaaacagcaggacgcaaattggcaaacaggttcaaatccttacggattgccaacaggccgcgctcagggcgcaacggacggtcgaggttgtcgtattgaggagaaccgactgcaccaagcaggacggcatcggctttgcggcagaggttttgcgtaaattcgggataaggatgaccgtattcgtcataggcttcgccgcccaatggggcgtattcgtagccggcatccaaaccttgggcgatgagtttgtcgagtacgcggacggtttcggcgacgatttcgggaccgatgccgtcacctcggaggatggcgatatgtttggtcatttcaagtttccttatgggttgatggttgaagggttatttctttttgtatttgtgtgcaatttcgtgccaacgaggtatggaaatcgatcggttgtagtgttttttataggcttcctcaaatttctttttccataaggatgcgttatgccgtgttgccgggttttgataaacggtttcttcaattgcggaaacaaaatcttccaagcattcaaacataggcatattctttttatttatgctgtaccaaacacccgggcggattttatgcaccacgccttttttgacttgaagattaattgcccacccatccatgcttctcgtaatttgccatacttttttaagccataaatccttgatggttacattgccgttgtcgtccatatcgtaaccgaatattaaatagtctacatccagcatatagggtttatgaatgatttcatcagaatacattttaaaatctgcaatatcaaaacccggactggcatttcggttgaacgcctttacttccaacaattctctactgcggtcttttttatttaaaaagaaatcggggggcatttgggtattggttgaaacatcaaattcaatttccctttttctcaaccatccgccgagccattcctgaatgatgttgccgacgacatctttttgtttgacgataatatccacatcgcccaagaaaaatctaatttgaccattgaccgataagattttttcctcattcagcaacttatcaaatatttgttgtgcagtaagttttaccattttatccctatcggtttataaagtatgcagaagcctttcagataccgccttaatcacaggaacggcaacggtattgcccaataaatcgtatttgtcttttttaggaatatcaaacgaataatcgtccggatagccgaataagcgtaaaccttcttttccggtaagtgtgcgcaaaccgccgttgtcaacgacgaaaaggtgctccatatccattgcaactaaggttggcgcaacatcatttgggtctaatattttattgatttcaaatgatttttttcctgaaacaatattgtagcctttgggcagggattcatctttgattcttcgcccgccaattttttgtttcggatgctccaaaaccaaatagcctttatctgtcaggctgtccaaaatattttgaagattggggtgtttatagaaagttgaaatttgcgcttttgtcaaaggcatcccatccatccaatcgatgccgatttctgaagcccattttttcttcctccgttcttttagaagcatatttaataattgcttctcttcttcggttactgtgccttttaattcaatatcccaactgtggatattgtttttccctccccgtttgtcctttactgattttccgtacagttcggacgggggaaatttctttagcaattttttgatgaaaggactgctttcggtaggcagtcccgattccaaaatattttttaatttcggacttagggttgtttcaaaagataagtcgggtttggatttcaaactgcctgtcagataaatacgcttcctgttttggggaatgccgaaatcttttgcatttaaaactttccaagaaacatagtagcccaatgtttccaaggtttccaaaataacggtcagggtgcgtcctattttttgtgtcggatcttttctatcgtgcgtcaccaatccttccacattttccaaaataaaaccttttggtttttttgcctttaaaatccttgccacatcaaagaaaagcgttccccgcgtatcttcaaagcccaatctttttccggcgaaagaaaaagcctggcaagggaagcctgccaacaagatgtcaaaatcgggaatatctcccgtttcaattttcgttatatctccatacggcacttcatcagggtagttttgcttcaatacttccaaagctgccggtttgatttctgaggtaaaaacacattcgcaagcaaccgactgtttccgacaggcttgttcaaatcctttcctgataccgctcatcccggaaaataagtcaataaatttaatttgttgcatattaaaaatctaaaaatttatttgaaatggagagttgcattattgcattaatttagagtgtcgctaagcccgcttaaaagatgaaagcaatttatcgcccctctgtttacattagccgcaacaattatatgttatcaggaatgccgtctgaacggccttcagacggtataggttttaaccgttaaacagccaaggctggctttggcggcgtttttcttcaaaggcgtgaatttcgtcggcgtgttgcagggtcagaccgatttcgtccaagccgtttaagaggcagtgtttgcggtgttcggtaatgtcaaatgtgaacgtttcgccgcttggtgtggtcagggtttgttcggcaaggtcgatggagagctgatagccttcgttggcttcaacttctttgaaaagtcggtcaacccgttcttcggtcaacacgataggtaaaaggccgtttttgtagcagttgttaaagaagatgtcggcgaagctgggggcgatgacggcgcggaagccgtagtcgtccaatgcccaaggggcgtgttcgcgtgaagagccgcaaccgaagtttttacgcgtcaacaggatttgcgcgccttggtaacgcggctggttcagcgagaaatcagggttcaacgggcgtttgctgttgtccatgcctggttcgccgtggtcgaggtaacgccattcgtcaaaggcattggggccgaagccgctgcgtttgatggattttaaaaattgtttggggatgatggcgtcggtatcgacgttgctgcggtcgagcggggcgacgatggcggtaattttggtaaaggctttcatgggtttgcgtcttgtgctgacgatgccgtctgaagcggtttcagacggcatcgcgaatcggttattcggtggcgttttcgatttttccgccgagatgggaaatgccgcgtccgacggcattgccgccttttttgacggcttctttggttttgtcccagcctttttcgacggcgttgcctgtttgttcggcggcgcgttcggcggcggcctgtgttttgtcaaggttgcgggcggtgtcttgtttcgcgccctcccaagtgccggcgcaggcggacaaggcgagggcggacagggcggtaatgaaaagtttgttcatggttaaactccttggtttgaatattaaaggtgtttctgccttacgggacatatttcagacggccgcgtcaaattcttaaagaccgcctgaaaatacttacgccatcatgcggatgtcggtaaagcggccggtaacggcggcggctgctgccatagcggggctgacgaggtgggtacgtccgccgttgccttgacggccttcaaagttacggttggaggtggaggcgcagcgttgccccggggtcaggcggtcggcgttcatggcgagacacatcgaacagcccggttcgcgccattcaaaaccggcttcgatgaaaattttgtccaagccttctttttcggcttgttctttaaccaaaccggagccggggacgattaacacgcgctgtacgttggcggcttttttgcggtctttggcgatggcggcggcttcgcgcaagtcttcgatgcggctgttggtgcaagagccgatgaatacgatgtcgacggggatttcgtttaatggcgtaccggcttccaagcccatgtattcaagggcgcgttccataccgctgcgtttgaccggatcggtttcttcggcaggattcggcactttgctgctgatgtctaaaaccatttcaggcgaggtaccccaagtgacttgcggttcgatgtcttcggcgttgaaacggtattctttgtcgaataccgcaccttcgtcagacaccagcgtacgccagtactcgacggctttgtcccacgcttcgccttcgggtgcgaagggtttatcttttacgtagtcgatggtggtttggtcgacggcaaccatgcctgagcgcgcgcctgcctcaatcgccatattgcataaagtcatgcggctttccatagaaaggctgcggatggcttcgccgccaaactcgatggcgtagcctgtaccgcctgccgtgccgatttgcccgatgatgtagagcgccacgtctttggcggtaacgcccgcttttaatttgccgtcaacggaaatcagcatggatttggattttttcgcggtaatacattgggtcgccatggtgtgctcgacttcggaagtgccgatgccgtgcgccagtgcgccgaatgcgccgtgggtggaagtgtgcgagtcgccgcagacgacggtcataccgggcagggtcgcgccttgttcggggcccataacgtgtacgatgccctgacctttgtccataaacggaaaataggcgagtgcgccaaactctttaatgtttttgtccaaagtatcgacttgcagcttggaaatcgggtcttggatgcctttgtcccaatcgccggtcggggtgttgtggtcggcggtggagacgacgctgtcgatgcgccacagcttgcgccccgccattttcaagccttcaaatgcctgagggctggtaacttcgtgcaccaaatggcggtcgatgtagagcaggacggtgccgtcttcttcttcgcggacgacgtggctgttccaaagtttgtcgtagagggtttgtgctgtcatgatgttgttcttttggataaatggtaatgcggattgggcggattttagacgtattctttataccgcgcaacagattttgtctaatttttgagtcggtgttattttgtaaacaattttaacaaaaaaattagacatattgtccatttcagtaagcagttatatctaaagcatgattcgatacgaaagaatacttgtcgtcattctttcaaaggcattatcatctgcatcttgtcaaaaaacacacagaggtagacgaaagatgaaattaccggtgatgtcgcccgaacattcggcgcaacttcaggcgtttgaggcaaaaatcctgtccaatcacgccaaaatcgaggcgtggttccgcacgcagtggagcgtacaccgcccgccgttttacggttcggtcgatatacgcaatgccggttacaaaatttcgtctatcgatatgaatttgttccccggcggcttcaataatctgaatcccaactttatcccgctggcggcggttgccgcgcaagatgcggtgcaacgcgcctgcgaaacggcgaaatccgtattgattattcctgaaaaccacacgcgcaatacgttttacctgcaaaacgtttacgccctcggcgagattttgcgttcggcagggtatgaagtgcgcttgggcagcctgaatccggaagtaaccgaaccgaccgaatttgaaaccgcattgggcgacaaaatcctgttggaacctttattgcgtacccgcgatcgcgtccatcttgcagacggcttttcgccttgcgtggttttgttgaacaacgatttgtccgccggcattcccgacatcctcaaaggcatcagccaaaccgttttgccgccgttgcacggcggttggacgacgcgccgcaaaacaaatcatttcggcgcgtacaaccaagttaccgccgaatttgccaagttaatcggcatcgacgaatggcaaattaacccttattttgaaaaaatcggcggtttggacttccaagggcgtgaaggcgaagacgcgttggcggaagcggtagaacgtgtgctggcgaaaattcaagccaaatacgacgaatcgggcattaccgacaaacctttcgtcatcgtcaaagccgatgccggcacttacggcatgggcgtgatgagcgtcaaatccgccgacgaagtgcgcggattgaaccgtaaaaaccgcaataaaatggcgaaagtcaaagaaggcttggaagtcagcgaagtgattgtccaagaagggatttatacttatgaaaccttaaacggcgcggtgtgcgaacccgtcgtgtatatgatggaccgcttcgtcatcggcggctttttccgcgtacacgaagggcgcggtgcggacgaaaacctaaacgccggcggtatggtgtttgttccgctgtctaacagcattcctaccggtaacggcgataattcccaagaagcgcccgaagcctgcaagcgcgtattcgaacaatgggactcgctgggtatgccgcgctctgaaaaagactgcgacgtggacaacgaacacaaccgcctctacgtttacggcgtaatggcacgcctgtcgcttctggcggcttcaatcgagttggaagaaacggcgtaagactgttttgaaatacagatgccgtctgaagcggaaatccggttcagacggcatttcggatatttggcgtgtgggaacatctgtttcagacggcatctcagactatttaaaaaagggaaaacatgagcatcaagcaatggccggaaggcgaaagacccagggaaaagctgttggaacgcggggcggcggcgttgagtgatgccgaacttttggcaatcctgctgcgcgtcggcacgcgcggaatgagtgcggtcgatttggcgcgttatttgctgcaggagttcggcagtttggggaggctgatgagcgcggaggtcggcaaactgtcggcatacaaagggatggggacggcaagtttcacacagtttgccgtggtcagggaaatcgggcggcggatattggcggaagaattgcaggagagcatcgtcctgtccgatccggatacggtggccgattatttacgctttcatttggggcaggaaaaagtcgaagtcagcgtcgcgctgctgctgaaccgccaaaaccaactgattgcggtcagagagctgtcgcgcggtacggttgcggaaaacacgatttacatccgcgaaatcgtcaaactggcattggacgaatatgccgacagcctgattattgcgcacaaccatccgggcggctcgcccgaaccttcgcaggaagacatcatgttcacaaggcggctggcacaggcaatgtcgctggtcgatgtgtcgctgctcgaccattttatcgttacctcgcaaagcgtctgttcgttcagacagctcgggttgatgccctgacactctgttttacatgcggcggctctgataaaatagccgcttcaaccgtattcaacagatattgttaagttaatggaaacacaaaacaaacctaccgttaccgacattgaccgccctatactcgtcccgcccggtggacataaaaaagtcttgctgcattcctgctgcgccccgtgcagcggcgaagtgatggaagccatgctggccagcggcatcgactacaccatttatttttacaatcccaatatccatccgcacaaagagtatatgctccgaaaagaggaaaacgtgcgctttgcggaaaagttcggcattcctttcatcgataaagacgacgactacgaaaacgaccgcaaagaatggtttgccaaagccaaaggcatggagtttgagccggaacgcggcatccgctgcaccatgtgtttcgatatgcgttttgaaaaggcggcgcaatacgcgcatgaacacgggttccccgtctttaccagttcgctgggcatttcacgctggaaaaatatggcgcaaatcaacgactgcggacaccgcgccgccgcgccttacgatgatgtggtgtattgggatttcaactggcgcaaaggcggcggcagcgcgcgcatgattgaaatcagcaaacgtgaaaacttctaccagcaggaatattgcggttgtgcctattccctgagggattccaatgcccaccgcaaatcacagggcagaatccccatcaaactcggcgtgctgtattacggcgacgaatcgacacaatacgaacctgcccccatccgggtggacaaataaacacccgatgccgtctgaaggttcagacggcatcgggttcggcatcggcacggggaaaggtttgccggtttggcaatctgcaatcggaaaccgcattggcaagtttgccgttttgataaaacaccccgttgccgcgtcgggaggacggcattatgaaatccctttttattcggctgctcctgttgggttcggcggcaggcgttttctaccatacccaaaaccaatccctgcccgcgggcgaacttgtctatccgtccgcaccgcaaatcagggacggcggcgatgcgctgcactacctcaaccgcatccgagcccaaatcggtttgcacaagctggcacacgcgccggttttggaaaactccgcccgcaggcacgcaagctacctcacgctcaatcccgaagacggacacggcgaacaccatcccgacaatccgcactacaccgcacaaaagctgaccgaacgcacacgccttgccgggtatctctacaacggcgtgcatgaaaacatcagcacggaagaagaagccgccgaatcgtccgacagcgacatccgcacgcagcaacgccaagtggacggattaatgagcgcaatctaccaccgcctttccctacttgaccgccatacggatgaggcaggagcggcatttgtgcgcgaaaacggtaaaaccgttctcgtattcaatcagggcaacggcaggtttgagcggcattgcgcccaaggcagaaatcagccggaagcaggacggaaatattaccgcaacgcctgccataacggtgcggtcgtgtacaccgacgaagccatgcccgcacaggagctgctctatacagcctatcccgtcggcagcggcgcactgccttatttccacggcgagcgtccagaccccgtgccggaatatgaaatcacgggcaatcctgccagcattgatttttccgaggcggcaggcaaaattacgatgaaaagtttcaagctgtatcagggtaaaaacgaaatccgccccgtcagggttttaaccgccggcaacgaccccaacggcaggctgaccgcgtaccaattcgcgctttttccgctcaagcctttggaatacggcacgctttatacggcggtattcgactatgtccgcaacggacggcgagcgcaggcgaaatggcagtttagaacccgaaaacccgattacccttattttgaggtaaacggcggcgagacacttgcggttagaaaaggcgaaaaatatttcatccactggcgcggacgctggtgtttggaagcgtgtacccgttatacctaccggcagcgacccggcagccgcctgtccataggaaggcacgaggcgggcggcatcgtcttcagcgttgacggaatggcgggcagccgcatcacgcttgcaccggaaggagaaacggaacgaggcgtaaccctttatttacaggattgaatacatgacaggcagaacaggcggcaacggcagtacccaagcgcaacccgaacgcgtcatgctggtgggcgtaatgttggacaaagatggtacgggcagtagtgccgcccgtctgaacggttttcagacggcattggcggaagctgtcgagctggtcaaagcggcgggcggcgattccgtgcgcgtggagactgccaaacgcgaccgtccgcacaccgcgctgtttgtcggcacgggcaaggcggcggagctgtcagaagcagttgccgcagacggcatcgatttggtcgtattcaaccacgaactcacgcccacgcaggaacgcaaccttgaaaaagaactgaaatgccgcgtattggacagggtagggctgattctggcgattttcgctcgccgcgcccgcacgcaggaaggcaggctgcaagtcgagttggcgcaattgagccatttggcgggacgcttgatacgcggttacggccatctgcagagccagcgcggcggtatcggcatgaaaggccccggcgaaaccaaactggaaaccgaccgccgattgatcgcccatcggatcaatgccttgaaaaaacagcttgccaacctcaaaaaacagcgcgccctgcgccgcaagtcccgcgaatcgggcacaatcaaaacgtttgcgctggtcggctataccaatgtcggcaaatccagcctgttcaaccggctgaccaagtcgggcatatatgcgaaagaccagcttttcgccacactcgacacgacggcgcggcggctgtacatcagtcccgaatgcagcattatcctgaccgataccgtcggattcgtcagcgatctgccgcacaaactgatttccgccttttccgccacgctggaagaaaccgcgcaagccgatgtgctgctgcacgtcgtcgatgccgccgctccgaacagcggacagcagattgaagacgtggaaaacgtactgcaagaaatccatgccggcgatattccgtgcatcaaggtgtacaacaaaaccgacctgctgccgtctgaagaacaaaacacgggcatatggcgcgacgctgcgggaaaaattgccgccgtccgcatttccgttgctgaaaataccggtatagacgcactgcgcgaagccattgccgagtcttgtgccgccgcaccaaacacagacgaaaccgaaatgccatgaaaaaaacctgtttccactgcggtctggatgttcccgaacacctccacctgactgtccgttacgaaaacgaagaccgcgaaacctgctgcgccggctgtcaggcggtcgcacaaagcattattgacgcgggcttgggcagttattacaaacaacgcaccgccgacgcgcaaaaaaccgagctgccgccccaagaaatcctcgaccaaatccgcctgtacgacctgcccgaagtccagtccgactttgtggaaacccacggcggcacgcgcgaggcggttttaatgctcggcggcatcacctgcgccgcctgcgtctggctgatcgaacagcagcttttgcgtacagacggcatcgtccgcatcgacctcaattacagcacgcaccgctgccgcgtcgtctgggacgacggcaaaatccgcctttccgacattctgttgaaaatcaggcagataggctacaccgccgcaccctatgacgcgcaaaaaatcgaagccgccaaccaaaaagaacgcaaacaatacatcgtccgcctcgccgttgccgggctggggatgatgcagacgatgatgttcgcgctgccgacctacctttacggcggcgacatcgaacccgatttcctgcaaatcctccattggggcggctttttaatggtgctgcccgtcgtattctattgcgccgtcccgttttatcaaggcgcgctgcgcgacttgaaaaaccgccgcgtcggcatggatacgccgattaccgtcgccatcatcatgacctttatcgccggcgtttacagccttgcgacaaatgcggggcaggggatgtatttcgaatccatcgcgatgctgctgtttttcctgctgggcggacgctttatggaacacattgcccgccgtaaggcaggcgatgccgccgagaggctggtgaagctgattcctgcgttttgccatcatatgcccgattaccccgatacgcaggaaacctgcgaggcagctgtcgtcaaattgaaagcgggcgatatcgtgctggtcaaaccgggcgaaaccatccccgttgacggcacggtgctggaaggaagcagtgccgtcaacgaatctatgctgaccggcgagagcctgcccgtcgccaaaatgccgtctgaaaaagtaaccgccggcacactcaacacgcaaagccccctgattatacgcaccgaccgcaccggcggtggcacgcgactgtcgcacatcgtccgcctgctcgaccgcgccttagcgcaaaaaccgcgcactgccgagttggcggaacaatacgcctcgtctttcatattcggcgaactcctgcttgccgtccccgtcttcatcggctggacgctgtacgccgacgcgcacaccgcattgtggattaccgtcgccctgctggtcattacctgcccctgcgccttatcgcttgccacgccgaccgcgctggcagcttctaccggtacgctggcgcgcgaaggtattttaatcggcggaaagcaggcaatcgaaaccctcgcccaaaccaccgacatcatcttcgacaaaaccggcacgctgacccaaggcaaacccgccgtccgccgtatctcattgttgagaggcacagacgaagcctttgttctcgcggtggcgcaggctttagaacaacagtccgaacatccccttgcccgcgccatcctcaactgccgcatttcagacggcagcgtccccgacatcgctattaaacaacgcctcaaccgcatcggcgaaggcgtgggcgcgcaactgaccgtcaacggcgaaacacaggtttgggcattgggcagggcatcctatgtcgccgaaatttcaggtaaagaaccgcaaacagaaggcggcggcagcgcggtttacctcggcagtcaaagcggtttccaagccgtgttctacctgaccgaccccttgaaagacagcgcggcggaggcggtgcggcagttggcaggcaaaaacctgaccctgcacatcctcagcggcgaccgcgaaaccgccgttgccgaaaccgcacgcgccctgggtgtcgcgcactaccgcgcccaagccatgcccgaggacaaactggaatacgtcaaagccttgcaaaaagaagggaaaaaagtgctgatgataggcgacggcatcaacgacgcgcccgttttggcgcaggcagacgtatccgccgccgcagcgggcgggacggatattgcgagggacggcgcggacattgtgttattgaacgaagatttgcgtaccgtcgcccacctgctcgatcaggcgcggcgcacccgccatattatccggcaaaacctgatatgggcgggcgcgtacaatatcattgccgtaccgcttgccgttttgggctatgtccaaccgtggatagccgcactgggtatgagcttcagttcgctggcggttttgggcaacgccctgcgccttcacaaacgggggaaaatgcagtctgaaaaaatgccgtccgaacaatgacggacggcgttgctttagacgtatagttgatgaaaacaaaaataagacgatgaagaattgcaaacttaaagtatgtattgttaccgctcaaacacgttggcgttcaaaatttgagatcgaattgctaggtatttgattttattaaataagagattgtattaatgaggaaaaaaattaaaaagtggatttatgcgataaatggaataatgatgtcaatatggattattttttttccaaataccggttctgtgtatgacggtggcagaacaaccattttcaatgaaaaccatccttttcattttattttctgcataacatttcttattgggacaatttttcttatatatcatgaatataatgataactaatttttaacatccttattgttatatcatgatgaaatgacaataaggatggttttctgctttggctactgcagaacaccgtcgtcagtctcgcgtaggggggaatccatatgcttggtttttcttttattttcaaatgctaattaacggataggtctggattcccgcctgcgcgtgaatgacggaaatgtgcatttctaatttttacccactatatagtgaattaaatttaaaccggtacagtgttggctcgccttgccgtactatttgtactgtctgcggttcgccgccttgtcctgatttaaatttaattcactataaaaaccccgaatcctgattggcaggattcggggtttttgattgctggtgccgttcagacgggattttcaaacagcttattgatctacaaacgcacgctcaatcaggtaatcgccgcgtacgcctgttttcggagagacggtcagtccgaaatcgtccaaaactttgcaggtatctttcagcatcgcggggctgccgcacagcatggcgcggtcgtcttgcgggttgattttgggcaggccgatgtcttcaaacagtttgccgctcaccatcaggtcggttaggcgaccgtggtgttcgaattcttcgcgcgaaacaatcgggtagtaaatcagtttttctttaaccaagtcaccgaggtattcgtgttcgggcaattctttggtaaagcggtcgtagtacgccaaatcttttttgtagcgcacgccgtgtacgaggatgattttttcaaattgctcgtaaatttcggggtctttggtgatgctcaagaaaggagcgatgccggtaccggtgctcaacaagtaaaggtgtttgcccggattcaggtcgccggcaaccagggttccggtcggttttttgctgattaacacgtcgtcgccgactttgaggtgttgcaggcggctggtcagcgggccgtcttggactttaatgctgaaaaattcgaggtgttcttcccagttggcggaggcgacgctgtatgcacgcatcagcggcttgccgtccaccatcaatccgaccataacgaactgtccgttttcaaagcgcaacgattcgtcgcgggtgcaggtaaaggtaaaatatgcgtctgtccagtggtgtacggacaatactttttgggtattgaatgctgccatttgggtttcctgtcagtaaaagaaatggatagtgcttgttcgggaggtgcggcagagtggaaatgtctgcccgattcgggataaagccaaaattctaaacgaaacggatggttgcgacaatgcttgatgcgcgttggttatatgccgtctgaagggcttcagacggcatcgcggggcaggcggcggcttacggcggcatatcggcaagggaaatcagggaaatcgaggctgccagcctgagtgcgtcccgtccccagcgggggtgttccagcctgcgtatcgggaggatcggtttgacggtggcggcaatcagcttttgtatttcggcaggctgatctgacaatacgccgccccatttttccgcagccgcttccagcagtccgccgtttttcaatatcagcgcggtcgaatggatgtagcagagccaatcgcgggcttggcattgcgctatggtcaggacttcggaagggtcgtcttcaaaatccaaaaagctgatgttttttccgtccgacatcatatttcgcgcaaacgcctgactgaggaactgccgttttttatgcacgcgtgcaatggcttccaaaccggcaagccaagcgtccgactttccagcctcggcttcttggcggatttgcgcatcgagcgggatgccttccaaattgccgaacataagggcatttttcctgacggcgagcaattcgggaacggctatccccgccgagcgcaattcgtacaggcgttttgattcggttgcaatggcaggctcgccgccgaggctgggaaccggcttcaacacccccagtttcaaatatcgggcaaccataccgagcagcgcgtaacgccatcgtgcattgtgcctgcctgctttgcgtatccataccttggttccgtcggcaagcaggtggggggcgatggctgcctcctgttttgccgccaattcgtctagcagtatggaaaaacgggtttcctgcataggtaaggtcattttctttcaatcttaagttcggacggaatgcccctgtacggaatatcaggcaagggtttgttcgatgatgccttttaccgcatccgcactgttcggcacggtttgcacgcgctgcggcaggttttccaaaccttccagcgcggcagggcgcggaatggcggcatcgccgacggcttcgcgtatggtcgcatcgaatttcgccgccaacgcggtttccaaacaaaccaccatttcaccttcttcgcgcacttcgcgggcgacttttacgccgtcggcagtgtgcgggtcgatgagttcttggtcttgctcgtaaacctgcttgatggtggcgaggcggtcggcgtgggtggatttgccagaggtaaaaccgtatttgccaccgactttgtccaaggcaaatcgcaggtcaaagcctttgcctgcagccacttccgcccacagcgtattgatttccgcaggatcgcgatccatcaggtcgaacacgaaacgctcgaagttggacgctttggaaatgtccatagacgggctggaggttacataagtatgcgcgctgttgcgcgggcggtatgcaccggttttgaaaaactcgtccaacacatcgttttcattggtcgcgacaatcaggcggcggataggcaggcccatttgtttggcaatgtgtcccgcgcaaacattgccgaagttgccgctcggtacgcagaagctgacggtttcgtcattgcttgaagtggcgttgaaatagcctgcaaagtaataaaccacttgcgcgacgatgcgtccccagttgatcgagttgaccgtaccgatatggtatttttccttgaacgcggcatcgttctgcaccgccttcacaatatcctgacagtcgtcaaacattcccttcacggcgatattgtggatattctcgtcttgcaggctgtacatttgcgcgcgttggaacgcgctcattttaccgtcgggcgacaacataaatacgttcacgccctttttgccgcgcaaggcatattccgcagccgaacccgtatcgccgctggtcgcgcccaagatattgagttttttgccttctttgtttaaaacatattcaaacgcattgcccaaaaactgcattgccatatctttgaacgccagcgtcgggccgttggacaaggcttggattttgatgccgtctgaaagcgtgcggacgggggtgatttccttagtaccgaacgccgcttccgtgtaagtacggttcagaatgtcgcgcaaatcgtcctccggaatatccgtaacaaacaggcgcataatttcaaacgccaattcgggataagctaaaccgcgccatttgtccaaggtttcgcgcccgatttgcggataatgttccggcagcatcaggccgccgtcgggggcaagccccatcaataaaacttcgctgaacggtttgtgtgcggtttcgccgcgcgtgctgatgtatttcatgatttttctcgtctgtcgaaattgcaggaaaacggcttcagacggcatctgcctcatgccgtctgaagaaggttagcggtacaggtgtttgaagcaggcggaaaccgttttggcggtcagggcggcaagtgcctgattgcgcgtggacggagccagcatctgcatcacatcgttgccggtcatccgttcgggtgcttcttgggcgacgcaagcgcaaatcttgttttcccactccgcctgtttttcggcactcatcgccagcgcggtcaaacgccattcgctgcgtttgtccaattccgcacggcattggctcccaaccgccattttgacgatgctgccgcccatgcctgtgccaccgtctaagctgccgaatgtgttaccgcctccggcggcgcagccgccgagtaagattgccaccggcaaaatagacaaggttttattcatctcaattccttttcggttgaaaccccgccttttatggcgatagaatctgattagccgccccgttcgggataacgcgaagggcggcgttttatgcgccgttccgagtgttggaacaaaccgttttgaatatccggttgaagcccggcaacattatacttcaatcgggaaaataaaaaatcccgccgccgtcattttgcctgtttgcaaaaatgccgtctgaaagcggttcagacggcatttccgatttcagcctagcccaaagatttgaagtgttccaaaaacggcgggataccgggcagcatcccgaccgcacccatcgccacacacaagatcaagaaacctactgcgggtatcaacacgcgtccggcgaaacctaattgcgcactgcgctctttgcagccgattaagcccaaattatccaacagcatcgtcaacgcccagccgaaaaccggattgaccaaggcggaagagaacaccacgatggcggcggattgggtggttttgcctttgcgcgtcatttccatgcccgcttccaaaagcggtaagtatacgcctacgaccaaggctacgctcaataccggctgccaaatcgccaagtccatcggatagccccataacccggcgataatacataaaaccgccgttaaaaccgcaccgcccggaatggggcgtttggcaatcgatgccggtacgatataagttccccaagaagaggtaaaatttgcaccccctaaaatagaacccactgcttgacggacagaacaacttgtcatggtgtcgtctatattcatcaataccttatcggttttttccggatagctgattttttggaacacttgatgtcctaaaaaatcgggcgaccacattgcaacagccaataccgcaaatggaaagacaaccaaaaaactttctgccgtcggcaaccccagatgccagccgctgttttcaccccaccaataagcaggactcattggaggcaggccgggggcggtgtgaaactcaaacggcgcacccaatgcaaatgccaccacaccggcaatcaagcatcccaaaggcacggctaaccagcgttttttccaatgctccaacaaagcgtacatcacaatcgttacaataatgacggtaaaagcgatgtagggcatattaaaaccgcctgcccacgaaaacaatttttttacctgccccgtcgtgccgataaagcccaaatagagtaataatccgccgcatacgccgttgcttgtcagcttcgccataatactgccgccgcgaaataaagccatcagcagacctaaaaccgcaatcgaaatgccgaacgccaaaggatgcccgcctgccgacacaacgatgggaatcatcggaatcagcggcccgtgcgtaccgggcaggttggcgccgggcagaaaaaagcccgataccaataagataaacgcggcggcgattaaaagctcatagcgcacattttccagtacaaagctgtcaggcagccccaaaggtgcggcaaacgccgccgccaccgcccccaccatcaccacttttccaatcgttcccgccatcgcaggaatcaaatcctcccactcgaagcggtaatcgcgaaagggcaggttgggccgccagcgttttggttgcataatctgcaattcatgttccaaatattcgtcccgcgtcgcaaattccgaagctggacggtgcaaatcccgataagtcccattatgtttttccataaccttcctccttatatatcgcgcctcgtaaaaggggcgcatgacttttctttttgatacgggctgcgttcggaagccgtaaccccatttaaagcccaaacaggcaataaaaccaatctttttttttgataaccatcatccggaaaactgatacaatttacaaaccacttgattaaaaagttaattttcagcaacaatccacctaaaagatttcgattgcacaaatatagaaaacatccgcacaaggagggatatatggatgccgtacaattaaaatcatttgtcgccgtcgcgcacgagggcaaccttacccaagccgccaaacgacttttcctttcccagcctgccgtttctgcccaaattaaagcccttgaagaatatgtcggcacgccgctgttcaggcgcacggggaaaggcatggtattgacgcgggcgggcgaaatactgttgcccgaagcggaatccctgctgcaatacaaacacaagctggagcattttgccaaaacgctggcaggcgattattcggaagagaccagtttgggcattatccaccccatcgattcggcaaaactcgtcgcgctgacggacaatatcggtcaaacagcccccaaaacgcgcctgcacatccaatacggaatgagcggcgaaatcctctcgcgcatccaacacaaaaccctgcacggcggctttatactcggcaacgccgcccaacgcggcatccgcagcgtattcctgcaaaacctgacctacgcgctgatttgcccgcaaagccaatatccccatctgacccgctcccttccgcagagcctgcaagaatgcgtatggatagaaatgtcgggcgtgtccggaagtaggaagcacctgcaccagttttggcgcagcaaccggctctcacccaaaaaacagatcttgtgcgactacccccaaaccattatcgatttggttgcaggcggtataggtgtggcaatggtgccgggaaacaaagccgaagcggcggcaaaagaaggcgcgggcgtggctattatcgaatcgtgccgccacagtatgccgctcaatttcatttatgcggaagaatacgaggataatccccacgtctcactcctgctcgagtgcattgaaaaagtatggggagtgcaggcggtgcagccgcccgttgtctcggacaactgaaataaatcctgctttgctgattgttttaaaatagaaatttgaattttatcacgctgaaaacactgaaaacgccatccgcattctctcaaatacggcttaaaatgccctttggaaatgccgttatagtggattaacaaaaatcaggacaaggcgacgaagccgcagacagtacaaatagtacggaaccgattcacttggtgcttcagcaccttagagaatcgttctctttgagctaaggcgaggcaacgccgtactggtttttgttaatccactataaactgacgcaaataccgttttgcacaattccaaaagttttcaattccgttaatgcgattttgccgtttggcgaaatgcgtactgttccagtcgtggattgaacccccaccctgtatagttctttcgaagcattggggtattgttttttcaaagcatcttggattcggatttcaagtgcaacactagtgtattagtggttggaacagattcaagaataaaacacttggcgtttcgtagccaagtgtttttcttggtcggtggttcaactcatcttgaaccctgcgtatctcccgatcactgatgttacggaaatcggtttgtttggggaagtattgccggatgagtccgttggtgttctcattcagccctttctcccaagaatggtaagggcgacaaaaataagtctccgctttcaatgctttggttattttggtgtgttggtagaactctttgccgttatccatggtaatggtgtgcaccctgtctttatgtgcctttaatgccctaacagctgcccgggcagtgtcttcggctttgaggctatccaatttgcagatgatggtgtagcgggtaacgcgttcgaccaaggtcaataatgcgcttttctgtcctttgccgacaatggtgtcggcttcccaatcgccgatacgggatttctggtcgacgatagcgggtcggttttctatgccgacacggttgggtactttgcctctggtccatgtgctgccgtagcgtttgcggtagggtttgctgcatattctgagatgttgccacaacgtgctgccgttgcttttgtcttggcgaaggtagcggtaaatggtgctgtggtggagcgtgatctggtggtgtttgcacaggtaggcgcatacttgttcgggactgagtttgcggcggataagggtgtcgatgtgctgaatcagctgcgaatcgagcttatagggttgtcgcttacgctgtttgatagtctggctttgccgctgggctttttcggcgctgtattgctgcccttgggtgcggtgccgtctgatttcgcggctgatggtgcttttgtggcggttcagctgtttggcgatttcggtaacggtgcagtggcgggacaggtattggatgtggtatcgttcgccttgggtcagttgcgtgtagctcatggcaatctttcttgcaggaaaggccgtatgctaccgcatactggcctttttctgttagggaaagttgcacttcaaatgcgaatccgccgtcgtttgaacatttttttcttcctgtttgatttcagacggcattgccgttccgtttggtttccagcagctcccagcgttccagcttttccaaaagcagcatttcgatttcttcggcgcggttttgcaatgcacctgctttttcgtaatctttgaaaatttcaggataggaaagttgggtattgatttcagcctgctcggcttccaaagcggcgatttcgtcgggcagggcatcgagttcgcgctgctctttgtaggacagtttgaccgtgcggttggctttgggtttttctttggcgggttcggcatcggatgctttgggtgcggatgccgtctgaattttatcttcccgcgattttgcgtcgatatagtcctgatagccgccgatgtattctttcagacggccttgtccttcgaaaacaatgctttgggtaattacgttatcaaggaacatacggtcgtgcgagacaaggaatactgtgccttgataatcgcgcaacaggtcttcgagcagctcttgggtgtcgatgtctaagtcgttggtcggttcgtccaagaccaggatattggcaggacgggtaaagagttttgccagcaaaaggcggttgcgttctccgccggagagcgatgaaacagggctttgcgcacgggctggatggaacaggaaatcttccaaatagctcatgacgtgttttttcttaccgccgacttcaacgtaatcgtttccctgtccgagggtgtaaaacacggtgtcgttttcattcaacgcgctgcggaactggtcgaaataggcgacttcctgcttactgccgatacggattctgccgtaggtcggctgcaattcgcccaaaatcagcttaaggaaggtggttttgccgatgccgttggggccgattaggccgattttgtcgccgcgctgcaagatagcggagaatttgtccataatgactttgccgccataggcaaacgaagcgtgttccaattcggcgatgattttgccacttttctcaccgctatcgagcttgaagttgacttgtccctgtacgttgcggcgttctgcacgctggcggcgcagctcttccaaacggcgcacgcggccttcgttgcgggtacggcgcgcttcgatgcctttgcgtatccatgcttcttcctgtgcgtggaatttgtcaaagaggcggttgtgttccgcttcgactgccaactcttgcgcttttttctcgctgtatttagagaacgagccgggataggaacgcaaaataccgcgatcgagttcgacaatccgcgtggcgatattgtccaaaaaacggcggtcgtgggtaatcacaaccaagctgccttcaaacgctttgagcagattttccagccaaataatcgcgtcgatatccaaatggttggtcggctcgtccagcagcaatacgtcgggcttttgcacccaagcctgagccaaggcgacgcgctttttctgaccgccggaaaggttgccgattttttcattttccggcaaaccgagttcccccaaagtctgcttgactgccgcatccagtttccagccgtccttcgcttcgatttcaagttgcaattcgttgagttctttcaacaaagcctcactcgaaccattttccaactcatggctgacatgatgataacggcgcaataaatcacgaatttcgcccaaaccttcggcaacggtatcaaatacggttgcgtccttatcaaaaaaggattcctgcggtacataaacgattttgaggttgttttgaacaataatctgcccgtcgtcgagcttttgcaaaccggcgaggatttttaaaaacgaagacttgcctgcgccgttgcgtccgattaagccgactttttcgccgctgtcgagttgaaaagaagttttgtcgagcaaggcaacgtggccgatggcaaaagaagcgttttctacagataatatattcatgatacaaattctcaacagttaccgtttggattttaccgcaagtttggcgcgggcaatttcaaccgcacccggcaggacggaaacaataatgatgccgcccatcaccaagcccagattgttttttacgacggggaagttggcaaagaaatagcccgcgtaagaaaacaggataacccacaacaagccaccgatgatgttgtagcggataaatttggcatagtgcattttccccataccggcgacgaagggggcgaaggtgcggacgatgggcataaaacgggcaatgatgatggttttgccgccgtgtttttcgtaaaaacggtgggttttatcgagatattcacgtcggaagattttagaatcggggttggcgaacagcctgccgccgaaatatttgccgacggtaaaattgagcgcgtcgccgagtatggcggcaaggcttaataatgcaaccatcaaatgaatatccataccgcccagcgcggcaatcccgccggcggcaaacagcagcgaatcgccgggcagtaagggcgtaacaatcaggccggtttcgcaaaaaacaatcaaaaacagaatcgcataaatccacacaccgtattgcgccgacagcgcgagcaggtgttggtcgatatggaggatgaagtcgatggcggaggcaagcacggcgcgttcctaaaaaaacaaaccgcgtattttaaccgattggaaaaatgccgtctgaaaagtttcagacggcatcggctattcaaattcatttcacgtaaaaaccgcaaaccaaaatagtttgcggtttggcatttaaagtgacaatgatgatttcaaatcatcagaattttatgccgacgcgcaagccgtattcacgaatactggttttcgggatggtgagcgatacgtcgccactcttggttgttacactaaactcgccggattctttgtaagtgcgttgtttgtagaacggccccgcctcgatgctggcggattcgcccagttttttaccaatatttgcacccaatccaaagccccagccgttggttttttgattgatgtcttttttgagattggtaacgccggtgtttaatttatagcgggaattgaggtcaaatttcacttcagaccaagggttgatataccagccgttacccagttgggaaagcaaatccgcgtgaactttggctaaccacgactgacggctgctgtgaagcgtatgcttggtggttttaatgctgtcttttgaagattcaaaacccaagccggcacccacacggaaatttaaagaatcacttaacgtttgggtgtaggtgtagcctgtgtaaagatcgatacggttttcaggaacgccggtgggcagttttacatttttagtcttacccagcttgttctcatctgtttccaaattaataatattttttttgctgcgcccgaaaccggcttccaagcggatgccttggttggcatcaaaaggaatatcagcacgcacgctgatgtgtttggcagctttgtgtttttctttcaggaaagcacgagttgaagaaatggaagagaggtcggtgtggacggtaaactcattagcggtttgaagctcttgtgcagcggcggcagtaccggtcagggcaatcatggcacatgtaaaaactgtttttttcatagttaaaacctctaaaatttggattgtagtcggatatggtaacataacgtaaataatcgttacgcttacaattatattcttaagctttcggggggggggggattttacatatattaataaaaattaacaaatagttatttgtttacaacgaattgttattctcacttggttttctgttttttatgggaatgacgaaattttagtttgtgtgtatttatcggaaaaacagaaacccgccgccgtcattcccgcgcaggcgggaatctagaacccaacgcgacaaaaatttatccgaagcgacaacaatcttttcatcgtcattcccgcgcaggcgggaatctagaacgtaaaatctaaagaaaccgttttacccgataagtttccgtgccgacaaacctagattcccgcctgcgcgggaatgacgggattttaggtttctgatttcggttttctgttttaagggaatgacgagacttgagatggcggcatttatcgggagcaactgaaaccaccctgccgtcattcccgcgaaagcgggaatctaggttcgtccggtttcggttatttccgatagattcctgccgcgttgggggtctggattcccgcctgcgcgggaatgacgggactttaggtttctgtttttgtttgagacctttgcaaaattcctttccctcccgacagccgaaacccaaacacaggttttcggctgttttcgccccaaataccgcctaattttacccaaatacccccttaatcctccccggatacccgataatcaggcatccgggctgccttttaggcggcagcgggcgcacttaacctgttggccgctttcaacaggttcaaacacatcgccttcaggtggctttgcgcactcactttaatcagtccgaaataggctgcccgcgcatagcggaatttacggtgcagcgtaccgaagctctgttcgaccacatatagtggattaaatttaaaccagtacggcgttgcctcgccttgccgtactatttgtactgtctgcggcttcgtcgccttgtcctgatttaaatttaatccactataacgggtcttcgataaatatcggttacgtttggtttgcgtttccgtcagcggacggttgcggcaggctttgcgcataatgccgtccaacaactgatgttcttccagatgttgccggttttccgcactgtcatagcctttgtcggcatagacggtcgtacctttgggcagtccttccaacaaaggcggcaggtgtttgcactcatgggcattggcgggggtaatgtgcagtttctcgatatagccttccgcatcggtacgggtatgttgtttgtaaccgagtttgtagaggccgtttttcttgatccaacgggcatcgctgtccttactcggtgtggtttggccgttgatttgtccttcttcatcgacttctatgacctgacgctgtgtgctgccggcggtctgaataatggtggcatcaatgacggcggcggatgctttctctacttttaagcctttttcggtcagttggcggttgatcagttccaataattcggacagggtgttgtcttgcgccaaccagttgcggtagcggcataaggtgctgtaatcgggaatgctcagttcgtcaaaacggcaaaacaggttgaagtcgatgcgggtgatgaggctgtgttcgagttcgggatcggagaggctgtgccattgtccgagcaggacggctttgaacatggacaacaggggataggcgggacggccgcggtaatctctgaggtaacgggtttttgacggttcaggtatggttcgatcggctgccaatcaatcacccggtccaacttcaatagcgggaaacggtcgatgtgtttggcaattatggcttgtgcggtttgccggaagaaggtgctcatgagaaatcccctaaatgtcttggtgggaatttaggggattttggggatttttgcaaaggtttccgcctgaaacattatgagatttcaggcggcattggattgcttggcggaatatttttaaaaaggcttacgcgccgtaaacggggtatttattgcacaaagcagttacttgtttgcggactttggcgaggttggcttcgtcttcggggttagacaatacgtcggcaaccaagttcgccaatacgcgcgcgtcggcttcgttaaaaccgcgtgtggtcatggcagcggagccgatgcggatgccggaggtaacgaagggtttttccggatcgttcggaatggcgtttttgttgacggtgatgtgcgctttgcccaaagcggcttcggcggctttgccggtaattttcatcggttgcaggtcaacgaggaaaacgtggctttcggtgcggccggaaacgatgcgcaaaccgcgtttaaccaactcttccgccatggcggctgcattgattttcacttgttttgcgtattgtttgaactcgggttgcaatgcttctttaaacgccacggctttggcggcgataacgtgcatcagcggaccgccttgcaggcttgggaagatggaagagttcaacgctttttcgtgggtattgtcgcggcacaaaattacgccgccgcgaggaccgcgcagggttttgtgggtggtggtggtcacgaagtcgcagaacggcaccgggttgggatattcgccgccggcaaccagaccggcatagtgcgccatatcgacaaagaggtatgcgccgactttatcggcgatttcgcggaattttgcccagtcgatttgtaacgcgtaggcagacgcacccgccacaatcattttgggtttgtgttcgagcgcgaggcgttcgacttcggcataatcgagcacttcgttttcatccaaaccataagtaacggcgttgtagagtttgcctgagatattaacgctcgcgccgtgggtcaggtggccgccgtgcgctagagacatacccaaaatggtgtcgcctggttttaaaacggaagcgtacacggcttggttggcttgcgagccggagtgcggttggacgttggcataggctgcgccaaacagttcttttacgcggtcaatcgccaattgttcgacaatatcgacgtattcgcagccgccgtagtagcgtttgccggggtagccttcggcgtatttgttggtcagctgggaaccttgcgcgtccattacggcgcagctgacgtagttttcggaagcaatcagctcgacgtggtcttgctggcgttggtcttcttgggcaatggctgctgccaaatcggggtcgtattgtgcgagggtaacgctttttgaaaacatgttctcggctcctttgtgtaatcagggtatcatgagtgttttttgtataaaaaaatatttcaaaacctaaggcagatagcccataatgcgtaaattttctttggcattatcaggtaatttatttaacatgctggtttttagcgtctcattacctttatttagtacaagactaatcaaaagcaatacattaaatggtaaattttcggcagtttgtgcaaaatcaatcaaataaccagcaccaaccacatctttatcagccataacccgctgatacaccacttgctaagacaactctcctgccccaccatgtcttaaaatcagatgaatggcttgtaatgctgtgtttggtgtctcacaaattgccaagatctgctcagaagcttgcttgatggcttgtatttttgtttgattactcacaatttccccctattttaataattaacttaaatgcggtcaaattcacaaaatacaagctttacctctaatcacccatcactcgaccttctcggcgtggatcggcaccaccaaccagcctgcttggctcgataataatggcttgaacacctgaatttagctcacgcacatcagtcttatagcccaaatcatttaatgcttgttgccactggacggcggttgtacccgtttctagttcatagctaccaaagcgatttaataaattgggtgcactgatggcattttggatatccatattccagtcactatgtgccacaatcgtcttagcgacatagccaatgatacggctaccacctggggagccgattgccatataaggcttgcctgctttaaatacgatggttggtgccattgaggagcgtggtctcttgccgggctcgacacgattggcgacctgtttgccctgctttattggctcaaaactaaagtctgtcagctcattattcagcaggtagccatttgccatcaaagttgagccaaacgcattttcaatggaagtcgtcattgatagcacattgcccgccttatccacaattgatatatgactggtagaaggtaactcaatcgcttgtgaggacacccactcatgaataaaatcgcctgcagatacgctaggcaatgccttatccgactgctcaagcagctggctgcgatgttttaggtagtctttagaaatcaactggcgaatgggtactggtacaaaatcagggtcgcccaaatatacatcacgatccgcaaacgcaagcctagaagcgtcgcccaagagacgtaaaccttcagcatcataccccacctgattgggtgaaaattcatttaaaatccccaaaatctgacccacagcaatcccacctgagcttggtgcacccataccgcatacttcataaatacgataagtcacacaaacaggcgggcgttccaccacttgataatcagataaatcttgtaaggataattgaccggggttatccttagcattttggacaactgaaacgatattttgggcatatttaccagtatgcagagcttttgcaccttgagctgctaacgcctgaacactgtcagcaaattctaaatttttcagcaagctgcctgcttgtagcggcacaccattcggcaaaaaataagcggctgtttttggatagcgtgccaaatgctgctgattttgctcaaccgagatggcaagccttggcgacacctcaaagccttgttttgccaagcggatcggtgtatcaaataattttccccaaggcaatacaccgtatcgctgatgtattgtctccatcagtttagggatagcaggcgtacccaccgagcgaccaccgaccaccgcttccataaatttcaatggttgaccatctttatccaaaaataattccggcgtcgcacgcatcggtgccgtctcacgcccatcaaatgtggtcaatgttttggcggtattatcccaatacaacacaaatgcaccaccgcccaagcctgacgactgtggctctaccaagcttagtgtcgtctgcaccgccaccatcgcatctgcagcgctaccgccttgctttaagatatcatagccagcttgtgttgctaatggattggctgacgctaccataaaatcacttgcaatcacctgcttttgttcggtcagtcccgttgcatgttcaggcgtgtgagcgtctgcacctgtgatgacagcagaatgagtattaaccttaccttgattggcatggatgacttgacatccagagattgtcatagacattatcaatgcagtcaataaatatgttttagccacaagcactccttcgcctgagtttgattgatgattcatacaaggcatgctgattattgtatttaatatggctaaataattcaatccaaactatcaatcttgaccatcaaaaaaagaccgctaatgtcatcagcagtcttttttgatatttattttaagatattaagtaatcagacctttgggctatgctcttcaatgagtggttttagctcacctgattggtacatttgtaggataatatcactaccaccgattaactcaccattaacccaaagctgtggaaaggttggccgactggcgatgagtggtagagtactgcgaatttctgggttttctaggatattaacaaaagcaaagggtctgccaattgggtcagcacctctactgcacgcgctgaaaatccacattggggaaactggggcgtgcctttcatatatagtggattaacaaaaaccagtacggcgttgcctcgccttagctcaaagagaacgattctctaaggtgctgaagcaccaagtgaatcggttccgtactatttgtactgtctgcggcttcgtcgccttgtcctgatttttgttaatccactatacagtaggaaaggctgaaaatttatgcgtaaagcgtgatattgtcaacgtttttatcaaccggacggcggtgttaaaagaaaattttgccgtatccgataaaacactggataaaaatattatctttgttataattaatgtaaagattcaatttgactttttaaccgtaaaccaagagaggaaagcgatatgttcccagaataccgtgatttgatttccaaattgaaacaggaaaattcccgcttcgcccgtctgttcgacgaacacaacgagctggacgataaaattaccggtctggtcaacaatccggttaccagcggtgcggaaaccatcgatgagctgaaaaaagccaaattgaaactgaaagacgagttgtacgccatcctgcaaaaagcagcgggaaaataattcgggtttgagtttttgaaatgccgtctgaaatgtgttcagacggcatttttgtcatttgaccggaaggcttgtgctgtttgaaataacggcggcggtatcggattgccgccgccgtgtacttgtgtgaacggctgtctgtctattttgcgtgcaggcggtcgagataggcgacttcttcgctgctgcccatgaagacggcgacgcgttggtgcaggttttcgggctgtatgtcgagcatggcttgatatgcgttgcttgccgatgcgcccgcctgttcgagtatcaggctcatagggttggcttcgtacatcaggcgcagtttgccgggtttagcggggtcgcgtttgtcttgcggatacatgaacacgccgccgcgcatcaggatgcggtggatttcggcaaccatactggctacccagcgcatattgtagtttttgccgcgcgtaccggtttcgcccgccaagagctcgtcgatgtattgttggacggggggcagccagtggcggcggttggacatattgatggcaaattctttggtactttcgggtactttcgggttttctttggtcagcacaaattcgttttcggcattgagcgtgaacatatatacgccatgtccgaatgtgaatacgagctgggtttgaggcccgtaaagaacgtaaccagcggcaagctgctgtctgcccgtttgaaggaatgattcggttgccaatgcgccttcgggtttttcaaggatggagaaaatcgtaccgacggaaatgttgacatcaatattggacgatccgtctaaagggtcgaataggacgagatagcgtccgttttcaccggcatttacgaaagtgtcttcttcctcgctcgccagcccggcaacggcagaattggctttgagtgtgtcaatcatgatgttgttggcgataacatccagttttttttggtcttcgccctgaatattgcccgtgcccgccatacccaatacgccggccagtgcgccgaggcggactttggcgttgatttcggtgcaggcggaaacaacggacagtaaaacgccgccgagtgcttcgggcagctggttttgttgcaggtgttcggggaggaatcgggtcagtgtgtccatagtttgctcgtttcggaaaggtttgtgccgtctgaaaggcggcaggttattgtggcgtattcctttggtgcgttttgcaggatagtctaggggattgtagtgtaaaaaaacggcatggggcaagtcggaacgcggcaggcggatgaggggatatttattcttaaaagtgccgactgccggtatatcgtccggttttgtttatttgacgggagatgttgtctgaagggtttcagacggcatcggggtcagcggattttgctgtccaaaaggtagcgcgagccttcgtcttgcgccagcagccgcgtcagggcggggaggtttgccgccaattgttccgccaacagatagggcggattgatgacgaacattccgctgccgtgcataccgaaaccgtcggctttcggcgcgtggacgtgaagttcggcgtgaaggtagttgtcgggcaggagttttttcaattcttcgggcagcttgcggctttcttcgcggctgaggcagggataccaaatgagataacagccggactcaaaccgttttaaagcggctttcagcgtttccgttacacgccggtagtcctgtttttcctcatagggcgggtcgatgaggacggtggcgcggcgcggcgggggcggcagcagggaaatcagccctttgtaaccgtcttcgcgtaatacttgtccgcgtttgcccaatcctgcttcgcccatattgttttgcagatggacaaagtcggtggggtgcagctcaaacaggcgtaatttgtcgccgacgcgggtcagcgattgcgccagccacggagaaccgcagtaaagtttgggcgagggcaggattttttgtatgtgcgcggcaaagtcagagagttcggcaggcaggttttgcgcctgtcggagcagggcgatgccttgtcggtattcgccgactttctgcgcctcgctgccttcgagattgtacacacccgcgccgccgtgcgtgtcgatgtaccagtagggcttgtctttgcggttgaaatattgcagcactaaaaacaaggtgaaatgtttgagcatatcggcgtggttgccggcgtggaatgcgtgtctgtaactgagcatagtcggtaaaacggcgggatattcggatgccgtctgaagcggggttcagacggcataaacagggatggatgggaaatcagcggctgccgccgattttgctttctctgccttcgagcagcttgacgatattacttttgtggcggaacaacaccagcaaagcaatggcgacggtcgcccaaacccacgagacgtgcggcataaagaaggatgcggcgaccggtgcggcgattgtggcggttaatgcggcaagggaggacaccttgaagccgaatgccataacaagccaaatcaacgcgcagaccaaggcagttgcgggagagagtgccagaagcacgcccaatgccgttgccacgcctttgccgcctttaaatccgaaaaacaccggccacatatgcccgaccagcgcggcgagtgcgacggccgcgattgcgctgtcggataaaccgagcggttcttgaagcacgcgtgcaagcaaaacggcaactaaacctttggcggcatcgcccaagagcgtcagcgcggccgccttttttttgccgctgcgtaaaacattggttgcccccggattgcccgatccgtaggtgcgcgggtcgtccatgccgtaatacttggacacgatgacggcgaaagaaagtgagccgatcagataggaaacagcaacagccggtatgttgaacatttgcggtactttacttagaatggtgcggttattttagcaaaaaacggggcggattatggataaaatctttttgcacggcatgaaggcagatacgcttatcggcgtgtacggctgggaacgcgaacggttgcagaccctgattgtcgatttggacatcggtgttcccgagaaagcgggttcggacgacgatattgccaatacggtgcattatgccgaggtatgcgaaacgctgcgccgacatctgaaagaacaggatttcctgcttttggaagcgttggcggaatatattgccgatttggttttgggatatttcggcgcggtgtgggtgcgcgtgaaaatcgtcaagccgggtattttggaaggcgtgcgcgaggttggcgtggaaatcgagcgcggcaagcgtgaagattgaacggcagaataggaaacggaaaggagatatgaagtggatttgagggaagtaaaattaggcggcgaaaccatttacgagggcggtttcgtcagtatcagcagggataaggtcaggttgcccaacggcaatgaagggcagcgtatcgtcatccgccatccgggtgcggcatgcgtgttggcggttacggacgaagggaaagtggttttggtgcggcagtggcgttatgcggcaaatcaggcgacattggaacttcctgcgggcaagctggatgtggcgggcgaggatatggcagcgtgtgcgctgcgagaattggcggaggaaacaccttataccgccgacagcgtacgcctgctttacagtttttatacggcggtcggtttttgcaacgaaaaaatgtatctgttcgaagcggaaggcgtgcgtttgggcagtacgcttgccaatgacgaagacgagattacggaaaccgtattgatgtcgaaagaagaagtccgtcaggcattggcaaacgatgaaattaaagacggcaagacattaatcggtttgcaatactggttgatgaaggattgacaggatgttggacttgcccgccggattggatcggcgggcggtttgtttggcggatgggatatgccttttcggcttgtatctgggcgcgtcctttaaagtcattcgtgctttagtaataagagagaaaaggggatgataattacctaaaagaacgtgataatttttaaaatggttaataatgaatatctttgttactaatttttgttattggtttattagtttattggctatttcttatataccatctattaatgcatggcatgatgaattaatagatgatattaattttggcaaaagggttatgatggttactttttttgcatttttaggcacggtaatagagcgtttttttaagaaaaagccttggtggttttatcctgccaaggctttttctttgttacagacctaaaagctcaatttgaatttgagaacggtaattggcacagccagtatttaaacaagcgaagctaatttatagattatgtcaaaacaaagggaggcaatttgttgcggttatttgactgccgcccctatcttcagcccgagccaggtcagcagcagcgaacctgccgtgtgcaggaaaatattggcaagtgctgaagcgggacggttcaattggagcagggttacggtttccagcgaaaatccggaaagcgtggtcaggctgccgagaaaaccggtaatcagcagcagcttccattgcgggtggttgacggtttcggcaaagattccgataagaaaagcgcctatccagttggcaaacaggttgcctgtggcgggaggtattgatgcgggaacggcgaggttgagcagccaacgcgccgttgcaccgagtgccgcaccgatggaaagggggatgatgttggaaagcatggttttgcctgtctatgccgtctgaaggctaccgccatatgccgcggtcggacttaagatagcggttgtcgtcgaaagtgttaatccaatggggcttcagtgcaacaaatatggcagttgaaatgccgctgaggaaggcttccgcccacgccagcagaataaagacgggcagggcggtcgtccacaatatttcggacggaaaagcgtttgcggcatccaaaataccggtcagcaccagcccggtcagcagaatgccggcggcggaagcgagaaagccgttgacgaaaataaagatgaaaatattgggcggcaggcggttgaccagcatacgcgacaggcggttgacggtcagcgcgggcagtatcagcaccaaagcgttcggcggatatgcgccgacagaaccggcaaacagcaggcagtagggcagcatcagcagcgcggcaagccaaagggcggcggaagtgcccatcatcagtgcaaccaaattgacggcgagcaggtggtagttcatctgggcaagctgtccgccgccggcagaggcgttcagacaccatgctgcggaaaaaattacggtacacaggggaagggcggaacggtagcgggcaagcgagcggaatgccgacggcgcggaagctgccagtatcaggataaggacaatccacgaaaccgacagtaccatatctgaaaaccagactgtttggaaaatcatggcaatgccgcaaagattaagggaagggacggctattatactgtcggcgggggcaaaccgaaagccgaatcggtttcggcagaattgccggccggttgttttttttgggatggaaacacgttaaaataaacccgtttaatcgtttgtcttgcgggaaacggcatatgttttggatagttttgatcgttattttgttgcttgcgcttgccggcttgttttttgtccgcgcacaatccgaacgcgagtggatgcgcgaggtttctgcgtggcaggaaaagaaaggggaaaaacaggcggagctgcctgaaatcaaagacggtatgcccgattttcccgaacttgccctgatgcttttccatgccgtcaaaacggcagtgtattggctgtttgtcggtgtcgtccgtttctgccgaaactatctggcgcacgaatccgaaccggacaggcccgttccgcctgcttctgcaaaccgtgcggatgttccgaccgcatccgacggatattcagacagtggaaacgggacggaagaagcggaaacggaagaagcagaagctgcggaggaagaggctgccgatacggaagacattgcaactgccgtaatcgacaaccgccgcatcccattcgaccggagtattgctgaagggttgatgccgtctgaaagcgaaatttcgcccgtccgtccggtttttaaagaaatcactttggaagaagcaacgcgtgctttaaacagcgcggctttaagggaaacgaaaaaacgctatatcgatgcatttgagaaaaacgaaacagcggtccccaaagtccgcgtgtccgataccccgatggaagggctgcagattatcggtttggacgaccctgtgcttcaacgcacgtattcccatatgttcgatgcggacaaagaagcgttttccgagtctgcggattacggatttgagccgtattttgagaagcagcatccgtctgccttttctgcagtcaaagccgaaaatgcacggaatgcgccgttccaccgtcatgcagggcaggggaaagggcaggcggaggcaaaatccccggatgtttcccaagggcagtccgtttcagacggcacggccgtccgcgatgcccgccgccgcgtttccgtcaatttgaaagaaccgaacaaggcaacggtttctgcggaggcgcgaatttctcgcctgattccggaaagtcagacggttgtcgggaaacgggatgtcgaaatgccgtctgaaaccgaaaatgttttcacggaaaccgtttcgtctgtgggatacggcggtccggtttatgatgaaactgccgatatccatattgaagaacctgccgcgcccgatgcttgggtggtcgaaccacccgaagtgccgaaagttcccatgaccgcaatcgatattcagccgccgcctcccgtatcggaaatctacaaccgtacctatgaaccgccgtcaggattcgagcaggtgcaacgcagccgcattgccgagaccgaccatcttgccgatgatgttttgaatggaggttggcaggaggaaaccgccgctattgcggatgacggcagtgaaggtgcggcagagcggtcaagcgggcaatatctgtcggaaaccgaagcgttcgggcatgacagtcaggcggtttgtccgtttgaaaatgtgccgtctgaacgcccgtcctgccgggtatcggatacggaagcggatgaaggggcgttcccatctgaagaaaccggtgcggtatccgaacacctgccgacaaccgacctgcttctgcctccgctgttcaatcccgaggcgacgcaaaccgaagaagaactgttggaaaacagcatcaccatcgaagaaaaattggcggagttcaaagtcaaggtcaaggttgtcgattcttattccggccccgtaattacgcgttatgaaatcgaacccgatgtcggcgtgcgcggcaattccgttctgaatctggaaaaagatttggcgcgttcgctcggcgtggcttccatccgcgttgtcgaaaccatccccggcaaaacctgcatgggtttggaacttccgaacccgaaacgccaaatgatacgcctgagcgaaatcttcaattcgcccgagtttgccgaatccaaatccaagctgacgctcgcgctcggtcaggacatcaccggacagcccgtcgtaaccgacttgggaaaagcaccgcatttgttggttgccggcacgaccggttcgggcaaatcggtgggtgtcaacgcgatgattctgtctatgcttttcaaagccgcgccggaagacgtgcgtatgattatgatcgatccgaaaatgctggaattgagcatttacgaaggcatcccgcacctgctcgcccctgtcgttaccgatatgaagctggcggcaaacgcgctgaactggtgtgttaacgaaatggaaaaacgctaccgcctgatgagctttatgggcgtgcgtaatcttgcgggcttcaatcaaaaaatcgccgaagccgcagcaaggggagaaaaaatcggcaatccgttcagcctcacgcccgacgatcccgaacctttggaaaaactgccgtttatcgtggtcgtggtcgatgagtttgccgacctgatgatgacggcaggcaagaaaatcgaagaactgattgcccgcctcgcccaaaaagcccgcgcggcaggcatccatttgattcttgccacacaacgccccagcgtcgatgtcatcacgggtctgattaaggcgaacatcccgacgcgtatcgcgttccaagtgtccagcaaaatcgacagccgcacgattctcgaccaaatgggcgcggaaaacctgctcggtcagggcgatatgctgttcctgctgccgggtactgcctatccgcagcgcgttcacggcgcgtttgcctcggatgaagaggtgcaccgcgtggtcgaatatttgaaacagtttggcgaaccggactatgttgacgatattttgagcggcggcggcagcgaagagctgcccggcatcgggcgcagcggcgacgacgaaaccgatccgatgtacgacgaggccgtatccgttgtcctgaaaacgcgcaaagccagcatttcgggcgtacagcgcgccttgcgtatcggctacaaccgcgccgcgcgtctgattgaccagatggaggcggaaggcattgtgtccgcaccggaacacaacggcaaccgtacgattctcgtccccttggacaatgcttgattttttgcaaatggaaatgccgtctgaagactgtttcagacggcatttttatagtggattaacaaaaatcaggacaaggcgacgaagccgcagacagtacaaatagtacggaaccgattcacttggtgcctcagcaccttagagaatcgttctctttgagctaaggcgaggcaacgccgtaccggtttaaagttaatccactatatcagacatttgaattcggattattccctgacctgtcccgtgccttgtacgatgtatttgtaactcgtcagctctttcaaacccatcgggccccgggcgtggagtttttgcgtggagatgcccatttcgcaacccaagccgaattcgccgccgtcggtaaagcgcgtggacgcgttgacatacacggcggcagaatcgatatgagtcgtgaaatagtccgcagcgtggcggttttcggtaacgatgccgtctgaatggtgtgtgctgtgggtttcgatgtgccagaccgcctcttcgaccgaagcgacggttttcacagcgaggatgtagtctaaaaactcggtatcgaaatcgtctgcacccgccgcttcgccgccgatatgccgcgccgcctgcggatccaaacggaagcggatgggcggcagtccggcttctatgcggtcgcgaaccaacagccgttcgagcttgggcaggaagtcggcagcaatgtcttcatgtaccagcagcacttccatcgagttgcacacggacggacggctggttttggcgttgtacacgatacggagcgccttgtcccaatccgcgtccttgtcgatataaatgtggacaatgcccgttcccgtttcaatgaccggcacgacggcattttcaaccaccgcccgtatcagccccgccccgccgcgcggaatcagcaggtctagataatctttcgccctcatcatttcgtaactgctttcgcgcccggtgtcttcaatcagttggagcgcgtcggggtcgatgcgggtttgcgccaaccccgttttcagggcggcaacgatggcgcgtgcggattggaatgcatctttgccgctgcggagtacgaccgcgctgccgcttttcagtgccaaagccgccgcatcggaagtaacgttcgggcggctttcgtaaataatgccgataacgcccatcgccacgcgctttttgacgatttccaagccgttgggcaaagtcgaggtttccagtatttcgcccacggggttgggcagcgcggcaaccgccctgatgccgtccgccatcgcgcaaatgcgtttgccgtccaacaaaaggcggtcggtcatgctttcgggaatgttgcctgccgcggcttccaagtcttgacggtttgccgccaaaatatctgccgtcgccgcttccaagctgtccgccatcgcaagcagcgcgcggtttttttcttccgtatccgccgtgttgacggatttttttgccgctttggcaagggcaagctgtttttgtgtgtttgacatgggtttccttttctaaaattcggtcagaagcaggcgtatttcgggcgtgatggaaatccagtcgtcccgatggatgaacacgcctttcgccttacgcgatttgagcaggtcttcggcggcggcagagccgaacaggacgcgccctttgcccaggggctgtttggttgccttgctgtacacggttacggtgtccatacgggaaaaatgcccttcgattccggcaatgcccgacatcagcaggcttttcccctgttcggacaaagcgtgttccgcaccttcgtccacataaacgctgccccggctttcggaatagaacgccagccattgcttctgcgtccgcaaacctttggcacgggggacgaaaaacgagccgtccgcctgatgttcggcagcttcggcaagtgcatcgggtttgagcgaggaacagatatacaccggtacgccggattcggcggcgatggttgccgctttgattttggtcagcataccgcccgtgccgtttgccgaacccgagccgcccgccatttcgatgatttcatggttgatgtgttcgattttgtccagccgtacggcatcgggattgctgttcgggttgcccgtgtaaagaccgtctatgtcggtcagcagcaccaagaggtctgcctgtatcatcgccgccacttgcgcactcaatgtgtcgttgtcgccgattttcaattcctcaaccgaaaccgtatcgttttcattgatgatggggacggcgcggcgttgcagcagcacggaaagtgcgccgccggcattttggtagcggcgtttgtcggcaaagtcggcgcggctgagcaggatttgcgcggacacgatgccgtctgaagacaggtttgccgtatattcttccatcagcagcccctgcccgacggcggcggaagcctgtttgtcggcgattttgaccggacgttttttgaaacccagcgcaccgaaccctgccgcaaccgcgccggaagacaccaagaccagctcgtgtcccgcatgatgcaatgcggcaagctggcaggtgatggtttggattttgccgcgcgagagactgccgtccgaatgggtaatcgaagatgtgccgactttaaatacgattcttttgtatttcattgtttccgtccttgttggtttgtcctgtctcgttgccaccttgtgccgccgaatttgccctgttctgccgcaattgtcaacaatcacgccgcgtctgcaataaaatggacaaaatgtataaaattaataaaatctatggcggcttattgagatttttcaaatttatattgccgttttgtccaaaatgcgtataatcctgtccatatttctgctgtaggctgatttattttagacaaggactaccatgcaattagatatagaccgcttggttgcttatttcggcggcgtgaacgcgcttgccgaagcgttgaaacagcacgatcccgaaaatgccgcgacgaccgccgccatctataaatggcgcacgcgcggctcgctgcctctggcgcaactgcaaaagctgaccgcgttggcggaagcgcaaggcaggccgctggatttgaatgcttttttacaaaaaaacgaatctctggagagaacagaaatgacacagaccaaccgcgttatcattttcgacaccaccctgcgcgacggcgaacaatcgcccggcgccgctatgaccaaagaggaaaaaatccgcgtcgcccgccagctggaaaaattgggtgtggacatcatcgaagcgggttttgccgctgccagcccgggcgatttcgaggcggtcaatgcgattgcgaaaaccattaccaaatcaacggtctgttcattgtcccgcgccatcgagcgggacatccgtcaggcgggtgaggccgttgcgcccgcgccgaaaaaacgcatccacaccttcatcgccaccagccccatccatatggagtacaaattgaagatgaagccgaagcaggtgattgaggcggcggtcaaagcggtgaaaatcgctcgtgaatacaccgacgatgtggaattttcctgcgaagacgcgttgcgttcggaaatcgatttccttgccgaaatctgcggcgcggtgattgaagcgggcgcgaccaccatcaatattcccgataccgtcggctattccatcccgtataaaaccgaagaatttttccgcgaactgattgccaaaacgcccaacggcggcaaagtcgtttggtcggcacactgccacaacgatttgggcttggcggttgccaattcgcttgccgcattaaaaggcggcgcgcgtcaggtggaatgtactgtcaacggcttgggcgaacgtgcaggcaatgcttcggttgaagaaatcgtgatggcgttgaaagtgcgccacgacttgttcggcttggaaaccggcatcgataccacgcaaatcgtgccttcgtccaaactggtgtccaccattacgggctatcccgtgcagcccaacaaagccattgtcggtgccaatgccttttcgcatgaatcgggcatccatcaggacggggtgctgaaacaccgcgaaacttacgagattatgtccgccgaatcggtcggctgggcaacaaaccgtttgagcttgggcaaattgtccggccgcaacgccttcaaaaccaagctggcggatttgggcatcgagttggaaagcgaagaggcactgaacgcggcatttgcacgcttcaaagaactcgccgacaaaaaacgcgaaatcttcgatgaagacctgcacgcactggtatccgacgaaatgggcagcatgaatgccgagagctacaaattcatctcccaaaaaatcagcaccgaaaccggagaagaaccgcgcgccgacatcgtgttcagcatcaaaggtgaagaaaaacgcgcttccgcaaccggttccggccccgtggatgcgattttcaaagcgattgaaagcgtggcgcaaagcggcgcggctttgcagatttattccgtcaacgccgtcacgcaaggtacggaaagccagggcgaaaccagcgtccgtctggcgcgcggcaaccgcgtcgtcaacggtcagggcgcggataccgacgttttggtcgccaccgccaaagcctacctttccgctttgagcaagctggaatttagtgccgccaaaccgaaagcgcagggcagcggtacgatttgagcgtgaaaacagacgatgccgtctgaagcataaaaaggcttcagacggcattgcggcgataatagggcgcaaaacccatttgaaaaggaaaatgatggattcccgaaaatttaccgaagcatccaaacggcggttgagcgaattgttggatgccaaaagcgaacaaggcaacacgatgcgttgcgacgaggttcaaggttttatgacggcgctgttgagcgggccggacaaattgacaccgctcgactggctgcccgaagtgttgggcgacgaatcgcaatttaccgccgccgaacgttccgaaatcgaacggctggttttggcaatggcgatggaaacaaccgccgcgatgtcggataaaaaactgcccgatttgtggctgtatgaaaacgaagacggcggcagcgatttttacacatggtgcaatgcttatctttacggtttggatattgtgccgaccgattggtttgaagccgtcgatgatgaagcgtttgaagagttgttttatcccatcatggcattgggcggtatttacgacgaagaggaaaacggcgctatccgtctgcaattcacagaaggcgagctggcggaactggaatccgagttgccttatgcattggcggatatctaccgctactggcaggcagtcatcaacaaaccgcaaaccgtccgcagggaaggcgaaaaaacaggcaggaacgatccctgtccgtgcggcagcggcagaaaatacaaggcgtgttgcggtaagaattgaagcgtttgtttccatgaaccaaacgtaaaaataccgtctgaaaccggatttccatgtttcagacggtatttttcacaggcggtcagtgctgttttttcatgccgaaccggacaaagccgacgatacccaaaacaatcatcgggacgctcaaccattgccccatcgacagccccaaggtcagcagcccgagatagtcgtcgggttggcgtgcgaattcggcaatgaagcggaatatgccgtagccgccgaggaagagcgaggcgacttgtccggtcgaccgctgttttttagagaacagccaaatgacggtgaacaggcagatgccttcaagtgcaaactgataaagctgcgagggatgacgcggcagcataccgtattgttgcagccattctgcccaaagcggattgtgcgcggcggcttcggcatcttcgtaacgcgcctgcgggaagcccattgcccaaaatgcgttgatgtcggtaacgcgtccccaaagttcgccgttgatgaagttgccgatacgtcccgaagcgagacccagcggaacgagcggtgcgaccgtatccatcagtttgaggaagccgatgccgtgtttgcggccgaacaaccgtatggcaataactacacccaaaaagccgccgtggaacgacattccgccttcccataccttgaaaatatcaagcggatgggcgaggtagtcggaaaacttgtaaaacaggacgtaacccaaacgcccgcccaaaattacgcccaaaatgccccatgtcaggaagtcgtcgagcgattctttggtaaaaacggacaagccttgcgcgatgcgccttctgccgagaaaggtaaaaagaataaatccgaggatgtagcttagggcataccagcggacggcaagcgggccgatactgataaggacgggatcgaattggggatgggtaatcataacgggctttcgttttcaaatgccgtctgaaaggcatgatgcttcagacggcatttctgcaataagggtttcagcgcaaatcgccgatgacgttgaggatagcggacaacgcggcttcgcccagccgtaaagaacgctgaccgttccagccgaagtcgtcgtcgggcagattggcattgtctttgaacggcatttccagcgtataggcaaggcagttgaaacggttgccgacccagttggtcgccaaggtcatattcgcttcgcccggcgcatctttttcgtaaccgtattcgtcttggaaatcggggctggcgtttaaaagggcatttttaaactgcgcttccaacgcggcgatgcgcggattgtagttcggcacgccttccgtacctgcgacaaagacaaagggcagcccttcgtcgccgtggatgtccaaaaacaaatccactccggtttccagcattttttcgcgcacgaagaacacttccgggcttttttctaccgtcgggttttcccactcgcggttgaggttcgcgccggcggcgttggtacgaaggttgcccagtgccgaaccgtcggggttcatattggggacgatatagaacgtggcgcggtcgagcaaggcgcgggcggtagggtcttgcgggtcgagtaatctgccgagcagcccctcgataaaccattccgccatggtttctcccggatgctggcgggcggtaatccagattttcaaatcgctttcgacctgattgcctatggtcagcagattgatgtcgcgcccttgcacggtgctgcccaagtcgtcgatgcggcacaggccgctgccttgcgcgtcgccgaggaggtttaaatgctgttcttcggagtaaggttcgaaataggcgtaatacacgctgttggacagcggagtatgattgacggtcagtacgccgttttcgtaggaagtcggtacgcggaaccagttgcggcggtcgtatgaggcacacgcctgatagccttcccagcctttcgggtaggcggcttctgccgcgttttcaaaatgcatgatgcagttttgatatgccgcgccttgcagccggaagtagaaccattgtgcaaaatcggaggcgttgtcgggacgcagggcgaggcggatgttggaaggatcggtcaggtctttgacgacgaccgagccggcatcgaagcgggtgctgattttaatcatgggaaagtccttgctgtcgccggtttctcgaaccggataaaccgcgattttaccgcccgtatcgcaaggcttcaacctgcccgaaagtctgccggatgccgtctgaagattgtttcagacggcgtttggcgttaacataagccgaaattgtcaacaatagggagccgttatggagtctgaaaacattatttccgccgccgacaaggcgcgtatccttgccgaagcgctgccttacatccgccggttttccggttcggtcgccgtcatcaaatacggcggcaacgcgatgaccgaacctgccttgaaagaagggtttgcccgcgatgtcgtgctgctgaagctggtcggcattcatcccgtcatcgttcacggcggcgggccgcagatcaatgcgatgcttgaaaaagtcggcaaaaagggtgagtttgtccaaggaatgcgcgttaccgacaaagaggcgatggatattgtcgaaatggtgttgggcgggcatgtcaataaagaaatcgtgtcgatgattaacacatatggcggacacgcggtcggcgtaagcggacgcgacgaccatttcattaaggcgaagaaacttttgatcgatacgcccgaacagaatggcgtggacatcggacaggtcggtacggtggaaagcatcgataccggtttggttaaagggctgatagaacgtggctgcattcccgtcgtcgcccccgtcggcgtaggtgaaaaaggcgaagcgttcaacatcaacgccgatttggtagcaggcaaattggcggaagaattgaacgccgaaaaactcttgatgatgacgaatatcgccggtgtgatggacaaaacgggcaatctgctgaccaaactcacgccgaaacggattgatgaactgattgccgacggcacgctgtatggcggtatgctgccgaaaatcgcttctgcggtcgaagccgccgtcaacggtgtgaaagccacgcatatcatcgacggcaggttgcccaacgcgcttttgctggaaatctttaccgatgccggtatcggttcgatgattttgggcggtggggaagatgcctgaagcaaagtcggaaaatgccggctttggcggaaaacctgtttgtctggtttctgtttttggggtttcgggcaatttccaaaccgtcattcctgaaaaaatatagtggattaacaaaaaccagtacggcgttgcctcgccttagctcaaagagaacgattctctaaggtgctgaagcaccaagtgaatcggttccgtactatttgtactgtctgcggcttcgtcgccttgtcctgatttttgttaatccactatagaaacaaaaacagaagcctaagatccgtcattcccgccgggcatctggttttttgaaatccggttgtttgggataaattctccggctttgattttttgtttttccgataacgccataactttgaaatttcgtcattcccgcgcaggcgggaatctagacctgtcggcacggaaacttatcgggaaaaaaggtttctttagattttatagtggattaacaaaaaccagtacggcgttgcctcgccttagctcaaagagaacgattctctaaggtgctgaagcaccaagtgaatcggttccgtactatttgtactgtctgcggcttggtcgccttgtcctgatttttgttaatccactatacgtcctagattcccactttcgtgggaatgacgggatgtgggtttttgtgcggatttgaaccggtaagggtggtgtgggattggtggtttgcttaggatcttttggattgtattttgtatatacatttacttgttgataaaagataaaataaaattagaaactaaaagtgagaaaaaattaataataatagggatgtataaatgtaaaggctccgtttcatagctaaggttatctgaatatatggaaaaaaagtaaaagtccataaaactaaaatatatagataatgctaatgataatagaattatcactttcctagagtaaggataatatttttttatcgtaaaaaaatataaaataggataaataattgccatatagatagattttgtaacaaaattaaaaataaataataaaaataatgtaataaagtatattttttggctatgaaataaaattgtacataattgaacgagcagatcaaaaaatgaactacatataacaataaataataacgtatttaccatactaaatttaataggtctcattatcatatttaataaccacttcatagtatagtggattaaatttaaaccagtacagcgttgcctcgccttgccgtactatctgtactgtctgcggctttgtcgccttgtcctgatttaaatttaatccactataaatgcagagtgggtggaaacactcactttatggtttgctacgctctgctcaattagcaacccgataacccaatatggataatagggtaattaatccaatctaatttgtcagcatccgttaatttattgcaaaataaagtattgaattatgtcgggtgcaaatgacgaaatataagtttccgtgcggacggatcaagattcccactttcgtgggaatgacggtggaaagattgttgtttttcccgatgaattcctgtgttttttgtttttccggataaattcctgtggctttgagttttttggatttcagcctcaatgccgtctgaacgccgaatcgggcttcagacggcattgcgtcatttgaaattcaaaaccggccagcctttttctttggcttctttttccagctcggcatcggggttgacggcgacgggttcgctgacaaggcgcagcagcggcaggtcgtttttggagtcgctgtaaaaataggttttgccgtagctttggagcgtttcgccgcgttcggcaagccattggttcaggcgggtgattttgccttctttgaggctgggcgtgccgatgtaattgccggtgtagcggccgtcagaaccggtttcgagttgtgtgccgatgatgttggtgatgccgaaaaggtggcagacgggggtgatgatgaactcgttggttgaggaaatcacaagggtttcgtcgcctgccatttggtggctctgcaccagcatacgctgcataggcgagatgtgggggatgatgtattccgccataaattcgcggtgaaactctgccagctcttctttgctgtaacgagcgagcggggcaaggtggaatttgaggaatgcgtcgatgtcgaggcagccgttttggtagtcgcggtagaatttttcgttttgcgcttcggtttcggcagcgtcaaccaagccttttttgatgaggtattgcggccaggcgtggtcggaatcggtgttgatgagggtgttgtcgaggtcgaagatggcgaggtttttcattgggtttcctgttgtttcaaaagctggcgcaaaagcggcagggtgatgcgtttgcccatcgtgacggcgtagttgtccagcgtgtcgagcatcatcatcaggctgtccatatcgcgccgccagtgtttgagcaggtattcgaaaatttcggaatcgacggttacttggcgtgccgccgccatactggcgagcgcgtcgattttttcttggtcggttaagggtttgacttcgtaaacgaggcagtacgccatacgcgtccgcaaatcttcgcggatgacaagctgctggggcgtgtattccgaaccgagcagcaaaaagcctttgccgctgttgcggaagcggttgaagatggaaaaaagcagggcttgttcttcgttgcccagtttttcgacttgatcgacggcgaggtattccgcctcgaacgcggcatcggtcagcggcatggaggcggcatcgatataggcggcgtttttgccggcttcgagcgcctgtgcgacccacgcctgcaaaagatggcttttgcccgcgccttcttcaccccagacatagataaactgtccgtgtttgtgtcggaggacatagaccagttccgcgttttccgtgccgaggaatttgtcgaaactcggatagtcgtgtgcggcaaagtcgaaaataagctggttcacggttcggcattccgaggggtggtaaacgggtttattgtacgttgttttcgcgcgcctttccaatttgaacgatgccgtctgaaaacggcttcagacggcatcgttcaaccgcaggcaacgttgccgacatcgaggcgcatattgtggaacgcgttgagcgtgctgcggtggccgatgctgatgatgatgctgtcgggcagtttttgtttcagtgcgcggtagagcagggcctcggtcggttcgtccaaagcggcggtggcttcgtcgagcaggacgattttgggcttggaaagcagggcgcggacgaaggcgacgcgttgcagttcgcccggggagagtttgtgttgccagtcgtcggttttatctaatttatcaaccagataacccaagcggcaggtgttcatggcttcggctaactcgggatgctgcttgtcaatgtcggggtaacaaaccgcgtcgcgcaggctgccctgtgccgtgtacgggcgttgcggcaggaagaggatgtcttgatgcggcggacggctgactttgccgctgctgccgaacggccaaagccccgccagcgcgcgcaacagcgaggttttgccgcaaccgctcgggccgcgtatcagcagggaatcgccgtttttgaggtttatgttgatgccgctcaacaggatttcgccgttgtggcggaacagagcgacgttttcctgtgggggactgttagtttttgcacaaggaacaaatagagtaaaaaaacgctgaaatcttcggaagacgtggatttcggcgtttttttgtatccggaaaagttacgccagctttttcacaaaaccgcgccggaatgcgcggttttctgtttaaagctgacgagattagggaatttttaaaactgttttaagaggtttttaaaatggatttaatcaatactccggccataccattcaacacggcctatgatggcgatgtcgtcttgggcattgctcaaatctatttcaaacggtgcgtaacgtggattttcagacgttacaagcagtttgcccggtatacgttgcacacgtttgacaaagaggtcattgcctatacgcaagacatataggccgtcacgcgggtcagtttcggcgtggttgatgagaatggaatcctcatgattgagcacgccctccattgaatcgcctttaacggtaattacagacagtttttccggctgtttggtcacatagttgtcaatccaatatttccggaaagccaagcagaataaaggttcttcgccgaagactggtgcgccataccctgctgctgcggctacgttgtagcgcggcacgaatacaaactcggacaggtcgacaggattgcccatagtgtcggtgattccatcagaatttctacttacagagaatgctccggcgttttccggcctggctttatcgagatacggcaagccttttccggtcagcagccagtttaaatcacaactgaatttttactaggtaatcggctgttgggatagctccctctttccaaactctattaaatccagaagccgacatttctattttgttatagatgtcagatggcttagccccatgaggccaaagaaatttgagcctatctaaaaaagtatccatagtaatcctaatttaactcatttaagcaaaacattaagcaaaaaaagaaactcttttgcttaaataagattactcaaataatcaatattttgtaaaaataattacgtttttgagaaaatattttagcaaaagagtttcatgaagctgttttgctaaatgtaattcactcatttgctaaatgacggcggttaataaacctacttaattaaggaattgcgagaatgaaaaaaagcaagaaagcatgactgattggcatcgtgctgacattgtggctcgtcttaaaaaggcaggctggtctgtgagagcgttatctatcgaggctaatttagcaccaaatacattagggaaagctttagatgctccttatctgaaaggcgaaagaatcattgcagcagcgattggagtacccgcagaagaaatctggccatctcgttttgagaaacgaaaccataagccaaccttcccaagatctataaatagataactgttttgctaaatagttccaaaagagtaccgcatttaagcaaaaatagaaagcggaaaaaatgaaaatatctgcatctgatattgcgaaattaggaattccgagcctaccaactgatagacaagggattgaataccatgccaagaaaaataattggcaacactgttttgagcaaaaaggaagaggccgtcctaaaaaactgtatgaaatcgcttccctccctgccgaaatccgagcagccatcatgaaacggcagtcggacgagctggcggagaagatgccgaaaatgctgcccaaagtcagaccggggacggcgatgtcggctcaagcactggctgaagcggccaagctgttgaacgagaaacaacggtcggtggcggatgcgcgatgtgcggtggtagcggcggtattggggattaaatacgaatacgattgctctgccaaggctgcggtggctcagtttttgggcttgctggcagaaggtaaattggacgcggtcacgcttgggaacttggaaaaggccaatgaccgcagccggacggcgaaggtcggcgaacgtactttagacggctggatttctgcttatttgaaagcggaaaacgcgacggagcggttggttgctttggctccgaagacgacgaaggcggtcaagccgattgaaagttacggatggttgccgatgtttatgcagtttcacaatattccgtccgcgccaaagctggcgcacagctaccgctggtttgtgcagtgggcggaagcggaaaatatgccggtcaatgatgtgcctaacttgagtatggtgcggcgcgtttgggaaaagctcccgttgattatgcaggagcgcggcaggaaaacgggggcggcttataaatcgctgctgccttatgtgaaacgtgattggggggctttgaagccgaacgatgtttggatcggcgacggccatagctttaaggcaaaggtggcgcatccggtacatggcagaccatttaagccggaagtgacggtgattattgatggttgtacgcggtttgtggtcgggttttcggtctctcttgctgaaagttgtgtggcggtatcggacgctatgcgtatcggggtcaagcattttggtttgccgattatctattactcggataacggcggcggccaaaccggcaagacgatagaccatgaaatcacgggtattacgtcccgaccgggtatccgccatgaaacgggtatcgcgggcaacccgcaagggcgcggcatcattgagcgatggtggaaagacaatctgattgagatggcgcgccagtatgagacgtttgcgggtgcagggatggacagcagcacgaagaacctgatgtaccgcaagatggaaagtgcgtttaacgctttggaaaaaggcaaggatttgacggaggaacaacagaaatatttgaaaaaactgccgagctggtcgcgttttatagcggatgtggtcaagtgtatcgacgaatacaacaaccgcccgcacggcgagctgccccgacatcctgacggcgggcattatacgcctaaggcttatcgggaaatgaggctggaacaggacggtatcgcgccggatatgttgtcggcgcaagagctggcgacgatgtttatgccgcaagaggtgcgaaaggtacagcgcggttggctggatttgtttaacaactcttatttctcaaccgagctggcggagtatcacaaagacgaggtacgggtcagctacgatttgagcgatgcgtcggcggtcaatgtgtttgatatggacggcaagtttattactaaggcgcaggccaacggcaatacccgcgaggctttcccgacggctcgtatcgaccaactggcggaaaaacgtcgaaaaggcaaaataaagcgggcggaaaatgcaatcaagctcgcaaacgcggaagtcaatcctgctctggaacaggctgcggtttgggacgagctgggacatttgggcggaaacgacatcgaggcggagtatgcggtattgccgaaaacgggcacagacgattttgtgttgtttgaggcggatagataaaggaaaacatgatggacaaacagcaaaatgcagcgttttcggccgagcttgttgaaaaattgaaactcaagcgagctcttgggcggattcaacgagctcaagcaaagattcaaggtgttcccgctgaacggaatcaggctcaaacgtttttgcctgcgcttgaaggaaactgcgaacctgctcaatcgaagtcggctcttgacgggtaatccgctggagcagccaggaaagtacgaaagaatcggcaagtgacctgtcttccaagtcttgaacggcgacttccagcatgatcaggcgtttttctaaatcgggaaactctttcatttcagacggcctttaaaggttgtttaaaactcaaggatattaaaaatgaaacaaattaatcaagcattgcaacaaaaactggttgaatttaaagaaaaatcaggcatgaaccaaacccaactggcacgcggtatcggtacttcgccggcatccatcagtatgtatctgaacggcacttatgcggaaaaaggcggcaattatgaaaccatcgagccgaaaatcgaggcgtttttggagatgcaggacagtaaagcgcaacgcgaagagctggtgttgggttttgtatcgactaagacgacccgccgtattgcagaagtgatgcgcgatgcgcacgaaggcggcgaaacagtggtgatctacggtcaggcgggattgggcaagactcaggcggtcaaaaactactgcgagaaaaaccctgcggccatcttgattgaggctaatccgagctttacggctttggtcttgatgcgcaagttggcgactgcggcgaaggtatcggcgatgggcagcctgaatgatttgtttgagtctgtatctgaccgcctgcgcgattcgggccgtctgattgtggtcgatgaagcggaaaacctgcctttacgcgcccttgaaattgtacgccgtctgcacgacgagactggctgcggcttggtgttgagcggtatgccccgactggtggccaacctgcgcggtaagcatggcgaactggtacagctttacagccgcgtgtctgttgcgctgaatttgggcgaatctttgccggatgacgaactctttgagattgcgaaagcggctttgcctgatgcggtcaagcatctgctccctgatagtgtacaagcgttgattacggtcatcgggtttaatgaaacgctggagctggtgcgcctgatgggcggtacgacttatcctttgcggcagggttatacgaaaaacagtcaatcccgtgttgcatacttggaagagattatcggcagtgaggcggccggtcggctggtggaggcaatggctccgtgcaatctgtttataccccgttgcgagacggccttgtatgagttgcgaaaccgtaaaatccgcagtcagtttgaccggcagacggcaggcggtacccctgcttatgaggccgttaacgatttggccttggcacaccgcctaagcgaccgccatgtgtggcgaattttaaagcaggcggataaggaagcggagcaggagaatttgttttagaatggaatgccatgcagatgtatggcattttattttggagaaaaatatgaaaaagttttattttgtgctgctggcgttgggtttggcagcgtgtgggcaagaacaatcgcagaaagctgatgcggagcagtatttttttgccaataaatatcaatttgcagatgagaaacaggctttttattttgaacgcgccgcccgtttccgtgtattgcaacaaggccttggcggggattttgagaggtttttaaaaggagaaatacctaatcaagaaaatcttgcaaagtatcgtgaaaatattactcaagcagtcgcttattatgcggacacgaatggagatgatgacccataccgcgtctgcaaacaggctgcgcaagatgcagaaatcctgatgaagagtatggtaacaagcggtggaggcggtacaactgatttagataaggaaagttatcaaaattaccgaaaatcaatgcaagaatgccgtaaaacaataacggaagctgaagccaatttgccgaaaaaataaaataaacgattctaaggccgtctgaacaacaggcggcttttttgttgcctactgacactgtttcgcccgctgcaaaagccatgccgtttgaaaatgtaagcctctgaaagtgcattttaatctgattttgagggaggctttaatgagcaaaattatttgtctgactgccggacacagtaacaccgacccgggcgcagtcaacggaagcgaccgtgaggcggacttggcgcaggatatgcgcaacattgtggcttcaatcctgcgtaacgattacggcctgaccgttaaaaccgacggcacgggcaaaggcaatatgccgctgcgcgatgcggtcaagctgattcgcggctcggatgtggcgattgagttccacaccaatgcggcggcgaacaaaacggcgacaggcatcgaagccttgtccacgccgaaaaataaacgctggtgtcaggtgctgggcaaagccgttgccaagaaaaccggctggaaactgcgcggcgaagacggctttaagccggataacgcagggcaacattcgcgcctggcttatgcgcaggcaggcggcattgtgtttgagccttttttcatcagcaacgacactgatttggccttgtttaagacgaccaaatggggcatctgccgcgcgattgcggacgcgattgcgatggaattgggagcggcgaaggtatgaaaaagtctttgattgctttatgtgttgcccattgtgcaaagttgaaaaacgattttggcgtaccaccgttacctgaaatcaaaatcacgccaagccctgttcgggtaggctctttgaaacaacatccgagcctgcgcttgggtaaatcaggcgtggcggctgctaaacgtgcggcgcgcaaacgcaagaatcgtcgttaatcatgggacaggttgcgttttacgaaaagatgattgggctgtggtcggccaaaagccgtgaggcaagcgaacaggcggacttggctgcgtttgaatttgcggagggcgaactggccaattatcgggaaatgctgaaacggcacctgcaaaccaaaagtgtggaatagcaatgcgtattttggatatttttaaaaacccggcgacaggcaatgtgtcgcactcgaaactgtgggcaaacgttgcctgcgcggctgggacgtttaagtttgtgatgttgcccgatccgtcggcggaaatttgggcggtgtatttgggcattgtcggcggctatgcggtggcgcgttcatttgtcagcgtgaagcgtcaggaggtcgagaatgaatctcgtgaaactgctggcgaataactggcaaccgattgccattatcgcgcttgtcggcacgggcttggctgtgtcgcaccatcaaggctacaagtcggcatttgcgaagcagcaggcggtcatcgacaagatggagcgcgacaaggcgcaagccctgctgttgtcggctcaaaactatgcgcgcgaactggaactggcacgcgcggaagctaaaaaatatgaagtcaaggcgcacgctgtcggcatggctttggcgaaaaaacaggcggaagtcagccgtctgaaaacggaaaataaaaaggaaatcgaaaatgtccttactcaagaccgtaaaaatgcaagcggcggttgcattgacggctttggctctcacggcctgcagctctacaaccgcgccctcggctacggaaattaaggttgtcgaaaaggcagtcatgccgaccccgcctgctgcattgatggtcgcgccggtacgcccgaatccgccgaaagacggcaagacggccacgctgttggaacacgccgctgagtttggtggctatgtggcggagttggaaaatcaaaatcaggcttggcgcgactgggcgggcaatcactcccgcaaagtcggaaactgacaaaaaagcccgcgtagggcgcgggctgagggtgaaagcggattttatacctcttttacaggggtagcggcggtagtgcttttcagcaaatcgactgcgtgctgacagttttgcttgctggtgtagccttcgccctgagcgatgatttcatggttggctgctttcaaacgccaacggtattcgccttttgcgtctttatagatttcaaaatacataaggtttctcctatgaatgagtacacgttttcttaccgctttaacggcaagtcctggtcattgagcatttgggcggacaaccctgaagaagccagggcgaaatttcgggctgcacgagaaaatgcgcactatgacggcgaagttgtagcaaaggtttatacatttgtaaatatttcgtgggttaagaaattgtacaagcggacaaaatatttaatgggtatcaaagaatgacctaccgtgaattagttgaacgtcagttggctgtgcgccatgccgatttggaattgggcttaagccgcgcacgcgagcaagagccgtttgtcattcatgtttccgatctgttggataaggcaggcattgagtacgcggtacgcatggataaggattttcagacgacgtttcaccttgaatatccaattacgaactatgacacctttaaacgtgcggtttggcaaactttgggggcgtattactgtgtttgtaatgatggtgatggactggagattgccagcaatcgccctgacggttacgccgtccgtatcgtattcggcgatgtgccggtttaaaggggttttaaatggactttgaatttggtttcagaaccctgtggccgattgcgacggcggcattttggttttgggtcaacggcatttcaggccgcctgaaagaggcggacaagcgtatcgacgaccttaaagaggagttgcacgcggtcaagctctcttatcacaccaaggcggacgccaaggcagacagcactaatattgcggcggccttggagcgaattgaaaacaagttagaaaaagtaaacgaaaaactggacaggaaagcagacaaatcatgagcgacccgattttggatgccttggcgcgtattgaaaacaagactgatcaaacgctgaaaaatcagaaggaaatgcaggcggaaattgcgcaaattcgccaagacacgaaacgcacggccattacattcggcgcactgggcggcggcgtgattacggtcggctgggaattgcttaaagcgaaaatgggactgtaattatggctcacccgcaagaaatccgtgaaaagttacgccggctctatgtgagcggcgagcaaactttggaaacggcggccttgatgtgcgaaatcccgcagaccactgcgcgtgcgtggaaacgtgcggataaggaaaaaggcgacgactgggataagatgcgcgccgcttacactttggccggtggcggtattgaggatttgagccgtgcgatgttggccggttttatggtgcagtacaacagcacgatgacgatgctgcaggattcgagtaccgaagatttgccaccatccgaccgcgccaagctgttggccagcctggccgatgcgtttacgaaaaccgtatcggccaatgcgcgtgtgatgccggaaacgtcaaaactggcgacggctttggaattgattgagttcttgatggcgtttgtacaagaaaaacatcccaaacatttgcctgcctttgtggaggtattggagccgtttggggtggaagtggagaagaagtttggttagaggccaacaaatttttttaaaagagtaatgagggtggcggcagggatagcattaattgcattttccgtaagcgtacttaatgcagtgtccttgattttccctaattcttttttcaaccagcttttttctgaatcagaaatctctgcttggtctatttttgccgcaattaaagcctgaatagtgtcgctgtgtagtttgactgtgacaacaccaagaatggcggataggccgccatcatcggtaaggaagtctatgcccttatgattaattttgcagtcaaaatttttatgaagtgaatctatcgaagtaatttcaattaaaccagattcttctaagtaataaatattttttaaaaaatattggaattcatctgattgtaaagttgctaggtgttgactttgaatttcacaaccaagagtcaaagccaagcccaatccttgtttatcaacagggatgttagaagtaataggtaaagaactactagggaaaagagagttatacaccttggttgcttttaggcagttcgggtaattatcacttaaaactcgtaagattttttcctgaatacctctatttaaccagttcataaattattcctcatgaaaacaaaagaattcctcaaatcccttgccgaactggccgccagtttgcgccaagtcatcgaagcggaagtggacggcttcgatgcgtcgcccaaggctattgctgcacgccgtgccaaggtgtttgacccggtaggcggttacgagtatttcgtgaatacctacttcccccattatatccgctcgcctgagaaatccgaactgcatgcgtttttattcagccgtctgccggagattatccgctcccccaaaggggaaaatgaggcggtgggtgcgccgcgtggagagggtaagtcgacgaaggttactcagttgtttacgctgtggtgtattgtgaccggccaaaaacattatgctgttattgtgatggacagtatcgaccaggcatatccgatgctggaagccatcaaggcggaacttgaatttaacccgcgcttgaaaaccgactttccggaagtatgcgggcagggccgtgtatggcaggccggtacgattgtgacggccaatgacgttaaagtccaagtggccggtagcggtaaaaagctgcgcggtttgcgtcacggcccttaccgtcctgacttaactgttttggacgatattgagaatgacgagcaagtccgcaaccccgaacagcgcgacaagctcaatgcgtggctgactaagaccgtattgcctctgggcggtgtcggtcagaaatacgatgtgatttatatcggcacgattttgcattacgacagcgtacttaaccgcactttgaataacccgttttggcacggtattaagtttaaggcgatgaaacgctggcctgaccgcatggatttgtgggacaggtgggaggaacttttccgaaacgacggcgagacggtggccgaggcgttttatcaggcaaacaaagacgagatggagcgcggcgcggtcacttcttgggcggcgcgtggcgtactcgcgctgatgaaaatccgtgcgcgtgacggccatgcgacgtttgattcagaatatcaaaacgatccggtcagtggcgaagatgcgccgtttgccaagtcgatgaagttttggaacgacctgccgtccgatttggtgtatttcggtgcgctcgacccgtcactcggaaaggccggggcgagccgtgacccgtccgcgattatcattggcggttatcaacgtgtaaccggcaaactgtatgtcgtggaggctcagattaaaaaacgtctccctgatttgattattgaggacgttattcgattgcaccgtcaatatcgttgcaaactgtggtttgttgagactgttcaatttcaggaatttctgaaagacgagctggtcaagcgcagcgcggcgcgtggaatacctgtcccagcgcgggcggtcaaaccggtatcggacaagctgttgcggatcgagactttacagcctcacatggcgaacggtttgattctgttgaatgagagccaacaaacgctgatacagcagttccgccattttccaaaggctgatcatgatgatggtcctgatgccgtgcatatgctctggtcgggggcggtggccaattgtgtgccgatagaatggcaaagccctaccgataacgattttgatgacgagataaaaagtaaatggagccgataatggcaaaaaagaacaataaaactaaaatccaaaagcccgaagctgcattgcagacggacgtggctcaaattacggcgaccggtcgggttatcgccgagcatccgtccaattttattacgccgcaaaagatgcgggccctcttcgaggacgcagaaagcggcgacatccgcgcccaacacgagcttttcgcggacattgaggagcgcgacagcgacatcgcggcaaatatggggacgcgcaaacgcgcgctgctgacgctcaactggcgcgtcgccccgccgcgaaatgcgacgcccgaagaagaaaagctgtccgaccaagcctacgaaatgatggacagcctgcctaccctcgaagacctgattatggatttgatggacgcggtagggcacggattttctgcgttggaggtcgagtgggtattttcagacggcctttacctaccccgaaactttatccaccgcccgcaaagctggttcaaatgggacaaagacaacgggctgctgctgcgtacccgcgaaaatccggaaggcgaagcgttgtggccgctgggctgggtcgttcatacccaaaaatcgcgcagcgtccagcaggcgcgcaacgggcttttccgcacgctttcctggctgtatatgttcaaacactacgccgtccacgattttgccgagtttttggagctgtacggcatgcccatccgtatcggcaaatacggcgcgggcgcaaccaaagaggaaaaaaacaccctgcttcgagcggtggcggaaatcggtcacaacgcggcaggcatcatgccagaaggtatggaaatagagctccacaacgcggcaaacggtacgacggcaaccagcaatccgtttttgcagatggccgactggtgcgaaaaatcggcggcgcggctgattttggggcaaacgctgaccagcggtgcggacggaaaatccagcaccaacgcgctgggcaatatccacaacgaggtacgccgcgatttgctggtgtcggacgcaaaacaggtggcgcaaaccatcacaagccaaatcatcggaccgttcctgcaaatcaactatccccatgccgacccaaaccgcgtgccgaaatttgaatttgacacgcgcgagccgaaagacatcgcggtctttgccgacgctatcccgaaactggtggatgtcggcgtacaaatccccgaaagctgggtgcgcgacaaactggtcattccagatgtgcaggagggtgaggctgtgttggtgcggcaggtaccggacaatccggtaaacagaactgcattggcggctttatccgcccacaccgtaccatctaaggctacgggcaggcatcaggaaatattggacggcgcgttggatgacgcgctggttgagcccgatttcaattctcagctcaacccgatggtgcgtcaggcggttgccgcacttaatgcttgcaacagctacgaggaggcagatgccgcactgaatgcgctttatccgaatttggacaacgcgaaactgcgtacctatatgcagcaggccttgtttatcagcgatattttgggacaagaccatgcccgcgcctgatttgggatttgccttaagtctgccgccaaaaaaggcaatcgagtggctggaaagtaaaaaggttacggcggagagctaccgcaatctgacagcctccgaaattgccaaagtctatacgattgcccgcatgaccgacttggatatgctcaacgacatcaaaacttcgatggttgaatcggcaaaaagtggacagtcgtttgacgattggcgaaaaggtatcttgaatctgctcagcaacaagggctggctgcatccgaacgggcataacggtaaggatatcatcgacccagccaccggcgaggtattcggttcgccgcggaggttggagacgatttaccgtaccaatatgcaaactgcctacaacgccggtcaatatcaaggatatatggcaaatattgatgcacgaccttattggatgtatgacgcggtaggcgacagccgcacccgtccggcgcattcggcaatagacgggctggtgtaccgctacgacgacccgttttgggcaacgttttacccgcccaacggctacaactgccgctgctcggtcatcgcgctgtcggagcgggatgtggaacgccaggggcggattgttgggcaaagcacggcggacaatctggtcgagacccataaaatctacaacaaaaaaggcgatacttatctgacccttgcctataaagcaccggatggcagtctgtacacgaccgatcgaggatttgattacaacgccggacgaatgaactaccgccccgatttagacaagtacgaccgtgcgttggcgcatcaatttgccaaagcggaaatgggtggtgcggattttaaaaccagctttaaacagcttgaaaaagagttttatgaagtcaagcaacgtttggatattgatggcaagcccgataaagagcagaaaatcaaaatccgaaatgcgctatcaagacagcttaaatttgctgcgggtgtattgagcaaggaaacgcaagaattggcaggtatgacacgagcgacggtgtggctgtctgatgatacgttggttaaacaggtagacagccgtgaggggcagaatttcgatgactcctactatgcttttttgccggatatgctgcaaaaccctgaacatgtcatccgcgacaatcgtgaattgattttcacagctcgctataaaggctcggcattgtgggcagttttaaaatatattaaggaggtggatgagatttatctacagtcgtaccgaatcagtaacgacaaagagattgccaaatttatggcgaagaagaaagtattgaaatagacgttgggcaaggctcgaaatcacttgcacacgctctcggacgccctaacgggcaggctgcggtatcgaggttatcaccgcttttccaacgtctgtacggaataataccatgattgatgtcaaaatagacaatatctttgtcgtcctaaaccaaatcgagcggcttggcaacgggatcgaaaaccgctacctgctgatgcgccgactgtccgaaaccatgcacacggcggtcaagctcaatttccgctacgcaggccgtccgaaatggttgggctaaaataccgcgacggcaagccgctttcggattcgggtcgtctgaaagacagtttttccacactgtcagacaacgatacagcccttgtcggtacgaatatcgtctatgccgccatccacaacttcggcggtatggcggggcgcaaccgcaaagttcggattccgcaacgggaatttttgacgctgacggacgacgacaaacaggctttgatggacgatgtgcaggattatttttcgggtctgataccgtgaatttataaaaccctcaaaaacgcgctttttagcgcgtttttttatgcgggtaatacaaacccctgcccaagatataaaaatcaatcctagacgcttctaaaaagcccctgaaaacgattaattgtgtatcgcgcggacaggttttaaaaaaatggcgggagggtttgaagcacgcctactctttgttgttttttcaaataggcaaaatgaccgtattgagagaggtacacatgtccaaaaatgcacaaaaaaccctacttgccgtgtgcagtttcgaggtgcagccaaaagacgggcgaatccaactgctgccatatggcgaatttcgcgcagtagacggtcgtccgactgatgtccctgcgtggtatctgaccgaagaaaacggtcatgatgtcgcgttgttggccaacagctcgcgcaatcagttggttgtcgattatgaacaccagacgctctacaaagagaaaaacggacaacctgcacctgccgccggttggatgcgttggctggagttcacgcctaaaggcatgtttgccgaagtggagtggacggacaaggcggctgcggcaattgccgcaaaagagtatcgctacatctctgctgtgttttcctatgacacaaagggatatgtaagcaaaatttttcacgccgcgctgacaaatttccccgcgttggacggtatggacgaggtgctggcggcagcgtcggcgcaaattttaaaaccggaaacggagcaaaaccctatgaaagagttgttacagcaactgttcgacctgcctgatgcgggcgaagaagaactgaaggcggcattgtccgcgctcgtggaagccaagccgaaagacgtggcattgtctgccgacgtgttcgcgcagctggcggaaaaagacagccgcatcgcggcattgacggcgcaaaccgccaagcctgatttgactaaatacgcgcctatctcagtggttcaagagctgcaaagcaaagtcgccgcgctgactgccaagcaggaagcagacaaaggcaacgaattgattaccgccgcgctgacttcaggcaaattgctgcctgctcagaaggagtgggcaaaaggcgtattgaaacagccgggcggcttggcatttttgaccggctttattgaaaacgcccagccggtcgctgcactggcaggctcgcaaacgggcggcaaagcacccgacgaacgcgtcgccgcactgactgcggaagaggcagccgcagcaaaaatgctgggcatgtccggcgaagaatttgtaaaaatcaaagaaagcgaaggtaagtaatggacaaatcagcgattttgaccgcaatcacggcagcattccgcaaagaatttcaaacggccttggattcggatttcaagtgcaacactaaggtaccagtggttggaacagattcaagaataaaacacttggcgtttcgtagccaagtgtttttcttggtcggtggttcaactcatcttgaaccctgcgtatctcccgatcactgatgttacggaaatcggtttgtttggggaagtattgccggatgagtccgttggtgttctcattcagccctttctcccaagaatggtaaggacgacaaaaataagtctccgctttcaatgctttggttattttggtgtgttggtagaactctttgccgttatccatggtaatggtgtgcaccctgtctttatgtgcctttaatgccctaacagctgcccgggcagtgtcttcggctttgaggctatccaatttgcagatgatggtgtagcgggtaacgcgttcgaccaaggtcaataatgcgcttttctgtcctttgccgacaatggtgtcggcttcccaatcgccgatacgggatttctggtcgacgatagcgggtcggttttctatgccgacacggttgggtactttgcctctggtccatgtgctgccgtagcgtttgcggtagggtttgctgcatattctgagatgttgccacaacgtgctgccgttgcttttgtcttggcgaaggtagcggtaaatggtgctgtggtggagcgtgatctggtggtgtttgcacaggtaggcgcatacttgttcgggactgagtttgcggcggataagggggtcgatgtgctgaatcagctgcgaatcgagcttatagggttgtcgcttacgctgtttgatagtccggctttgccgctgggctttttcggcgctgtattgctgcccttgggtgcggtgccgtctgatttcgcggctgatggtgcttttgtggcggttcagctgtttggcgatttcggtgacggtgcagtggcgggacaggtattggatgtggtatcgttcgccttgggtcagttgcgtgtagctcatggcaatctttcttgcaggaaaggccgtatgctaccgcatactggcctttttctgttagggaaagttgcacttcaaatgcgaatccgccgccgtctgaaacaaggagtcatcatggcaaaaaccaacaacaaaccagaaaccgccgaaaccgccgccccgtcgtttgaagacatcaaagccgaattggacgccgtgcaggcagagcttgccgccgcccgaaacgatgtcgaaatgctgaccacagccttggaaaaagccgaagacgacaaaaaggcactgtccgccgaacttgccgaactcaaagtgcagcatacgcaacgtgccgccgacgctttggcggacagccgcgatgtgatgctcgtcagtaccggcgcagacggcaaagaattttggcgcggcggcctgctgtttgacggcggctggcgcgaagtgaagcgcgccgaagtcggcgaagcggtgtggaaggcaatctgcgccgagcctatgctgcaacgcaaggcggtcgagtaatggcatacgcgacggttgaggatatggttgcgcgtttcggtgagctggaagtcttgcagctcaccgaccgcaacaacgaggggctgattgaccgcgaggtcgcacaaaccgcgctggtggacgccactgccgaaatcgacgcgtatctggggcggttcagacgaccttttgaggatctgccgcccatcttggtgcgcctttgctgcgacattgcccgctaccgtctgacggcggctcagggcgtgttgattaccgacgaaatccgcaaccgctacaaaatcgacgtgctcgacctgctgcgtgctatggccaaaggcgaagtgcagctgggcgtggatgatagcggcgaagaagtggccgcgggcgaagacggtattgtgtttgtaaacggtaaaaataaggtgttcgggcgtgatcactgatattgagcaagcgataacagaccgtctgaaacggggcttgggtcgcatggtgcgcacggttaaaagctacaacggcgaggccgacgatttggcggggcaaatccatacgctgcctgcggtttgggtaacgtatggcggcagcaaagttgagcctgccagcaccggcggcgtatgcggacgttatcaggataccgccgaatttgtggtgatggtggcggcccgcaatctgcgcaacgagcaggcgcagcggcaaggcggcatcgacagccgcgaaatcggcagcaacgatttaatccgcgctgttcgccgcctgcttgacggccagcggctcggttttgccgatagccgcggcttggtgcccaaagcggtgcgcgcgattgccaatcatgtgctggtgcaaaacgccgcagtaagcatatatgcggttgagtatgccatccgctttaacacctgcgggttggaaaatgaccgctaccccgaacgcaccgacaatcccgacgaccccaaccatatctttaccaagtatcagggtacattgagcgagccgtggcctgatttcgaggggttggacggcaaaatttacgacccgcaatccgccgatgaaatacctgtaaacctaacccttaaggataagcaatgagcaaaatcaaagtaacggcggcagatggcctgcgtgtgccgaccgaacacaacccgcacgaatatatcggccaagagccggtggaggtggacggcaacagcctgtattaccgccgcatgattgatgacggcgatttggtggtggttgaggatgccgccccaaataccaaaacccgcaatactaagggagagtaatgatgccccatattgattttgacacgattccgggcagcatccgcgtgcccgggcagtatattgaatttaacacccgcaatgccgtacaaggtttgccgcaaaatccgcaaaaggtattgatggttgcacccatgctgaccgcgggcatacagcccgccttagagccggtgcaactatttagcgatgccgaggcggccgatttgttcggacaaggctcgctggcgcatttgatggtgcgccaagcatttgccaacaacccttatttggatttgaccgttatcggtattgccgaccacagcgcaggcgtgcaggcaaccgcaaccgttaccctttccggcacggccaccgcgccgggcgtggtggaaatcacgattggcggcaagcaggtaagcacggccgttaacaccggcgagaccgccgccacagtggcagaccgtctgaaaaccgccatcactgccgccgatgtaaccgttaccgcatccggcagcggcgcagccgttacgctgacggccaaacacaaaggcgagatcggcaacgagagcggcttaaccgtgagcaccggcaataccggcctaacttatcaagccaatgcctttaccggcggtgccaaaaatgcggacattgccacggccttgtccaaagtggcgggcaagcattatcacattatttgcagcccgtttagcgatgacgccaacgccaaagccttgagcaaccatattaccaacgtatccaacgccatcgagcagcgcggctgtatcggcgtattgggtatgagtgcggccttgagcacggccaccaccgctaccggcgaaatcaacgacggccgcatgacctgtgcttggtacaaaggtgcggtagagccaaacggcatcatcgccgcaggttatgcggcggtgttggcctttgaagaagaccctgccaagccgctgaacacgctggaaatcaaagggctggccgttacacctgatgcgcaatggccgctgtttgcagaatgcaacaatgcgctgtacaacggcttgaccccgctcacagtggtcaacaaccgcgtgcagattatgcgtgccgtatccacctataccaagtcggccaacaacaccgacgacccggcactactcgacattaccaccatccgcacgctggattatgtgcgccgcagcgttaaagagcgcattgccctgcgttttccgcgcgacaaattgagcgaccgcctgctgcccaaggttaagagcgagattttggacgtgctgattaagctcgaccaagccgaaatcatcgaaaacgccgaggccaacaaaggcaagctggtggtggcgcgtgcgcaaaacgaccccaaccgtgttaatgccattatccccgccgatgtggtcaacggcctgcacgtctttgccgggcgcattgatttgattttgtaacccttttcagacggcgtttaaaacaggtttaaaggccgtctgaaaccttaaaaaaggataaagcatgagcgacgctacctatgccgacgcggtgattatggagatgaacggccgcgatatcgagattgtgagcatcaagccgcaaaccactacaggccgcaagccggtcaaaacgatgaaccgcaacggccgagtcaacggttattgtgacggcgtaaccgaacacaaattaagcgttaccgccgccattccgatcgacggtacggaaatcgactgggacaacatcaccaaggcgaaaatcacgatttaccccatcaacgacgaagatcgccgcacttcctacctcgactgctttaccgtcgataccggcgagcaatatgaagtcgataacgaggcacgcatcgacattgagatgattgctttgcacaaaatcaaggagtaatgcgtgattaccgtcaaactgacccacgggctgacctacaatggcaaagtcgtatctgaattacgcctcaagccactgaccgtcggcggcgaactggcggcgttcgccctgattgatgacttgcccgagctgcccgaaaacgccacaaaagccgaactgctgcaacgcgacgtcctagagacgctgacctactggtcgcagcagattgaagcccaaggtatcccatccgacatcctgacggcgcagtggctgatggaaaacctctctaccgaagactaccataccgtgatggcggctcaggaggatttgcgcctaaaaccgtccgccgctacggcgagccccgatgcgccgtcggcggcggagcagtaaaacgcagctacctgacggcacacaaaagctaccgtcaggcggtcatcctgatggcaaggcggggataggggcggacgcagtgcgcgatatgtgccacgccgagctgtcggcatggtttgaagacatcctgtcgagcctgggcataaaaacgccgaaggaagagggagtgattgtgtcgaaacggctgagaaagccggagggaaaataaaaaggtcgtctgagtttcagacgaccttttttttatttgacggttagggttgttttctgccgattattgcaatggtgtttgtttctttttcaaaaacaacgctatataaaataccatctgccggaacgtctttttgcgctgttgctcctgtctgattggattctttgacgacttcggttaaagctgtaaaaagttgttttcctgcttccgattcgcccaatttgtctgtggtagttaaagacagaactgcctgaatactgtgtaatccatttatggcattattgactagattttgtcctttctctccgtcggtttttaaaatgtagcctactgagatagctctaattttttgctgctcgtccagtttgagcgcaatcgccccaaaatccattaccaaagtaaggtcataaccacaatcggtcttgacaatatttttattatggatttttgttgagacgttctgagttttaaatgcttgctccaaattgatgagatattgttcaactgtgatgtccattggggcggtacaatcagcagcctggatactttggacaggttcttcggcttgtgccgtttttgattgttggttgcaggctgataaaacaattgaaacacaaattgcggaaatcaattttttcatattcataaaatatccctttgaataaaatggttatcattctagtattataacgcaacaaacaaataaagcacgaaaacggggttgaagcccataccgcctcccttaaacagcctttaaacgataattgaccttgagttaatacgtttaaaggctgctttttatggcaaacgggaacatgaaactgtcgttggtgttaaccgcccgagatgacggagcgagacggctactggctgatactcaacgacaattagatcgtaccgcgaaatcgcgggcgcaacttgaacggcaaagccatacttatgcgttgaccggcatccgctcagaaaaacagattcaacgcgaaatcatgctgacacaggctgcgtttaaccgtttggcgcgcagcggcaaggcatcacaaaatgatttggcacgggcggcggtcgctacgcgtaaccgaattcgcgagctgaacgcggaactgaaacagggcacgggatttgcggacaagatgggaaaaatcggaagattcggtgcagctgcggtggctggtggcgcggcagcgtatacggtgcttaagcctgctatggacaacagaaagcagcttgatgagaacatcaaccgcgtgtccagacaggcatttattgaggataacagtaaatcggcagcgtggattgcaactgaaggtgcgcaacagatcaaggatttggcacttgaacttgtcgagaaaaatggcgggacccacgataaggctttggatttaatcagcggcatgatgaccaccggtctgaattttgcccaaaccaagaatgaagcgcaggcggcatatgcttttgcacttgcctcagaaggcagtggcgaggatacggcaaaactgattaaaaccctgaaagatggcggcatgagcggtaaagacctgcaactcgggcttgagcacgtcttgcaatcgggtttagacggcactttcgaggtgcgggatatggttcgggagctgccgagcctgctctctgccgcgcaacaggcagggatgaatggtgtcggcggtttggactacctgctctcactcttacaatctgcggcgaataaatcgggcagtcctgccgaagcggcgactaatgtgcaaaatcttttgagtaaaactctgtcgcctgacacgataggtcgtctgaagaagatggcaaatccgaatgacccgaagaaaggtgtcgattggataggctcggttgtgcaaggcaagcaaaacggcgaaaacgcagtgcaggtgttgtcccgtcttgccgatgccatgctagtaaaggataagcaataccaagattataagaaacgcgcggctgcaggcgataagacggcggcggagcaggcaaatatgcttaagggcgcgcttttggcgcaactgctgcctgatttgcaggcaaaacaaggtttgctggctgcaacggatatgacgcaaatccgtgaatatatggcttcgttggctggcgtaacgttggataacggaaaaattgctaagaacaacgaggcgcgaatgttgtcggcagcggcgcaacaagagcaacaggaatcgctggcaatgttgcgggaaagtctgacgggaacattggtggatatggaaacctcgtttaaaaagctggcagcggaataccctaatgccactctagccctgcaagcattgacgacggcggcaacagcggcgtctgccgcaatgttattaaccgccggtggcggtaaaggtgcaggctttctgaaagatgtaggtagtaaagcgttgggatggggtaaggcttccgcaggcggcgtggcagcaggtgccacagcggcaggcggtaagttgctgtcatggggaaaatctgccggtagcgggctcatgaataatccagcgttagttaaacgggcgggtttgttaggtatgttgctgtattccgagtctttgggtgacggcacattgccaaagggtttgcgtggtaccaagacaactcctgaaatgattaatcgtctgaaaaacaacggtatccgatttgaacctgcgccgaagcgggaacaggcgcggggtggtgtccctcagtatttggctgctccgtcagcgcagcctaccgataagatgttgtctccgttgttttcaactcagacggcggcgtatcaggcagccattcagcagcagacggcggcgtatcaggcagcattggcgcaggatacggctgcagttacaacaggtttggcacaagtgcaaagtgcgatggcgtcggcaagtcagaccatcaataccaatgtgagcctgaatatcgacggacgtgttatcgcgaatgaggtatcgcggtatcaagtggccatgttcggccgtggagcgggtcaataatgagcggatggcataccttattgcaggacgcatcttacaagggcgtcggctttgatattgaggtggtggacgagagcaacggcaaggcattggccgagcatgcgcggccgtttgtgcagggtatcgaccttgaagacatgggcatgaccgggcggcaggtgcagattaatgcggtgttttggggcaagggctatgcaggccgtctgaaaaagctgctggatgcgctggagcagccgggcggcggcgtgctggtgcaccctgtttgggggcggatgcacaacatgattgcggcatcatggagttaccgacatgaggccgattatgtggattatgcgggcatcgatattactttccgcgaggcggccgaagcgcaggaaatctttgtttttgaaaacgcctttttggtcgagcttgaggcgttgattgctaatatcgacacctaccgcgaggcggctatcggctttgttgatgcggtgttggcggtggatgcgggcgtatcagctttatggggcagcgcgctgggcatttggagtgcggcatcgggtacgtttggcgcggtgcgccgtttgtttgatttggacaaaattgcctttcccgatcggggcggatacagtgcagcggcgtttaaaaacggctcggccaagctgtttgcggatatatcggtcatggtagatactggcatacgccgtgaggcgggtttggccgataatgccatgcaccatgccggttggtcgccgcgacagcggtttgacggggctgcggctgttgccgaccgcgccgccgctatccctgataatttgctgaccggccgcttttcagacggcctgcaaaaccgcctgaaccggttaaccgccaaacaggtgcagccggtagcgcaggcggtgcgcctgttatccacgtcatcgctgttgtcggtggcaacggcattaatcgaggcgcatggcgaagagatgaccgcgcccgatttgattgaggttaaccgcgccatgcgccgccgtatgcaggccgagattgccgccttgcgggcggtgcagacggctgctgccgagtctggtgggctgacggccaacgccgtgtataccgaggcttaccaaacggcagaatccctgcgcgcggcggcaggccgtctgaatgcgttggttgcggcggtcatcaaccaaaagccgccgctgattgtgcgccaagccccaatcgacggtacgatacaccaaatcgcccacgagttttacggcgatatagcccgcgcagcagagctggtgcggctcaatccccatatccaccaccccgcgtttatcaagcgcggcactttggtcaacagctatgcaaaataattcatacggctatgccgtgtcggtgcgcgtgggcggtaaagagcaccgccactgggagcgctacgacatcgacagcgactttttaatccctgccgacagcttcgattttgtcatcggcaggttgggaccggaggcggccatacccgatttaagcggagagagctgcgaggtagtgatagacgggcaaatcgtgatgacgggcatcatcggcagccagcgccacggcaaaagcaagggcagccgcgagttgagcttgagcgggcgtgatttggccggttttttggtggattgctccgcgccgcagctcaatgtaaagggcatgacggtattggatgcagccaaaaagctggccgcgccgtggccgcagattaaagcggtggtgcttaaggccgaaaacaaccccgctttgggcaaaatcgacatcgagccgggcgaaaccgtatggcaggcattaacccatattgccaactcggtcgggctgcatccgtggctggagccggacggcacgttggtggtgggcggtgcggattacagcagcccgccggtggcgacattgtgttggagccgcaccgacagccgctgcaatatcgagcgcatggacattgagtgggataccgacaaccgcttttccgaggttacttttttggcgcaatcgcacggccgcagcggcgacagcgccaaacacgatttaaagtgggtgtacaaagacccgacgatgacgctgcaccgccctaaaacggtggtggtgtccgatgccgacaatttggccgcattgcaaaagcaggctaaaaagcagctggccgactggcggctggagggatttacactcacgataaccgtgggcggccataaaacccgcgacggcgtattgtggcaacctggcctgcgtgtgcatgtgatcgacgacgagcacggtatcgatgcggtgttttttctgatggggcggcggtttatgctatcccgcatggatggtacgcaaaccgagctgcggctcaaagaggacggtatttggacacccgacgcttaccccaaaaaggccgaggcggcgcgcaagcgcaaaggcaaacgcaaaggcgtgagccataagggcaaaaaaggcggcaaaaaacaagcagaaacggcggtgtttgaatgagtttgagtaaattggcgaaaaaaacggcacaaactgctaaaaatatcggcgaaaccctgcgcgcggcctttcggggaaaaatcacgctggtggtgtcgtccgagccgatacagcgcgtgcagttgagcggcttggccgacgaaaccctgcaagaccttgaacatttgcaggaatacggctttgccagccatccgcccgacggcagcgaagcggtagtgataccgctgggcggcaatacttcgcacggtgtgattgtgtgcagccagcacggcagctaccgcatcaaaaaccttaagcccggcgagacggcgatttttaatcatgagggtgcaaaaatcgtgattaagcaaggcaaaatcattgaggccgattgcgacgtgtaccgggttaactgcaaacaatacgaggttaatgcggccacggatgccaaatttaacgctccgttggtggagaccagtgcagtgttgacggcgcaaggccaaatcaacggcaacggcggcatggccgtcgagggcggcgacggagccacctttagcggcgatgttaaccaaacgggcggcagctttaacaccgacggcgacgtggtggccggcaatatatcgttgcgccagcacccgcataccgacagcatcggcggcaaaaccttaccggcggaaccggcatagacaagcagacctttggcagccttcgggctgctttttttgtgcgtgtgggattgaagcccgtgtactccgtgaggccgtctgaaaacggcaaaatgccaacatggacaaagagctaaaccccagcatcggcgactataccggccgcaccgtcgatacgctgcaaaatgccgtgtatatccgcttgatgacaccgttgggcagctggtgggcggataaaacgctcggctcgctgctgcatttgttgcagcgcgaaaaagacctgcaacgggtcagcctgttggccgagcaatatgccgatgaggcactgcaaccgattgttaagagcgggcgtgccgacaagattaccgtgcgcgcagagcagccgcacgacggccgcctgatcctgcatatccggatggatacggcggcgggcgggtttgattaccgccacgaagtgcccgtgatttaaagaggttttaaacgtgtttgaaacgccgacatttgagcaaatccgcgagcgtatcctgcgcgataccaaaagcctgtggccggatgccgatatcagccccgacagcgaccattatgtgcacgccagccgtttggccagctgcgccgaagggcaatatgcgcatcaaagctggattgtgcggcagattttccctgataccgccgaccgcgagtatttggagcggcatgcctccatgcgcggcttgagccgccgcaatcctaccacggccagcggcacgctgaccgtaagcggtattgcgcaatccatgctttcagacgacctgcaagtgcgtatcggccagcgtttttaccgcactaccgcccgcgccgttatcggcagcggcggcacggcggaaataccggcaatcgccgacgagccgggcgcggccgccaatgtggcgacggcgaggcgcaactgatggccgcccccgccggtgtggccaccgaatgccgccttaccgtacaaggcggcaccgaccgagaaagcgatgcctcactgctggcgcgtctgttggaaatcatccgccgaccgcccgcaggcggcaaccgttacgactataaaaactgggcgttgagtgttgacggcgtaaccagcgcatatgtttatccgctgcgccgcggcttgggtacggtggatattgccattacctccgccgacggtgtgtcgtcggaagaaactgtgcgccgcgtacaggcttatatcgacgagatgcgcccggtaacggcaaaaaatgcgctggtactcaagccaaccgtaacggcggtgcctgttaccgtgcaagtcaagctcgacggtatcgacttggacgaggccaagcgccgcatacggacggccctaaaagaatatttcgacaccctgatccccggcgacggcctgactgtgtcgcaaatcgaggctgctatcagcaatgtggatggtgtgatcgaccgccgtctgactgcgccgacggccaaccgtgccgccgatacggttaaccgcatcgagtggtttaaagcgggcgcgattaatgtaacggagatgccgtcatgagctatcaagacatcttgcggggcctgttgccccccgtgtcgtatgcccgcaatgccccgcgtgtgcgggcgcaggcagaaatagacggcgcagcgctggatgcggtggcggaatcggctcaaagcgttgccgatgccgtcgacccgcgcagcgccggccaaatgctggccgattgggagcgcgtattaggtttggacggtacgggcaaaaaccgccagcaccgtgtgttggccgtcatggccaagctaaacgaaacaggcggcttgagtattccttattttgtgcgtttggccgaggcggcgggctatcaaatccaaatcgacgaaccgcagccgttccgcgccggtgtaaaccgcgccggcgaccgtcttgcgccgcaggaaatcatgtgggtgtggcacgttaacgtgcgcggcggcaacaaccgcattacccgattccgcgccggtatctcggcggcgggcgacaggctgaccgattacagcgatgccgtgatcgagagcctgttcaaccgcctcaagcccgcccacaccgctatccgatttacctaccgctaaaggacgatttatgcaccccatcgaaacccccgataagaccttccacgacggcgacggcgtgtccgaattgggcaccatcctgcccgcgtggtggctcaaccaagtgcaatccgagctgctggccgtgctgactgcggccggtatccagccggataagtcgcagcctaatcaattactggcagcactaaataggctggctgtagttatcaccggcgaccaaaccgtcaacggccaaaaaacctttaccgcccaaacccaattccaaagcggcatccatttatccgccaaccagacgaactggaacggcggccacaaagcctacatcggcgcggatgccgacaacgcccacatcgtcttcggcgacgacaccctccgcctgcacggcgcaaacaaccgcatttcctacaacaaccacgacatcttccacaaagccaacaaaccgcgttttgccgaagacatccaaggcaaaccgaacacactgtccggatacggcatcggcaatttcaaagtcgaaacattccggggcgatttgaacaccctcaaaacagacggcatctattccctgccgacggcggtcggcagctccaacctgcccgttgaaaacaccgcctgccatatccaagtcatcgccggcacgaaacacggctggtgcaggcagttgggttatcccgcctacacgtccgacgtgtacgaacgccaccaaacgagcagcgcaaacgacaactggtccgcatggaaaaaactcaattcggacggcatccccgtcggcgcgatcgtatcctttcccaaagccgtacaaaaccccgcaggctatctcaaagccaacggcacgacctttgcacaaaacaccttccccgacctttaccgcgccttgggcaacagcaaccgcctgcccgatttaagccgtaccgacatcggcatcaccgcgtggtttccgtccgaccaaatcccgaccggctggctggcgtttgacgacatccgcacgcgcgtaaccgaaaccgcttatcccgagctgtaccgtctgctgaccggaaaatacggcagcatccaaaacgtcccgcaggcggaagaccgctttatccgcaacgcgggcaacagcttggcagtcggaacgaagcaggaagacgaaatcaaacggcacgtccacaaagtattttcacactggacaaaccacacagacgcggcagccctcggttacgaagaccgcaacgaaaggcagagaagcgcgctcgtatcgacttggacggacgaaaatttaaacgacaacggctttttaaccccgcgctcggacagcaaaatggcgacaggcggcgacgaaaaccgccccaaagccctggttttaaaactgtgcatcaaagccgccgacaccttgggcgaagccgtgttttggataaagtcccacggcgaaaccatcaacgcaggcgcgctggacgcgggcacgctggcgcaaggtttgcaagacaaagccgaccgagaccacacccacaccgccgcccaaatccaagggctggacgaaaaaatcagcaccgccgttgccgcgcaattcacacgccaaaccatcggcggcgtggatattgtcagattccccgacggcacaatgatacagaccggcagctacaggttcacacgaagcggcggccccatcgaaaacgaagtcgtcttccccgtcgcctttgccgacggcaacgtcaaatgcttcgtatccgaacgccattcggaacgcgttaccggcgatcgaaggcaacacaactggctgtttatccgcgcaaaaaaccacgccgccgccattatcaccaactggtacgaaggcagttgcgactggatggccatcggcaaagccgcctcgggaaacgccgccagctccccgataggccccgaaatacctgaaaccaacgaagaaccgcaaagagagagtggaagaacatcaaccggaccccgaaaccgccgccgccgagacggcttgctcgaggcactgcaagactagcgggctgtagagatggctgtagagacgggctgtagagatggctgtagagacgggttgtagagacgggttgtagagacgggttgtagagatgggttgtagagatggctgtagagatggctgtagagatggctgtagagatggctgtagagatgggctgtagagatgggttgtagagatgggctgtagagatgggctgtagagatgggctgtagagatgggctgtagagatgggctgtagagatgggctgtagagatgggctgtagagatgggctgtagagatgggctgtagagatggctgtagagatggctgtagagatggctgtagagatgggttgtagagatgggttgtagagacgagttgtagagatgggcttcagcccgccgatccaagcaatccgaccgaaaccggccgcgccgccaatcccccgaaacctatgccccgccaatcctgccactcttcgtcattcccgccgctttcgtcattcccgcgaaagcgggaatccagaccccccgacgcaacaggaatctatcggaaaaaccgaaacccccgccaccgtcactcccgcgaaagcgggaatccagcccccaaacgcggcaggaatctatcagaaaaaacagaaacccccgccgccgtcattcccgcgcaggcgggaatccagaccccaaacgcggcaggaatctatcggaaaaaacagaaatccccgccgccgtcattcccgcgcaggcgggaatccagaccccaaacgcggcaggaatctatcggaaaaaaccgaccccccgccaccgtcattcccgcgcaggcgggaatccagaccccaaacgcggcaggaatctatcggaaacggctgaaaccgaacggactggattcccgcctgcgcgggaatgacggcggcaggggtttcgggattcccgccttcgcgggaatgacggaaagtggcgggaataacgaaaggcgggaatgaccgcgcaaaaagccgctgcccccttcggacggcaccggcaacaaaaaaccgcacggccgaaaccgcgcgggaaaggatagtcgggcgcgcccgataagcagcggccgcccccgttatttcaattgggcgatatattggcgcaaaacctcgttgatgcgcgtctgccagcccttgccgccggcgcggaatttttcgaccacatcggcggacaggcgtatggtaacgagttgtttcggggttttgcctgtgtttcgtttttgcattacgcccttttcttccaattgtttttgatgggaaaaaagcacctgtgccaagtcttcgggcagggcttcggcaatggggcgggcaagcgcaaaatcttcggcggcaagttcccgcacttcgccgtcagcgtttgttaaggattgacgttgcatattttttaacctctcttttattcgctttgcgaaaactgatgacacggatgccgtcttttatcggcgtaaaacagacaatgtgcaggcgttgcgtatcgcctagataagcagcggcaacataacgcggttcggggtaatcaaagcggacatcgggcacaataacggccgttgtccagcgtatttgcccgactgattcaaagggcaaattccgctcttcgatattgcgttgatttttttcggagtcaaattcaatcttcattgcagcttgcagcgtattttgtcgttacattataagcggcaaaaaaccaaaatgtaaatacaaaaaaggaaaccccaaaatgaccatctatttcaaaaacggcttttacgacgacacattgggcggcatccccgaaggcgcggttgccgtccgcgccgaagaatacgccgcccttttggcaggacaggcgcagggcgggcagattgccgcagattccgacggccgccccgttttaaccccgccgcgcccgtccgattaccacgaatgggacggcaaaaaatggaaaatcagcaaagccgccgccgccgcccgtttcgccaaacaaaaaaccgccttggcattccgcctcgcggaaaaggcggacgaactcaaaaacagcctcttggcgggctatccccaagtggaaatcgacagcttttacaggcaggaaaaagaagccctcgcgcggcaggcggacaacaacgccccgaccccgatgctggcgcaaatcgccgccgcaaggggcgtggaattggacgttttgattgaaaaagttatcgaaaaatccgcccgcctggctgttgccgccggcgcgattatcggaaagcgtcagcagctcgaagacaaattgaacaccatcgaaaccgcgcccggattggacgcgctggaaaaggaaatcgaagaatggacgctaaacatcggctgaaaaaatacgtttaccacctgttggtagccatcgaccaactgttcaacgccctaaccggcggcgcggcggacgaaaccctctcaagccgcacctatcgccgcgcgcggctcgcccaaaagcccaaaacccgctggaagattttatataccctgatcaacggcgtgtttttcgaccgccaccactgccggcaggcgtatatcagcgaactgaaaggcaggcagcacgacgcgcggttcaaccaaagccgcgccgccggggaaaaggggacgcgatgaactacttcggcatggtagagtttctgcgcctgatggcaatggtgcggccgccatttgtcttcttctccggcacccgcagcgaactgcctgcttatcttgacctcgtggcagaactgcgcctgaccggatgggagcgttttgcaggcagccaaaccttgactgtgagcagcacatcaacagcaattcaagctacgacgaccacctgatttataagttctgaccgcaagtagcgtactacttttaaaggcataagataatccccgtttaacagaccattaaacggggataaatttgtgcaaaagctaatacaatttcctacgcttcggcggtgcaaaagctgccgccaattcgtgcaaaagctgccgccgccttacattccagtgcaatgccgtctgaaacttcgctaatctcgggttgccgcgcgctgtgttgttcttcggtactcagcaaaaagccgtacagacgctccaatcgggcgcggtaggcggtgaatttgttgtagaacatccggaagaaagaaagcgcgttttgcagtcgcgcgaaggcttggacggtctgctggatgtcgccgattttgatttgtccggcaaacaggcgcggcgcttgcaaaataatggggaagagcttgatgccgttggtgaacatatcattaaagccgctcaggcagacgctttgtcgcgcaatacgccagcggttgcggataatggctttaaaacggtcagaaagctggtcgtgttcgtgtttttcgccgctgtaaaacgccacgctttcggcgtggtcgcgcacgcggatgagggaataacggtagtcgccgttgagtttttcgttttcataattgtaacgaatcaaagggttgcctatccacatggcgataaaggtcgccaaaatcacaaatatatagacaaaccaaacgatgccgtgcggaatgtcgaagccgaacacggtcaggatgccagccaagccccgcaaaacaacggcaaattccagagaagtaacgaccgaattgaccatgccgcgcacaaattcgatggtcgaagcgataaattcctgcgcgtcctgttggatacgctggtcgatgttgtccggcgcgtggcggcgcatttgcaggcggtagtagtttttgtcggcaagccagcgtgctgtcagcacttcgttgagccgctccgaccatttaatcgccaagccttgatcgaggaagtcgttgacgacgttgttaaacgcccgtatcagcaccacgcccgcgttcattgcagcaaacatccaaaatgccgaagcatttcaaatcctgcatcgagtcgtaaagccctttggacataaaggtactcaacacattcagccgcatttcggttaacaccagcgtaatcatcgccgtaatcagcagcaagactttgaccgcgcttttcggtgtcagacaaagccaaagcggtgtggaataaagctcggtttgccatttctgcatgggaaatttcttacggtatcaatgccgtctgaaaaagacgggtacagttgattttttgatgaagtttggggaagttttgccggtcagggtacattgcgtgttaatttatagtggattaaatttaaaccagtacagcgttgcttcgccttagctcaaagagaacgattctctaaggtgctgaagcaccaagtgaatcggttccgtactatttgtactgtctgcggcttcgtcgccttgtcctgatttttgttaatccactataccatacaaccacgccggaattaagtttaaatttgaataaaaggttcgggttctgcaaaatacagaacccgaaccttgttcggatattgaaaccggctgcccgattttgggcggtgcggcttgcaagtatcaagattcgcatatgccgtctgaagctcggagaggttcagacggcatatgcttatttgggctgctcttcaacgaatctcggacctttcaagatgccgttgtgagaatagggcgacagcaggttgtatgcggcggttttggaaacctgataaccgcggtcggtcaggctgttggcaatctgattgaccactgcgctgaccaaagcccccaacaggccgctgttgctgttgttgctgccttcgcggatgctggccgaacccgaccacaactcttttccgttgcgggaatcgaccagccgtgctttggcggatacggtcgtcacgctgtctaaaatttgatatgaagtgccgtattcggtaaccgtaatgtacaaaaccgcatcattgccgaaaatctgatgcagtttttccggccggacggcgtgaatatcggcggcattggtcaagccgttttgtttgaaggtttcctccacgactgcggcggggaagacgtaatagccggcttcggaaagcggcgcggcggtcgaagccagtacaccccatgttccgttgacatcgggcgattcgttcagcggcggaaccaccaaaattgaagccggtttgctttccttgaatgacgtgtagtcgaaatcgggcgctttttgaacttggcaggcagacagcgccaacacggcggcaagccctaaaatcaaaggtttcatcgcttgcctcctttaccggttttcatcaggaagtccataaatacgcccgattcgggaaacagccttttctcttcttcaaactggcggaacgcgccctctttgtctcccgctatttaggtgacgcgttagaatactcaagctatgcatcaagcttggtaccgagctcggatccactagtaacggccgccagtgtgctggaattcgcccttccgggctggatgtgttcgggaataccgtttttcagatagccgcgtatgcctgcccagccttggacgaaacgggaaaaacgggcggtatcgctgccccaaatgccccagcagaggcgaaatacgagcaggaaaaggacgaacagcccgacgcgcgtgtgccattgcagcatatcgccgccggctttcgcgctataccacataaagggcagggacgcggcaagcagccagtggaaaaggcgggtggggaggtcccagactttggttttgtttttcataatcggtttccggcggtagaatcggtttgttttcgagccttattttaaccgattggaggggcaatgtttcccgtttttcatctttcaggcgagagccgccgccagatgcttcagacggcattgcgttttccccatgttttcaaagcccgtgcggaagattcgcacaaagggactttcggcacgctcgccgtagtcggcggatcggcagggatgagcggcgcgcccgtattggcggcatcggcggcaatgtatctcggctgcggcaaagtgtgggcgggtttcaatcaggatacgctaccttttgccgttattgccggttttcccgagattatgctggatacggcggacagtttggccaaacgtcaagatataaacgcctgggttgtcggttgtggattgggtacaggtagggcggcggtcggaacgcttgccggaattttgacggaacacacggacaagcccgtcgttttggatgcggatgcgctgaacatattatcaaccgatgccgaaacccgaaatctggcgcgcgggtgtaaaaacctgattttaacgccacaccccgccgaagccgcgcgcctgcttggaacgacggttgcgcaggttcaggcggatcggacggcggcagtgaggaagataggggcaattttcggcgcaaccgtggttttaaaggggcacaaaacattggttgcctcacccgatacggaaatctatgtcaacgaaagcggcaacgcgggattggcaacggcgggcagtggcgacgtattgggcggcatcatcggcagtctgctcgcacagggcgtgccggtttttgaagccgcctgcgcgggcgcgtggctgcacggcgcggcggcggatgtcataaaagaatcggcaggcattgcggcagggctgttggcaggggaaatcgctccggcggcaaggtggctgcgcaaccggataactaaaagtatgtaagaagatatagtggattaacaaaaaccagtacatcgttgcctcgccttagctcaaagagaacgattctctaaggtgctgaagcaccaagtgaatcggttccgtactatttgtactgtctgcggcttcgtcgccttgtcctgatttttgttaatccactataccatacaaccacgccggaattaagtttaaatttgaataaaaggttcgggttctgcaaaatacagaacccgaaccttgttcggatattgaaaccggctgcccgattttgggcggtgcggcttgcaagtatcaagattcgcatatgccgtctgaagctcggagaggttcagacggcatatgcttatttgggctgctcttcaacgaatctcggacctttcaagatgccgttgtgagaatagggcgacagcaggttgtatgcggcggttttggaaacctgataaccgcggtcggtcaggctgttggcaatctgattgaccactgcgctgaccaaagcccccaacaggccgctgttgctgttgttgctgccttcgcggatgctggccgaacccgaccacaactcttttccgttgcgggaatcgaccagccgtgctttggcggatacggtcgtcacgctgtctaaaatttgatatgaagtgccgtattcggtaaccgtaatgtacaaaaccgcatcattgccgaaaatctgatgcagtttttccggccggacggcgtgaatatcggcggcattggtcaagccgttttgtttgaaggtttcctccacgactgcggcggggaagacgtaatagccggcttcggaaagcggcgcggcggtcgaagccagtacaccccatgttccgttgacatcgggcgattcgttcagcggcggaaccaccaaaattgaagccggtttgctttccttgaatgacgtgtagtcgaaatcgggcgctttttgaacttggcaggcagacagcgccaacacggcggcaagccctaaaatcaaaggtttcatcgcttgcctcctttaccggttttcatcaggaagtccataaatacgcccgattcgggaaacagccttttctcttcttcaaactggcggaacgcgccctctttgtctcccgaacgggaaagcagcagtcccagatgggcgtgcgcacccggggcggcattcatttttttgttgccggcttccacaaagtatttttccatcttttcggtctgcttgcccaacgaagtgtcgtcgtttttcaaaccttcatagacggtatcgggatagccgccgtaataatacagggatttttgcccgttgccgccgcaggcggtcagagccaagaccgccgcacacagcgacaaacggctcaaggttttcggattcatcatttctccttaacggttgggttgccatgcgccgttgtcaacagcctgaaccaggctgttgacggcttcgcggattgccaagtctaaaactttgccgttcaaagtcgcatcgtagccggaagtgccgccgaaaccgatgatttcacggttggaaagtgcgtattcgcccgcgccctgtgcggaatagacgatttcggaagtattgacgttgacgatattcagagccacttttgcataggcgatttgcgatttgccgcgacccaaaatgccgaagagctgatgatcgccgacatctctgcgtccgaattcggttacatcgccggtaacgacataatctgcgcctttcaggttatgcgctttgccggaaatgccggattcctgttttaatgcgttcaaattggtgcggttcagtacgttgaagcggttggtctgttgcaggtgcgttactagaatggtttttgcctggctgcccaaacggtcttccccgtcggagaaaatgcctttttggaagctggagcggttgtcgaatgttccgacggaaatcggggtacgaacaccgtgatattgcgtattgtaggaggcgactttctctacctcgagactgcgtgaggattcggtcgcacagccggtcagtgaaacggcagcggcggcaaggacaacggcggtggaaacggttttcataaaatttaccctaaggtcaagttaaggaaataacgggttgtcattattgtccttatgtaaatttaagtcaaggtgtttgtctgtgcgggacggatgcgcgcggaaggtacggatatttttcaaacggaatcgcggcgcgggcgggatgcctgccttttccggatttagaggtaaacgatttcgccactccgccctttgctttcggcacttgcccaccagacaaatgcgggcagcacgtccccgtagcttttgcgttcgcttttggcttcgcccggatgggatttgatgcgttgcggggaattgatggggccggggacgaggacgttggcgcgcaggttgccgaagcgttcccattcgtcggcggcgactttgcacaggtagttcaacgcggctttggacgcgccgaagccgccccagtaggctttgggtgtttcgccgtggctttcgccgacgaagatgacggacgcgtcgggcgactgcttcagcagcgggaacagggcgcgggtcagccccataggtgcgacggtgttgatgcggtattggttgacccattcggcgacggtttggaaatccagcggcgagagggcgtaaaaatagccggcgcagtggacgatgccgtccagtttgccttgcgtggcttcggcaatggtggcggcgaaatgttcaaattctttttcttccgcgctaataaggtcaaagcagatggcgaatggttcggggtatccggcttcgacaatcgcgtcatacactttttccagttttttctgatgacgggcaaccaaaatcacggttgcgcctgccgccgcataggctttggcgacctgttcgcccagaccttgcgatgcgccggttactaagatggttttgtcggacagtgtcgccatactttttcctttttggttgtcggttaaggtattttagcgttttgccgcaccttgtaaagcgtcccgatgtcggccggcgttttcagacggcatcgctcaggctttgcaggcaggcttccgccgacgcgaaacctgattgtacggcggcttcgagcgtggcggggtagtccgggtggaggtagtcgccggcggggaagatgcggtgccggtgcaaccacgacaagtccggcggcggggcatcggctgcggttgtggcgcgtttttcggtgatgacgcgcacggcttcgggttcgcccaaatgcggaaggatgcgtttgaggtcggcgtgggctttgtccgcccacgcccggtttgcaaacgcgccgacgcggtcggaaacgctgatgacggcggacacttcgttttcaggcagtccgagcctgccccggcaaagcagccattgcaccgtgccgtcggcaaggccggtcagcggggcgggcaggcggacgggttcggcgtagcgcagatagacggtggtgatggcgtggtagcgaaggttttgatatgccgtctgaacgtgttcgggcgtgccttcgggcaggagcgcggcggcgtggtagggcgcggtggcggggacggcggcatcgaaagcttcgccgttgacgagcactttcccgtccgggagggtgttcagacggcatacgcgcgtttcgaggcggatgtccgcgccgagccgttgaagatccgccaaggcgggttcggcgacgattgcgcccaaatcctgcttgggtaggagatagtcgctgccggattttttcgtcagcacgccgtcggacaaaacgttgcacaacacgcgcaggcttgcggtttccaaaggcgtgttgagcgcgccccaaaccaagggctgccaaaactgcatcacggcggcacgcggcacgttccgctgtttcagccattgcgccactgtcgtgtcgggctgtccgaggcgtgcggacttctgcaaatcggacatatcggcaagcagtttggctttgaatgcagtcggtgcacgccgggcaagcagcacgccgcccaaaatatgcagcggcgcgggcagggggagggcgcggaactgcaaaccgccgtgcatatgccagtgcagcggtacgcgcaaaaaggcggcacggggatccgaaccgatggttttcatcaggcgcaacacgccccggtatgcgccgagcaaaatgtgctgcccgttgtccaaaaaaccgaaaccgtcggtatttccggccagtgtgcgcgccctgccgcccgcctgccggccggcttcaaacagggtaacgtcggcgtgccgcgccaaggtgacggcggcggacagtcctgcccagcctgcgccgatgacggcgattttcgggcgcggatgcggcgtgttcatcatttattcctccaatggttttgcagccgtatctatttccgtttccgaaaatgacggtagaaaaggatacaggctaaaaataaaggcagcagaaagcgcgcatagggataccacggatggtctgcatgccagtatccgtaccgtccctgtggaacggtatcatagcggtaactgtcggggaaaaagttgatccaaaccgttactgccagccataaggctatatccctgactgctttcatttacttctgctcctgtttaaattcccagcaattccatttcaaagcgcgaacgccaacgggattgcgcggttacgatgcagactttcagacgatggttgaaaccccgtccggcggggctgtgggaatcgggtttgcctgacgggcggcgggcggtatgcgccttatgcccgttccggcgtgccggggcgcggtttgaatccgaataaccaggttttcagggcaatgcgttttttgcgcggcgaagggagggcgattttgtatttgaggacgttttgtgcgccgtctcggtcgatttcgttcaatagctcgtaataaaccgccgccatgaccagtccgactttttgggcttttttatcggcatcaggcagcagcgatacggcttcgcggtaggtttcgcgggcgcgtttgatttggaacgccatcaattcggcaaaattgcccgtcgggctgcattgcaaaatcacgcttgcgggtacgtcaaaccgccgcatttcctccatcggcaggtaaatccgccccctgcgcgcgtcttcgccgacatcgcggatgatgttggtcagttgcagcgcaagtcccatcttgtcggcgtattccagcgtttggtcgtctgaaaaccccaaaatccgcgcaatcaggcagccgaccacgcctgcgacgcggtggcaatacagtttcaattcttcaaaactgccgtaacgggcttgaaccaaatccatctgcatcccgtcgattaaggcttccagttcatatttcggcagcttgaaggtttccttaacttgccgcaaggcctgattgacggggtgttccggcatcgcgccgccgaataccttgtccaaatcgccgcgccaccagttcaatgtcgcctgtgcaacatcggggttggaacattcgtcaaccacatcgtccaattcgcggcaaaaagcatataaaaccgttaccgcatcccgtttttcctgagtcaggaaacggaagcccgacaaaaaactggagcggctttcttctgctttttggcggcaatagtcgagtcctttcacgatttatattcctaatgatgggcgggaaaggcggattttatcggcatttggcggtagagggcaatttcggcggcacgacctaatccttagcggtttgctcaactatcggcgcaaattctgttaaaatgccgctttccttcctttacacaccgcaccgacaggcagaatttatggctcttttgcagatttcagaaccgggtatgtccgccgccccgcaccggcaccgtttggcggcaggcatcgatttgggtacgaccaacagcttggtcgccaccgtccgcagcggcagtgccgcctgcctgcccgatgccgaagggcgcgttaccctgccttccgtcgtccgctatctggaaaacggcggcattgaagtcggcaaaaccgccctgtccgcccaaaaaaccgacccgctgaacaccgtcagctccgccaaacgccttatcgggcggacgcttgccgatctgcatcaaaatacgcactacctgccttaccgtttcggcgacaatcaacgcgttatcgaactgcatacgcggcagggggtgaaaacgcctgtcgaagtgtcggcggaaatcctcaaaacccttaaatcgcgcgccgaagaaaccttgggcggcgatttggtcggcgtggtgattaccgtccccgcctatttcgacgatgcccaacgccaggccaccaaagatgccgcgcgtctggcgggtttgaacgtattgcgcctgctcaacgaacccaccgccgccgcaatcgcctacgggctggacaacgcctcggaaggcacgtttgtcgtgtacgacttagggggcggcacattcgacgtatccgtattgcaactgaccaaaggactgtttgaagtcaaagccaccggcggcaacagcgcgttgggcggcgacgatttcgaccaccgcctgttctgccgcctgctcgaacaaaacggactctcccaactcaacgaacaagacagccaactcctgctctcgctcgtccgcgccgccaaagaacaattaaccacgcaaaccgaagcgcgcattcaggcgacgctttcagacggcatggcaatcgacacaagcatcagtcgcgccgagttccacaacctgacgcagcatttggtgatgaaaacgctcgaaccggtcacacaggcgttgaaagatgccggtgtcggtaaaaacgaagtcaaaggcgtgattatggtcggcggttcgacccgtatgctgcacgtccaacaggcagtcgccaccttcttcggacaaaccccgctgaacaacctcaaccccgacgaagtcgtcgcgctcggcgccgccatacaggcaaacgtcctcgcaggcaacaaaaccgacggcgaatggctgctgctggacgttacgcccttgtcgctcggtttggaaacctacggcggcttggcggaaaaaatcatcccgcgcaattccaccatccccaccgcgcgcgcgcaggactttaccaccttcaaagacggtcagaccgcgatgacgatacacgtcgtacaaggcgaacgcgaactggttgccgactgccgcagccttgccaaattcaccctgcgcggcattccgcctatggcggcgggtgcggcgcgtatccgcgtaaccttccaaatcgatgcggatgggctgctgtccgtttccgcccaagaacaaagcaccggcgtacaggcgcaaatcgaagtcaaaccctcctacggcttggacgacgacaccatcacccaaatgctcaaagacagcatgagcaatgccgccgaagatatggcggcacgcgcccgtgccgaagccgtagtcgaagccgaaagcctgaccgatgccgtcaacgccgccctcgagttggacagcgatttgctggatgccgaagaattgcaacagattcggcaaggcatcgccgatttgcaaggccgtctgaaagacggaaaagccgaagacatccgtgccgccgccgccaaactcggcagcatcaccgacaatttcgccgccaaacgcatgaaccgcaacatccaacgcgcgctgacaggccagagtgtcgataatatttgatacttaaacggtttcagacggcatagaaataatccgatgccgtctgaaggctcgaaaacacttgaaaaacatcgatatggaaaagtcaggcattgtctatctgatgaaaaccgtcatcaagggcgtgtataaaatcggcatttcggatgtaagcaattttgaaggcagaatgcgccatttggaaaacaacggttatgcgaacgttgccggattggaacgcatcctcgccgtcaaaaccgacaattacaaagaaaaagaaaacctgctccatgaaattttcagcaaaagcaggataggcgataccgaattgttcgccgtggacgaaaaccttgtgaaacgtttgtttttatcgcttcgcggcgaaatcgtgttcccgaaaaacgaaacggcggaatcggaatttgaaaaaagcgtccacgaacgcaggcaggaagggaatgccgggtcaggccgcaaacaactgcttgatttggtacggcgcggacaccgggaatacccttacgcgctgccccggcttttggcgggcgcggcattctacaagccgaaaaaatcgaaaatccgcctttttaaagaagcatatttcggcaaaagcggcacgaggctgaccgacgaaattgcagacggcatccatatttacacctgtttttcgcgggcggatttggaaaaagcctattccgaatatttggaacttttcaaatccgaatcggatgccgaaggcagaaagccgcagtaaggtgcaaacagataccgtacacgttgaggagcagatatgatgggcgattccgtcatttattatgtagaacaggcagacgaaccggtaaaccgtgccgacgaacgcgcccgtaaaacattcaaatatttttggcgcgagcttttttgggaacgccgccgcattatttccgccttggattttgccatggtcaaagtcccttttttccaagacggcgaagacggcgaaatttgcgaacatatgtggatcgacgatatttattttgacggtctttatatttacggtgtgctgaacaatgaacccggcgaactgaccaatgtcgaacaaggcgaaagcgtttgcgttccggttgacgacatcagcgactggatgttcgtgtgcaacggcatcccctacggcggctttaccatacaggcaatgcgcgggcagatgacggaagaggagcgcaccgaacacgatgccgcatggggaatcgatttcggcgatcccgggcagatattgctggtgtatgaagaaaaagaacatcccgaaaatctggaagagcatccgatgtgccggaactgtattgacgattttcggcaacagttgtcccaaaactcggattatctgcgggaacaggacgaagacggctatacgccgcttcatcatgaagccatcgcaggaaatgcacttatggttcaagccatgcttgaatacggcgcaaatcctgcctcaacgacatcggaaggctataccgccctcgattttgcctgcctgacgggctggcaaaatgttgccgacctgctcgaaccgcgacattaggcagacagttttccgaaaacgaacacaaacactttttacagaaagacaataaaaatgcccaaaatcaccgtacttccacacacgacattatgccccgagggtgcagtcatcgataacgcacccgaaggtaaaaccgtccttgacgtgctgctcgaccatgatatcgaagtcgatcacgcctgcgaaaaatcctgcgcctgcacaacctgccacgtgattatccgcaaaggtttcgacagcctagaagagccgaccgaattggaagaagacctgctcgatcaggcttggggtttggaagccgattcgcgcctgagttgtcaggcggttgtcgccggcgaggatttgattgtggaaatccccaaatacaccatcaaccacgcgcgcgaagaacactgaaaacaggccgtctgaagccggcacgcttcagacggcattgttgcgcggataaggcgcaatcgcccgaaaacaggcgttcgtacaggcggaactttcgattctatagtgaattaacaaaaatcaggacaaggcggcgagccgcagacagtacagatagtacggcaaggcgaggtaacgctgtaccggtttaaatttaattcactatatattgatttttatcggttttctgacggaataatccagtgcggcatccgaggcggattactcggacgcgatgcaccggtatttatcggttttgcagccggaaaaaccgccggcgggttatagtggattaaatttaaaccagtacagcgttgcctcgccttgccgtactatctgtactgtctgcggctcgccgccttgtcctgatttttgttaatccactatacttttagggcgacggtcgggcagtatgccggatagcgttccactctcgcttctatattgattttgattggttttctgacggaatgacccgatgcggcatccgggacggcttgtgttttttcctgcccgcctgccggattttcccatccttgcgtgaaaccgaaagagacggcggcgcggcggacaagctcgagatagcgtccttcaagctccggacaggcggcggacacgctttctaccgtaaccgtgaaaccgccgcccgacccggcaaggcgttccgcaatttgcgtgtagatgagccaacgttgggcgcgcaacattgccgaatcgcaaccggcagccgctttatccaaggcaatcaggtcgcgccggttttggtggtgaaggcaaaccgttactctggagaggatatgttgcccgtccaatatttgatacagtttgcgtatcagcagaatcaggcggtcaaactcctccatctccgacagggaatcaggatggtcggaagcggtataaaccagtttggacaattttgcggcaaacatattgttcatcaatcttccttgtcggttgaaaccccgctcttcggggcggtagaatcagatttgtttgggagggacaactcctcccagatcaggacgacacataggctggtgcttgatgtgttgtccggcgagttgaaacattcagcaatcctcaaggggcggcagttttgccgaaacatattctacacggcttcaatgccggacgataaaaggaaattcatatgaaatggaccgacacccagcgcatcgccgaagaactctatgacctgcacggcgaaaccatcgatcccagaaccgtgcgctttacccaactgcgcgacctgattatggcattgcccgaatttgacgacgaccccgcccgttgcggcgaacgcatcctcgaagccgtgcagcaggcatggatagacgaggcggaataagtttcgggaatgccgtctgaaatgcggcggtacgcggttcgtgcttctgtttgcagcgggaatggttttaccagtctccttttttcagcctgtccagttggcggcggtcgcgcttggtcggtctgccgtcgggataggcggaagtgatgcggctgaattggtcgagctgtttgcgctcttccctcaatgttgccgttttcgcgtcctcttcatacagaagccgcgcctcggatgccgggcggcgttggtggttcaaacctttaaccttgattttatagggaagggaattgagcgtcaggtcgataatatcgccgatgtctatggttttactgtttttgaccttcgagccgtttacttgaaccctacccagttcgatgtgcttttgcgcaagggaacgggtcttgaaaaaacgtgccgcccaaagccatttgtccagccgcatggcggaagaatcgtgcttgtctttcatacgattttgtttgaaataattgaatttgtttcgagtttagcataagatacgccgccttataactagtatatatgcactaatccactgttttccatgctgtccgaacacaaaaagagggtatggaaaagccgttttggacaataaattaactgcggaatatgcacaaatagcgtatgatagcggcagaatctgttgatgagagcttcattctatgaaacctgtttttttggattttgaacaacccatagccgaactgaccaacaaaatcgatgagctgcgtttcgtccaagacgagtctgccgtcgatatttcggacgaaatacaccgtttgcagaaaaaaagcaacgacctgaccaaatcgattttcagcaaactcacacccgcccaaatttcacaggtttcccggcatccgcagcgtccctatactttggattacattgaggcactgtttaccgattttgaagaactgcacggcgaccgccactttgccgacgattatgcgattgtcggcggattggcgcgtttcaacggacaaagcgtgatggtcgtcgggcatcagaaagggcgcgacaccaaagaaaaaatccgccgcaacttcggtatgccccgtcctgaaggctaccgcaaagccctgcgcctgatgaagacggcagaaaaattcggcttgcccgtaatgacctttatcgatacgccgggcgcgtatcccggcatcggcgcggaagaacgcgggcagtcggaagccatcggcaaaaacctgtacgaactgacgcgcctgcgcgttcctgttttgtgtaccgtcatcggcgaaggcggttcaggcggtgcgttggcggtcgccctaggcgattacgtcaatatgctgcaatactcgacctattctgttatctcccccgaaggctgcgcgtctattttgtggaaaaccgccgaaaaggcggcggatgcggctcaggctttgggcattactgctgaccgcctgcaaaagctggacttggtcgataccgtcatcaaagaaccattgggcggcgcgcatcgggatttcgggcaaaccatgaaaaacgtaaaagccgttttggaaaaacaactgcacgaagcgcaaagcatcccgcttgccgatttgctttcgcgccgtttcgaccgcattatggcttacggcaaattttcggaacaataattcaggtagaacaagcagcaagcagtttgtctgaaactgcttgctttttctttatcgggacggaaccgtgctgactttagatgcgtttgagcaatgcttgaaggattgttttcctcaaggtctgaatggaaaaaaaacagcggtggcattaagcggcggcttggattccgtcgttttgctgcatctgcttgtccgcgccggaaaaaagggcggttttattccggatgcattgcatatccatcacggcttgagtccccgtgccgacgattgggcagatttctgccaaaactattgcgatatgctcggggtggggctggaaacggttaaggtctgcgtggaaaaaaacggtttgggcatcgaggcggcggcaaggcaaaagcgttatgccgcgtttgccgaaaaaggctttgacgttttggcgttggcgcaccacagggacgatcaaatcgaaacctttatgctggcggtcgcgcgcggcggcggtttgcgcgctttggcggctatgcccgccgtccgcccttttggggaaaaaggcatcatctggcggcccttgctgcctttttcacgccaagatatatgggattatgcccaaaaacacggtttgccgaatatcgaggatgaaagcaataccgatacggcttatttgcgaaaccgcttccggcaccgtattttgcccgaactttcggcgcagattccccatttcgggcggcatgtgctgaacaatgtccgcgctttgcaggaagatttggctttgttggacgaggtcgtcgttcaggactgccgttgggtttgcggggccggttatttcgatacggcgcggtggctgacgttttccccgcgccggaaaacccatattttgcggcattttctgaaggaaaacggcattcccgtgccgaatcagaatgcccttgccgacattgcccgggttttgacggaggcaaaaaccggacgttggaacttgcaaggctttgaattgcatcattatgcaggcaggctgtttgtgttccgactggaaaaaacggataaactgcggtttttgaaagacaggcagataagcggaaatttaagggaaatattgacggggcagggatttgtgttgaagcggcatccgtttgggcttcctgagcatcttttggagcaggacggaattttgaggacggtagcggcatcggatacgttggccatgggcggcatccataaggatgtgaaaaaaatccttcaggggaaacgggttttgcctgtcctgcgcccaatttggccgcttgttgccgacagcggaaaccgtccattggcgttggcaaactgttgtgcggatttccaatactcggtttcagacggcattttgcccgtccatcctgactttcccattttattttgataatatcgcaaacagatttcggcggcgttcagtcgggtattgtccggttgcatatttctaaaaggcttgtgaagtgaaacacatcagttcgaccaataatgaacacatcagacacctgcaccgcctgttgtcgcaaggaaagttcagacggcaatacgcccaaaccgttttggagggcgtgcacctgcttcaggttttcctgcaatccggcgggatgccggtcggggtatatattcccgaagcgaaaatgccgtctgaagaagtccgtaaattgacggcggttttgccggaagacgggtttttttccgtttcagacggcatattgaagaaaatcagcagcctgacttgtgcggatgatgtgcttgcgctgattgatattccagatgcgggtgctttgccggccggcggcgattgcgtggttttggacggcgtgcaagacccgggcaatgtcggcacggtgttgcgaagcgcggcggcggcgggaatcggcgcggtcattttgggcaaaggttgtgcggacgcgtggtcgcccaaagtgctgcgagccggaatgggcgcgcatttcttgtcggagatttatccgcaggcggatttggaaatatggttggtgcgctataaaggccgtgtgtttgccaccgccttgcgcgaggaaaagcaggcggttttgtacggcgaagatttgtgcgaaccgacagcctgggtgtttggcaacgaaggcgcgggggtcggtaaagcagttttagatagggcggacaagtgtgtcaggataccgatgcacgatgcaaccgagtctttaaatgtcgcgatggcggcgacaatctgcctgtttgaacaaatgcgccaacgggcggcgtattgaggaagagaaatgccgtctgaaaaaatctattacggcgtattgattttcttatgtatcgcttctatgctgctgtcgccgtttttttatgcgggtgctttgaagcccaagaaggcggcattgcggaaggacgggcagtggaaactcatctgattgtccaatgccgtggcggcggcggttttggcttgggtgtggtggaaatggttttgacagatattgctcaaaatcgtgctaatggaatccgaacaaataaagaatttggtaaaaaatttgttaaatcaacgaattaaagttttgtggaaaacaaaacagctctaagcaaatagggcgtttgtcggtaaatacggaagagttgcggcattatcgggcatctttaacaagtagtgccgtcttgacaggcaatcggtttttatgggcagcttgcaaaatcgcggatataaaattgcgaatcggttaaagtgtggggacgctatgaaaaattgcgaattttttatgacccgacaagggcaatctatgatagcggtgcagattacttaactagggaaaaacatagattagtcgtaattgcaaatagtgcttgggggctattgcttaatttatcttgttattatgacgaggttttggaaaagcggaaaataccgttcggcaaacaggaaattgatgacgatatggacaaagtgtccgcccttaagcggaagtttaaagatatttctgaaatcaaagtaggggatggttgggaatacccgttcaattatgagcagggaatgaaagaattagatgaagtgctattgaaatacattcccttttttgaagaagaacgataaaggaggttgatatgcgcgtatctaaaataattggaagtatgttgcttgttacagcggttcagaccgtattttcggcaaatgtttacgcgtgccgccataatggtaaaaccagttacagccaaactccgggaaaacattgtaccaacgcgggtttggggcgggaccgggtgtacagttcggttagaccggcagtaaaagacagggcggaagacgcaggggtcggcgattattcggacacggtgagggacgaacacgtccaaaatccgaaaggaaatgcacagaaagacggttcggctgccggcatcaagccgcactgattgaagccgaatcagcccttgcgctgtcggacggcaaaatttgaacgattggggaactttgatgaaacacatccatattatcggtatcggcggcacgtttatgggcgggcttgccgccattgccaaagaagcggggtttgaagtcagcggttgcgacgcgaagatgtatccgccgatgagcacccagctcgaagccttgggtatagacgtgtatgaaggcttcgatgccgctcagttggacgaatttaaagccgacgtttacgttatcggcaatgtcgccaagcgcgggatggatgtggttgaagcgattttgaacctcggcctgccttatatttccggcccgcaatggctgtcggaaaacgtgctgcaccatcattgggtactcggtgtggcggggacgcacggcaaaacgaccaccgcctccatgctcgcatgggtcttggaatatgccggcctcgcgccgggcttccttattggcggcgtaccggaaaatttcggcgtttccgcccgcctgccgcaaacgccgcgccaagacccgaacagccaatcgccgtttttcgtcatcgaagccgacgaatacgacaccgcctttttcgacaaacgttctaaattcgtgcattaccgtccgcgtaccgccgtgttgaacaatctggaattcgaccacgccgacatctttgccgacttgggcgcgatacagacccagttccactacctcgtgcgtaccgtgccgtctgaaggcttaatcgtctgcaacggacggcagcaaagcctgcaagatactttggacaaaggctgctggacgccggtggaaaaattcggcacggaacacggctggcaggccggcgaagccaatgccgacggctcgttcgacgtgttgctcgacggcaaaaccgccggacgcgtcaaatgggatttgatgggcaggcacaaccgcatgaacgcgctcgccgtcattgccgccgcgcgtcatgtcggtgtcgatattcagaccgcctgcgaagccttgggcgcgtttaaaaacgtcaaacgccggatggaaatcaaaggcacggcaaacggcatcaccgtttacgacgacttcgcccaccacccgaccgccatcgaaaccacgattcaaggtttgcgccaacgcgtcggcggcgcgcgcatcctcgccgtcctcgaaccgcgttccaacacgatgaagctgggcacgatgaagtccgccctgcctgtaagcctcaaagaagccgaccaagtgttctgctacgccggcggcgtggactgggacgtcgccgaagccctcgcgcctttgggcggcaggctgaacgtcggcaaagacttcgatgccttcgttgccgaaatcgtgaaaaacgccgaagtaggcgaccatattttggtgatgagcaacggcggtttcggcggaatacacggaaagctgctggaagctttgagatagcccgggcgatgccgtctgaaagcccttcagacggcatcgcccggctgcgcggcacaaaggcggaaaaaccgtttgccccgtattttcaaacgcgttacacttgccgccgctgttttcagccatttgattacccgcaaccgccgtcattgcgccggcggtttgcctgtcagcgtcattgcgccgctgtaaatacgaaagaacacattatgaccgtatcccccgtcgccttgcgccgtaagaccgagtgcaagcctcatcccaccgcgcgctattggaaaaaatgcgatgtcgaagccctgttcggacttcccttcctcgacctcatttaccaagccgccgaaatccaccgccaaaatttcaacccgcgcgaaatccagctttccacgctgttgtccatcaaaaccggcggttgtcccgaagactgcgcctattgtccgcaatcggcgcaccacaataccaatctgggcaaagagcagatgatggatgtggatgaaatcgtcgaaaaagccaaaatcgccaaatcgcgcggcgcaagccggttttgtatgggcgcggcgtggcgcggccctaaacccaaagacgtggagacggtttccgcaatcatcaaagccgtcaagggcttgggtatggaaacctgcggcacgttcggtatgctcgaagaaggtatggcggaagacttgaaagaggcgggcttggattattacaaccacaacctcgacaccgaccccgaccgctacaacgacatcatccacacccgccaacacgaagaccgaatggacaccttgggcaaagtccgcaacgccggtttgaaagtctgctgcggcggcatcgtcgggatgaacgaaacccgcgccgaacgtgccgggctgattgccagtctcgccaatctcgacccgcagcccgaaagcgtgccgattaaccggttggtcaaagtggaaggcacgccgcttgccgatgccgaagatttggactggacggaatttgtccgcaccatcgccgtggcgcggattacgatgccgcaaagttatgtccggctgtcggcagggcgcagcaatatgcctgaagcaatgcaggcgatgtgctttatggcgggcgcgaactcgattttttacggcgacaagctgctgaccacgggcaatcctgatgaggacggcgacagaatcctgatggaaaagctcaacctgtatcccttgcagtttgaaccggaaggcgaggtcgccgaagtggaaaaagcctctgggattaaagtggattattgacgattgaaaaatgccgtctgaaacccggaaaaaggctttcagacggcatttgtccggacggcatttccaatatctttttaccggcgcgtgatgctgccgtcgggcgagacatccagcccgttccccttggggaaatcgctgcggttcagataaataatccgcccgataacggttttctcggggtcgattttggggattttatcgccgacttgagtgatggggataatgttgccggaaacgaaccgcccctgtttgtcggtgataattttaaaaatgggggcgatgccgctgatgccggaggtgttgattgcgccgtaggtggcaaagttgccgccgctgtaggagatgaagcggtcgcggtaaagttcgacggcgcgagtaacgtgcggcccctgcccgaatacgacatccgcgccggaatcgacggcaagccgcgcaaactcaacgacgttgcccctgttttccccatagaagatttcggtatcgaacggcaggtgttccgcctgtttcccttccgcgccgccgtggaacatcacaatgacgatgtcggctttctgtttggttttggtaatccgttttctaactttggcataatcgttcagtttgacggcggcaaggttgggggcgaaggagacgaagccggatcttacgccgtttttcttcaggatggcggtttcaaacctgttttcgatgcccgaatatttgatgttcaattcgtcaaggttcgccctttatgccgtttccgcaccgcaaaccgccggggtcaagccctcggcgcatcctgccggaacggaatccccgtgctgccgattgacggttcaaaccccgcgcccgtttcaaataccggcgatgtggacggacaggatgcgcctgacgaaaagacagccgataccgtttccattatcggcgtgggcgacattatgctcggcagcaattatccggtcgattacctgcccgataccaatattctgaaaaacgtcgaatctgccttgcaagacgcggacattaccgtcggcaacctcgaaggcacgctgtttgacgaaggcggtacgccgaaaaaatgtgcaaacccccaaaatatgctatgcattccgaacgccctccgcatacgggcaataccttgccgacgcgggattcgactacctcagcttcgccaacaaccacagcaacgacttcggcgcgcaaggcatcacggcaacggcggcgagcggcagctcttttacatactcgatcgcgctaaagccgctgccgataacgaggccaaaattgcggaaaataccgccatcgcccagataaatttgtccatcatcagacctttactgttcagacgagacagcatttgccgcacgttttggggcttatctttcgatttgcgctacgtcgcgcaccgcgcctttgtcggcggaagtcgccatcgcgccgtaagctcttaatgcggcggagacgtagcggtcgcggtttttaggcttccatgctttgctgccgcgcgcttccatttcggcacggcgtgcggcaagctcttcatcggaaatggcaaggtggatgctgcggttggggatgtcgatttcgacggtatcgccttcgtgtaccaaaccgatcgcgccaccttccgccgcttcgggcgaggcgtgtccgatggacaaacctgatgtgccgccggagaagcgtccgtcggttaagagagcgcaggctttgccgaggcctttagatttcaggtaggaagtcggatacagcatttcctgcatgcccgggccgcctttcgggccttcgtagcggatgatgacgatgtcgccagcgacgatttggttgcccaaaatgccttctactgcgtcttcttggctttcaaacacgcgggcgcggccggtgaatttgaggatgctctcgtccacgcctgcggtttttaccacgcagccgcgctcggcgatgttgccgaacaagaccgccaaaccgccgtcttgcgagtaggcgtgtgccacgtcgcggatacagcctttttcgcggtcgaggtcgagggttttccacatacggttttgcgagaacgcttgggtggtgcgtacgccgcccggcgcggctttgaagcgttcgatggcacgggtgttttcgggattggtcacgtcccattgttcaatcgcgtctttcagcgtcggcgcgtggatggtgtgcacgtcggtgtgcagtttgcccgctttgtccagttctttcaggatggcgaagataccgccggcgcgatgcacgtcttccatatagtagtcgtggttgttgggtgcggttttgcagatgcagggcacgacgcggcttaagcggtcgatgtctgccattttgaaatcgacaccggcttcgttggcaacggccaacaggtgcaaaatggtattggtgctgccgcccatcgcaatatccatcgtcatagcgttttcaaacgcttttttggtggcaatgctgcgcggtaacacggtttcatcgttttgctcgtaatagcgtttggtgatttcgacaatcatacggccggcttcgaggaacaattctttgcggccggcgtgggtcgccaaatacgaaccgttgccgggcagggaaaggccgagtgcttcggtcaggcagttcatcgagtttgccgtaaacatacccgaacacgagccgcaggtcgggcaggcgttttgttcgacttcctcgacttgccggttgctgacattgtcgtccgccgattcaatcatcgcgtcaatcaagtccaaacggcgttcgggctggatgtttgccacgccgataaccttgcccgcttccatcgggccgccggagacgaagatggtggggatgttcaggcgcatcgcggcaatcagcatgcccggggtgattttgtcgcagttggaaatgcacaccagcgcgtcggcgcagtgggcgttgaccatatattcgatagagtcggcaatcaaatcgcggctgggcagggagtacagcatgccgctgtgtcccatagcgatgccgtcgtcgatggcgatggtgttgaattctttggcgattgcgccggctttttcgatttcgcgggcaaccagctggcccatattgtgcaggtggacatggccgggcacgaattgggtgaaggagttggcaacggcgatgatgggcttgccgaagtcggtttccatcacgccggtggcgcgccacaatgcacgtgcgcccgccatattgcggccgtgggtggaggttttggagcggtattcaggcatagtgtgtttccttgtgcctataccgtctgaaagacagggctgtttcagacggtatcgggtacggttttttagagtgggaaaagagggtattttataccaagtatcggaattttgcgggattgaaacggcgtgcggcaaaaaagaaaatccccgcaggaatgcggggacgggttcaggcgcgggcaatcgcgacggctttggatgcgtcccaaaaatcaacgggtgcatttaatacgggtttgacgatgcccgtccgtatggcgaaatcgccgaaaccttcgccgatattgcgttctgccgcccatttgccgatcaggtcgtccaattcggcaaggatttcgggcagggtgatgttttctttgtaaagacgggggatgcgtacgccttcacggtcgccgccgatatggaggttgtagcgtccgacggctttgccgaccagtccgatttccgccaacatcgcccgtccgcagccgttcgggcagccggtaatgcgggtaacgatgtagtcgtccgacgtgccgtgtttcgccataatcttatccagctcgccgatgaagtccggcagcacgcgttcggcttccgccattgccagcgggcaggtcggaaaggaaacgcaggacatcgcattttcacgcagcttgctgacatcgttgcggattaatccgtatgttcgggcaaattcttcgatttttgctttgtctgcttcggcgacatttgccacgatgaggttttggttggcggtgatgcggaaatcgcctttgtggattttggcgatttccaacacgccggtcagaagctgtttcccgccttcgtcaaccaaacgcccgctttcgatgaaaagggttaaatgccagttgccgtctatgcctttcacccagccgatgcggtcgccgcgcccggtaaatttgaacgggcgtacgggttcgaacggcatacccatacggcgttcaacttccgcgcggaagttgtccaagcccatattttgaatggtgtagcgggtgcgggcgtttttgcggtcgctgcggttgccgaagtcgcgctgcgtggttaccaccgcttcggcggccttcagcgcgtgttccggaggcacgaaacccagttccagtgaaatgttcggataggttttggtgttgccgtgttccatcgaaagcccgccgcctgccaaaacattgaagccggcaagctgtccgttaccgtctgaaacggcgacgaaatccaaatcgttgccgtagcagtccacatcgttcaagggcgggatgacgactgcggttttgaattttcgcggcagataggttttgcccaaaatcggctcgtcttcttgaaggaagtcgtcggaactttgaacttttttgccgtccacccacacatccagataaccgcgcgtgcgcggcagcaggtgttcggaaatctttttcgcgtattcgtaagcctgccggtgcagttcggactcgatcgggttggacgtgcaaagcacgttgcggttcatatccgccgccgtggcgatggaatccaaacccagtttgtgcaagaggcggtgcatcgtctgcaacttggctttcggcacgccgtgaaattggaaggtttgccggttggtcagccggatggagcggtaatgactgttttcccgggcaaatttgtccagttctatccattgggacggtttgatgatcccgcccggcagccggcagcgcaaaagcataaatttcaagggctcgagttttgcctcggcgcgttcggcgcggatgtcgcggtcgtcctgctcatacataccgtggaagcggatgagttggaagttgtcgcctttgaagccgcccgtgagcgggtctttcaaatcgtccaaaatcgtgccgcgtaaaaaattgctttcggttttcagacgttcgttgtcggatagcggtttttcttgccacgccaaaccttttgtcttggtctgtacggtcattttgtgttcctcccgattatatttaatcaataaacatcacgctgatagcgtttttcttcgcgcagcatatccaaatattcttctgcgccctcttcgtccaaatgtcctgccccgataatcacatccagcaaggcggcttccacgtcttttgccatttttgccgcatcgccgcacacatagatatgcgcgccttcctgcagccattgccaaagtccttccgcctgttcgcggattttgtcctgcacatagattttttcttcctgatcgcgggaccaggcgaaatcgtacctgtgcaggaagccgtctttggcaaactgctgccattcggtttgatagagaaaatcacgggcaaaatgcggattgccgaaaatcagccagtttttgccttccgcattttctgcggcacgttgttggacgaaagcgcggaacggtgcgacgccggtgcccgagccgatcatcacaatcggcttgcggctgtcttcgggcagcctgaagccgtcgttgcgttccacaaacacgcgcaccgtgccgtcctcttccagccggtcggcaaggaaacccgatgcgccgcccgttctggcgcggccttcgtgttcaaaacgaaccacgccgacagttaaatgcacttcatcgcccacttccgcctgtgctgaagaaatcgaatacaaacggggtgcaagcggacgcagtaaacggatgaattgttctgccgtcaggcttgccgggaagcggtgcagcacatcgacaataggcgtgttttgcacgaaatcctgcaaaacggcgttatcggcaatgattttatcgagttcttcataatgggcgaacgcggcatagcctttgacgaaagccggagtgttttgcgtgagttcgaaatgagatgaaagtgcgcgcgcaaccggcatcatctttccgcccgcctgtatttccgttgccggatcgatgccgagcaggtctaggatttccctgaccagtgccggatcgttgtcaaaccaaacgccgagcgcgtcgcccgggaggtagtgcaaatccgaaccgctcaaatcgatttcgatgtggcgcacgtctttatcggattggcgggcggtgattttctgattggccagcagggcggcgggaaagggggctgccttgcagtacctgccatccggtgccgtctgaaggccggcggggggcgttgtctgcggcgcgggcgttgcccggttttttgcggcttcttcttttaagagtgcggcgatattatctgtccaggcgtttgcggaggcggtaaagtccaaatccgcatcaacgcgttcgagcagccgttttgcgcccaattcttcaaaacgccggtcgaaatctttacctgcctgacagaaattcggataggaactgtcgcccaaacccagtacggcaaattggagtttgtccaatttcggggcttttttgccgttcagcagtttgtgcagcacgacggcttctttcggcggttcgccttcgccttgggtggaggtaaccagcagcaggcggcgttcgccggcgatgtttttcgccttatagtctttcagttcggcgcgactgacttggatgccggcggcttccaggctgtccgccgctttgtcggcaacggatttcgcattgccggtttgcgaggcggaaaggacggttacggaaaaaggttctgccgccggcaatgccgtctgaagcgcgggcagtcctgcagatgccccgtttcctgcttttgcccaagcgtagccggacagccacgcccattgtgccgcgtccagccccgacaggagctgcgtgatttcgggcggcagaggcggtaatggcggatttgtgttctgcatatcgtgttcactcataaaatcatacctgccgcaacagtgccgtatgtcgcttcgtctatcaggataaacgaaccggcggcggtgttttccgcataaggcgttgccgtaacgggtttttgaaggttgatgcggactttggcgatgtcgttcatcttcaaggattccgcgccggcctcttgttccagcgtgcggacatccaaaacgctttcaatttccccgacttttgccggcacggtttgcgtgccgtgcttgagcaggtatttgcgcgcggtgttgagcggacgttcgtcaaaccagcaaagcgtggcttccagatgtttttgcggggcgagcggggaatttttatcgacaaaaaggtcgccgcgcgaaacatcgatgtcgcggtccagccggagggttgccgcctcgccggcaaaagcctgcgccacttcccctttcggcgtgatgatttcggacacttcggcggtcagcccgttcggttcgatgcggacggtttgcccgacggcgaccgaaccgcgttcgatgcgcccctgatagcctcggaaatcatcggccttgtcggcatcttggcggacgaccagttgcacggggaaataaaaatcgtcggcggtgcggctgacttcgtccgcccccggcagggtttccaaaatggacaataagggttcgcctttataccaaggcatattgccgccggggtaaacaatgttgtcgcccaagagtgcggacatcggtacgaaatgcgcgtctttcaaaccgagctgttcggcaagtcggcggtatgcctccacaatggcgttgaatttgtcttcgctgtaatccagcaggtccattttgttgaccgccaccacaatatgcgggcagttgagttggcggaggatggcggaatggcgtttggtctgcggcagaagctgcaagggctgcgcgccgaaatccagttgggatgcgtcaaccagcacgactgccgccgaagcggtgcttgcgcccgtaaccatattgcgcgtgtattgttcgtgccccggcgtgtcggcgatgatgaatttccgtttcgccgtggaaaaatagcggtatgccacatcgatcgtaatgccctgttcgcgttcggcttccagtccgtcggtcaggatggagaagtctatggcttctttcaaacctttgcttttgccggattccaaggttttgatttggtcggacagcagggctttgctgtcgtagagcagtcgtccgatcagggtgcttttgccgtcatcgacgctgccggcggtaatgaagcggagcggggtttggtgttgtgccgtcatattttcttcctcatatctgcttaaagggtttttgaaatttagaaatagccttcttttttgcgtttttccattgccgcctcgcttgcctgatcgtccagccgggtcgcgctgcgttcggaaatgtcggcaaccgctgtttctctgataatctccgtcggcgtggacgcggtgctttctaccgggcaggtgcagctgatgtcgccgacggtgcggaagcggacatcaaggatttcggaggtttcagacggcattttcggggtgagcggcgttacagggaccagcagccccctgcgtctgaccacttcgcgcctgtggctgtaataaatcggcggcagctcgaggttttcgcgggcgatgtattgccagatgtcgagttccgtccagttggaaatcgggaagacgcgcatattttcgcctttgtgcagcctggtgttgtacagcgaccacagctcggggcgttgcgccttcggatcccattgtccgaactcgtcgcggaacgagaaaatccgttctttggcgcgggctttttcttcgtcgcgccgcgcgccgcccataagcgcgtcgaagccgtttgcctcgatggtttccaacaaggtaaccgcctgtgccgcattgcgcgaatcggtttctttgcgtaagaccaccgtgcctttggcaatggagtcttccacgcgccccactatcaggcgggcattgagttttgccgcctgcgcgtcgcggaaggcaatcacttcggggtagttgtgtcccgtgtcgatatgcaccagcgggaagggcagtttcaccggccggctgcccagccggaaggctttgcaggcgagggcgagcaggaccacggaatctttgccgccggaaaagagcagggcggggttttcgcattctgccgccacttcgcggatgatgtggatggattcggattccaaccagtcgagttgggcgttgttcggttcggttttcgtcataccatattccttatttcttctgtctgatatttatgaattatttgtgcagcccgcattctttgctgtttctgccttcccaccaccaccgcccggcgcggatgtcttcgcccgccttgacggggcgggtgcaggggtcgcagcctatgctgggaaatccttgccggtacaaatcgttgtaaggcacattgttggcgaggatgtatgcccacacgtcgtgttccgaccagtcgaaaatcgggttgtatttgccgatgccccgtccggcatcgtattcggcaaacggcagttccgtgcgtgtggcggattgttcgcggcgttgcccggtaagccaggcgtccgcgcctgcaatggcgcggttgagcggttcggtttttcggatgcggcagcattcgcggcgcgcttcaacgctgtcgtaaaaggcaaacctgcctttgctttccacataacggtcggcatcttctcgaaccggccggaaacgctttatccgcaaatggggatatgcgcgtccgagcctgtccagcaggttcagggtttccgtgtggagcagccccgtatccaaggtaaaaatgccgatattgaggttttcgccggcgataaggtcggtaatcaccatatcttctgccgcaaggctgctggcaaaccgtgcatcccggtggctgccgacaatccggtgcaggcgttgtttgagggtttccgttttttccgcaagggcggtttcgccgccggatccgatatgcggtatctgccacagggcgggtttgaacagtgtcgtttccatttttcccgccttatgccgcccgttgtccggcattcagtccgcccaatgcgggatacgtctgcccgacccggttttctccttcgccgttttcaccgaaccaggcgagtttttcgtgcagccccaccacttcgcctatgacaatcaatgccggattcggcgcggtttcggcgagttcggcaaggttggcgagcgtgccggttgcggttttttgagccggcagcgtgccttggctgataacggctgccggcgtgtcgggcgagcgtccgtgctgttgcagccgttcggcaatcagggcggctttgagcgcacccatataaatcaccaaggtctggcggctgcgggcgagggtctgccattcgatgtcgggcgcatccgccttgcggtggccggttacgaaaaccgcactttgggcataatcgcggtgcgtgagcgggatgccggcataggcggtcgcgccgacggcggcggtaatgccggggacgaccgaaaacggaatctgatggcgtgccaaggtttccaattcttcgccgccgcgtccgaacacgaaagggtctccgcctttcaaacgcaccacgcgcctgccttcgcgggccagcctgaccataagcgcattggtgtcctcttgcggggtgcgctcgccccgggcgcgcttgccgacaaaaatccgttccgcatcgcggcggacgagggacagtatgccgtctgaaaccagcgcgtcgtaaagcaccacgtctgcctgctggatttcctgcagccctttgagcgtcagcagccccgcatcgccgggacccgcgccgaccagcgagacggagccgccttgatcattttgacgactttgttccaattggcctgccaattcccgttcggcaagggtgttttgccggtttttgacgagggcggcgaaacgtccgttaaactgcttttcccaaaagcggcggcgttcggtaacggatttcagtttgcccttgacggcatcgcgccaccttcctgaaatttccgccatatcgcccaaagacggcggcagcagggcttccagcctttcacgcagcagtcgggcgaggacgggcgcgctgccggagctggaaacggcaatctgaaccgggttgcggtcgataaccgacgggaagatgaagctgcaatggtcgcggtcgtccaccacgttgaccggcttttggcagctttcggcaagatggaaaacgcgccggttgagggcttggtcgctgcttgccgcaatgatgaggaaaaccgtgcggatgtgttcggcacgaaattcttcggcaagccacaggattttgttttccgccgccaacgcggagagttcggcattcaggtgttttgcggcaaccctgacctctgcgcccgccttcagcagcaggctgattttgcgtgcggcgaccgcgccgccgcctacgaccaatacggggcggccggcgaggttggcgaaaatagggaaataattcactggctgactcctttgctgtttgcccgcaccttgtttccgatacggtgcgtcgcggcatttttgtcggaatgcgggtcattttagacaaaaggattttccccggttaaataataaaaaggtatttgttagaagctgaaagctatatgggggcggctgcggatgcggcggttttccgttttataacggtttcggaagaaaaacggcctgaagccgtttcgggcattcagaccgtttgcgtggtgaggggatgccgtccgaagggcgaaaagggcttcagacggcattgatgtcgggtttcaggacaggagcaggatggcggctgcggcaagcgaggcaaccgataatgcggcggcaagcgcggctttgcctgcaaagcggattgaggttttgccttcgatgtatttgaagccggttatcatcgggaggatgaggtttttctttttgaatacgcggtatgcggcgacggcggcgatgtggattgcagaaaaaacggcgagcagcttgaaaaagttgaggtggattttccgcataaggctgcccgtatgttcggaaaccaaatggttgaggtagccgttggtgctgaaggtgttttcatcggcggcaaaaagcccggtgccgacttggaaggacacggcggccaaaagcgcaacgaccatcagtgcgcccaaggggttgtgtccgggctggatgtgttcgggaataccgtttttcagatagccgcgtatgcctgcccagccttggacgaaacgggaaaaacgggcggtatcgctgccccaaatgccccagcagaggcgaaatacgagcaggaaaaggacgaacagcccgacgcgcgtgtgccattgcagcatatcgccgccggctttcgcgctataccacataaagggcagggacgcggcaagcagccagtggaaaaggcgggtggggaggtcccagactttggttttgtttttcataatcggtttccggcggtagaatcggtttgttttcgagccttattttaaccgattggaggggcaatgtttcccgtttttcatctttcaggcgagagccgccgccagatgcttcagacggcattgcgttttccccatgttttcaaagcccgtgcggaagattcgcacaaagggactttcggcacgctcgccgtagtcggcggatcggcagggatgagcggcgcgcccgtattggcggcatcggcggcaatgtatctcggctgcggcaaagtgtgggcgggtttcaatcaggatacgctaccttttgccgttattgccggttttcccgagattatgctggatacggcggacagtttggccaaacgtcaagatataaacgcctgggttgtcggttgtggattgggtacaggtagggcggcggtcggaacgcttgccggaattttgacggaacacacggacaagcccgtcgttttggatgcggatgcgctgaacatattatcaaccgatgccgaaacccgaaatctggcgcgcgggtgtaaaaacctgattttaacgccacaccccgccgaagccgcgcgcctgcttggaacgacggttgcgcaggttcaggcggatcggacggcggcagtgaggaagataggggcaattttcggcgcaaccgtggttttaaaggggcacaaaacattggttgcctcacccgatacggaaatctatgtcaacgaaagcggcaacgcgggattggcaacggcgggcagtggcgacgtattgggcggcatcatcggcagtctgctcgcacagggcgtgccggtttttgaagccgcctgcgcgggcgcgtggctgcacggcgcggcggcggatgtcataaaagaatcggcaggcattgcggcagggctgttggcaggggaaatcgctccggcggcaaggtggctgcgcaaccggataactaaaagtatgtaagaagatatagtggattaacaaaaaccagtacatcgttgcctcgccttagctcaaagagaacgattctctaaggtgctgaagcaccaagtgaatcggttccgtactatttgtactgtctgcggcttcgtcgccttgtcctgatttttgttaatccactataccgtctgaaaggcaagggcttcagacggcatcttcatttcccaaatactgtccggtaaagcgtggtataatgcgtagttatctcttacagtttttgaaaaacattaattatgaaacaaatccgcaacatcgccatcatcgcccacgtcgaccacggcaaaaccacattggtcgaccaactgctgcgccaatccggcacattccgcgccaaccagcaggttgacgagcgcgtgatggacagcaacgaccttgaaaaagaacgcggcatcaccatcctcgccaaaaacaccgccatcgattacgaaggctaccacatcaatatcgtcgacacgccgggacacgccgacttcggcggcgaagtagagcgcgttttggggatggtggactgcgtcgtcttgttggtggacgcgcaggaaggcccgatgccgcaaacccgtttcgtgaccaaaaaagccttggctttggggctgaaaccgattgtcgtcatcaacaaaatcgacaagccgtccgctcgtccgagctgggttatcgaccaaactttcgagctgttcgacaacttgggcgcgaccgacgagcagttggatttcccgattgtttacgcttcagggttgagcggtttcgccaaattggaagaaaccgacgagagcaacgacatgcgtccgctgttcgatactatcttaaaatatacgcctgcaccgagcggcagcgcggacgaaacgctgcaactgcaaatttcccaactcgactacgacaactacaccggccgcctcggtatcggtcgtatcttgaacggacgcatcaaacccggccaaaccgttgccgtcatgaaccacgatcagcaaatcgcccaaggccgcatcaaccagcttttgggtttcaaaggtttggaacgcgtgccgcttgaagaagccgaagccggcgacatcgtgattatttccggtatcgaagacatcggtatcggcgtaaccatcaccgacaaagacaatcccaaaggcctaccgatgttgagcgtggacgaaccgacgctgacgatggactttatggtcaacaccagcccgctggcgggtacggaaggcaaattcgtaaccagccgccaaatccgcgaccgcctgcaaaaagaattgctgaccaacgtcgccctgcgcgtggaagataccgccgatgccgacgtgttccgcgtatccgggcgcggcgagctgcacctgaccattttgctggaaaacatgcgccgcgaaggctacgaactcgccgtcggcaaaccgcgcgtcgtgtaccgcgacatcgacggtcaaaaatgcgaaccgtatgaaaacctgaccgtggatgtacccgacgacaaccaaggcgcggtaatggaagaactcggccgccgccgtggcgaactgactaatatggaaagcgacggcaacggacgcacccgcctcgaataccatattccagcgcgcggcttgatcggtttccaaggcgaatttatgaccctgacgcgcggggtcgggctgatgagccacgtgttcgacgattacgcgcccgtcaaacccgatatgcccggccgccacaacggcgtgctggtgtcccaagagcagggcgaggcagtcgcttacgccttgtggaatctggaagaccgcggccgtatgttcgtatcgcccaacgacaaaatctacgaaggcatgattatcggcatccacagtcgcgacaacgatttggtggtcaacccgctcaaaggcaaaaaacttaccaacatccgtgccagcggtaccgacgaagccgttcgcctgaccacgccaatcaagctgacgctggaaggtgcggttgagtttatcgacgatgacgaactcgttgaaatcacgccgcaatccatccgtctgcgcaagcgttacttgagcgaattggaacgccgccgccactttaaaaagctggattgatgtttactggattaatgtttaaatgatacgcgatgccgtctgaaaaatttcagacggcattttttattcggacgggctttgcggcttcttgaagctgtttcagacggcgtttttcctacccaatcaagaaactgccgccatttttccagcggtatatcgccccgtcgcgtttcggtatcgggttcggcttcccggcagcatgtcgaacaatgccgtttgaaggaatacgccttttgagtccttacaggctgaggaagagggtaaaacataccgcaaaacataccacaaaaaacggtaacggatagttgtaagcggttgatgacgattatagacaataacgggttttcccaatgaaattattgtttgaataataaaaaatcccaaaccgtaaaagtttgggatttgtatttggcagagaggaagggattcgaaccctcgatacgctattcacgtatacacgctttccaggcgtgcgacttaaaccactcatccacctctctaatggcggaaattatcccaatcgggataatttattatttggtgcccgggagaagactcgaacttccacacccatgaggataccagcacctgaagctggcgcgtctaccaattccgccacccgggcaatctaaatattgaaataaagcaaagcatttgatttggtgcccgggagaagactcgaacttccacacccgtgaggatactagcacctgaagctagcgcgtctaccaattccgccacccgggctttgctttatttgctgttttgcggtacagtgtcctgccgcaaagaagtcgctattatatagttcataaagagaatgtcaacagtccaaatgaataaaaatattaaatctttaaatttacgggaaaaagacccgtttttaagtcgtgaaaaacagcgttatgaacatcctttgcccagtcgggaatggataatcgaattgttggagcgcaaaggtgtgccttcaaaaatcgaatcgcttgcgcgcgagctgtcgattacggaagacgagtatgtcttttttgaacgccgtctgaaggcgatggcgcgggacggtcaggttttaatcaaccgtcggggcgcggtttgcgcggcggacaaattggatttggtcaaatgccgcgtcgaggcgcataaggacggtttcggttttgccgtgccgctcacgcccgccaaagacggtgattttgttttgtatgaacgccagatgcgcggcattatgcacggcgatattgtcactgttcgtcctgccggcatggaccgtaggggccgccgcgaagggacagttctggatattgtcgaacgcgcgcaaagcaaagtggtcggccgtttctatatggataggggcgtggcgattttggagccggaagacaagcgtctgaaccaaagcatcgtattggaaccggacggcgtggcgcgtttcaaacctgaatccggtcaggtcatcgtcggcgaaattgaggtttatcctgagcaaaaccggccggcagtggcaaaaatcatcgaagttttgggcgattatgccgacagcggcatggagattgaaattgccgtgcgcaagcatcatttgccgcaccaattcagtgaagcgtgtgccaaagctgcgaaaaaaattcccgtccatgtacgcaaaagcgatttgaaaggccgcgtcgatttgcgcgacctgcctttggtaacgatagacggcgaaacggcgcgcgatttcgacgacgcggtgtttgccgaaaaagtcggacgcaattaccgtctggtcgtggcgattgcggatgtcagccattatgtccgccctgacgatgtgattgatgcagatgctcaagaacgcagtaccagcgtatatttcccgcgccgtgtgattccgatgctgccggaaaacctgtctaacggcatttgctcgctcaatcccgatgtcgagcgtttgtgtatggtgtgcgatatggtcgttacctatgcgggcaatatcaaagaataccgcttctaccccgccgtaatgcgctctcatgcccgcctgacctacaaccaagtttggaaatggatttcagacggcatcgaccatccgtacaaagcccaaatcgacaccctttacaaactcttcaaaatccttcagaaaaagcgtttcgaacgcggcgcggtggagtttgaaagcgtcgaaacccagatgattttcgatgacaacggcaaaatcgaaaaaatcgtccccgttgtccgcaacgatgcccacaagctgattgaagaatgtatgctggcggcgaatgtttgcgcagcggatttcctgttgaaaaacaagcatacggctttgttccgcaaccatttgggccccacgcccgaaaaactcgccaccctgcgcgagcagctcggtctgttggggcttcaacttggcggcggcgacaacccgtcgccgaaagactatgccgcgcttgtcgaacaattcaaaggcagacctgatgccgaattgctgcaagtcatgatgttgcgctccatgcagcaggcggtttacgaaccgcattgcgacggacactttggtcttgcctacgaagcatacgcccacttcacctcgcccatccgccgctatcccgacctgaccgtacaccgcgccatcaaagccgtgttgaatcagcaaacctacacgccaaaaaaaagctggcaggctttgggcgtgcatacctcgttctgtgagcgccgtgccgacgacgccagccgcgacgtggaaaactggctgaaaacctattatatgcgcgataaggtcggcgaagtattcgaaggtaaaatctccggcatgaccagttttggtatctttgtaacactggacggcatccacattgacggcttggtgcatatcagcgatttgggcgaagactatttcaacttccgccccgaaatcatggcaatcgaaggcgaacgcagcggcatccgtttcaacatgggggacagggttgccgtccgggtcgcccgtgccgatttggatgacggaaaaatcgattttgtcctgattgccggggggagcggcagggggcggaaagttaaatcatccgcgtctgccaaaccggcagggacggcggggaaagggaagccgaaaaccgccgccgagaaaaaaacagcccgaggcggcaaagtaaggggaaggggcgcgtctgccgccgcagaatcgaggaaaaaggcaaagaaaccggttccgattaaggtaaaaaaacggaaaggcaaatcataatgctgacggggtggcttgaggaggcggggcatattttcccgaagcctccacccgattttttgatgtgggcggacggagcgttatttccagcaaattgaaacgcccgtattgaaagattgcgtttatttccaccgccgttttaaaggccggcggtattcggcagacggggcgcaaacggcgttcagacggcattttcattctttcggcgtgtccgtccgaattgctttgcccgtccgcgcaatcagcccgtgcggcttgccttgaacggacaaaaaatgccgtctgaaacccgaaaatcaggtttcagacggcatttttccttgaaaaggctgttcaaatcagcgatggtagttcggtgcttctttggtaatttgaacgtcgtgaacgtgcgattcgctcatacctgcggaagtgatttccacaaattctgctttttcgtgcatttcggcaatattggcgcaacccaaataccccatgctggagcgcagtccgccggtcagttggtggatgatgttcacaatcgggcctttgtaaggaacgcggccttcgatgccttcggggacgtatttgtcggtgctgtcggttttgtcttggaagtagcggtcggcagaaccttggctcatcgcgcccaaggaacccataccgcgataggatttgtatgagcggccttggtagagttcgatttcgcccggcgcttcttccgtgcctgcaaacataccgccgagcatgacgctgtacgcgcctgcggcgagggctttggcgatgtcgccggagaagcggatgccgccatcggcaatcagcggaacgcccgtgcctttgagggcttcggcaacgttgtgaatggcggtcagttgcggcacgccgacacctgccacgatacgggtggtgcaaatcgatcccggaccgataccgactttgacggcatccgcgccggcggcgaccaaatccaaagcggctttggcagtggcgatgttgccgccgatgacttggatgtgcggataggtttctttgacccaacgcacgcggtcgatcacgccttggctgtgcccgtgggcggtatcgacgacaatcacgtccacgccggcctcaaccaaggctttgacgcgctcttcggtgtcgccgccggtgccgactgccgcaccgacgcgcagacggccttcggagtctttgttggcattgggaaactcggtggtttttaaaatatctttgacggtaatcagacctttgagttcgtctttttcgttcagaaccaaaacgcgctcgactttgtgcgtgtgcatcagttcgcgcgcttcgtctatgcttgtgccttcggggacggtaaccagacgttcgcgcggggtcataatggcggaaacgggcaaatcgacgcggttttcaaaacgcaggtcgcggttggttacgatgccgacgactttgccgttttcaacgacgggcaggccggacattttgcgtttgcgctgcgcacgcatttccaagacttcgcggatgagcgttgtcggtgcaacggttacggggtctttgaccacgccgctttcgtggcgtttcactttggaaacggcgcgcgcctgcatttcgggcggcatgtttttatggatgatgccgatgccgccttcttgtgccatcgaaatggcgaggcgcgcctcggtaacagtgtccatcgcggcggaaagcagggggaggttgagtgtgatttcgcgggtgagcttggtttgaagtttaacgtctcgcggcagcacggtcgaatgtgcgggaaccaacaaaacatcgtcgaaagtataggctttttctacgatacgcataatgctcggtctttcagtttgtgcaagatgcacggcattatagcacgttaccggcggcttgacagtttatcaggtttaattttggtcccctttgaatagctcggttttcctttgccgaccactgttgctcccgttctttcaatttcaggaaaagcttttttctaatttttggtaagtggctcagttattgaagccctatatcgggcggtaacttccagcacaaaaaaacggagtagttctttatttattttttcctttaattttcagtatattatcttaatatttcgagggtaacatatctgctaatctagttacagccccatatattatagattcaattgaaaaataacagattcaactgtacctttcttatacctgatttctttaaagtttttcccattgtcaaaactataaaaaagtctctcttcctcaccagaatatcccatttctaatactaaacaatctatttcacaattaccccctccactcatatatgtagtatcaatagaaaatatattgcataattccagagaattatatttatctatatcaaatagttgctctccaaaatctaaaccattgtttccacctgcataatacttctcttcaaaggatgacttcaaactattaaaaactgcatttagcgtaaaatatccatatgggcatatcttaggatatatattctctcctattattatctgaatttttccataaataaaaccattacattcagagttttcttcccataaaatcccaaattttcttgttgagtccataataatattcatataaatccttatattaataaattatttacaatatcccccgctttcagacggcatacggcgtggcggcggaatgccgtctgaaggcgggcgttatgataattgttccagcagcgtctgcttcaatgaggactggatttttgggtttttcaggtcggggctaaaaacggtaaaactgtcttcggcgcgttcatccagtgtggagattttggcatagcgcaggctgacgttgtgggcgaaaaagacttccgccatatcggcgagcaggaaggggcggttgacggcggtgatttcgacggaataccagtcgggatagtcttcttcgggggtgatggtgatgctcggtgcgatcggcatatagcggctgcggcggctgatgcggcggctgcggctttgggtttcggcaacggtgtgtccgtggataaagctgttgagttcggcttcgagcgcgctttggatgtcggggtagtcttcgggggcgtgctgcgaggggatttgcacgatgaaggtgtcgaggatgtagtcgtgttcggtgatgaaggcgcgggcggcgaggatgtcgaagccgtggcggctgaagatgcggcagaggcgggcgaacaggcgcgggccgttgggcatgaaaaccatgacttgaaagctgtcgcttttgggcaggatgcggctgcggacgatgggggtttcaaagtcgtggactaggttggcggcgtgccacaggatttcgcgggactggtggcgggcgaagtaggcggaaccgagcgcgttccatagttttttctgctgtttttcggggacggcggcgcgggtgagtaagtcggcggcttcctgccggcggcggccgaagagggtgtgcgggttgccgccgttgcctgtaaggtagcgtccggcggcatggaagaggctttccagcaggctggcgcgccatgcgttccacagcttgggattggtgccgcgtatgtcggaaatggtcagaaggtagagcgcgctgaggcgttcgtgggtttgcacgcgtttgcagaaggcatcgagtacgctggggtcttggatgtcttctttttgggcgacggcagacatcagcaggtggttttcgaccagccaggcgagcaggtcgctttcttctccggtcaggaagtggtcagcggcaaattggcgcgcgtctgcgatgccttgtatggcatggtcgccgccgcgtcctttggcgatgtcatggaaaaaggcggcaaggtagaggatgtcttgtttttcaaaggactgcatcagtgcagaggcgtagggcagctcgtggctgtgcatatccaaggcaaggcggcggacgttgcggacgacggtgaggatgtggtcgtccacgggatagatgtggaacaggtcgtgttggagcaggccgatgattttttcccacgcgggcaggtagcggcccaacacgccgtagaggttgagaaagcgcagggtctgggtcagcccgttgccgttgcggaaaaaaccggcgaagcggcggcggttttcgggattttggtagaagctgcggttgattttgcgcgtcgcgccccaccaggcgcgcagggtttgcggttcgagcgcggtaatgtcgttgcgctgctgcatgatttcgacgattttgaaaatgtgttcgggccgtctgaaaaaaatatcggtgtgccgcgcggcgatttggttgttgacttggatgtagtcgtcgtcaatccgcagggtaacgcgcaacggggtggaggaaacgcggctttgcagcataggcgtgaggatgccgcccagttgtttgacggttttaatcgcgcggtaaaacacgcgcatcagttcttcgctttggcggcggaggttcaagccttcataacccatgctttcggcgacttgcggctgcaaatcgaacagcaggcggtcttcggcgcgcttggcgtttaaatgcagatggatgcggatgtgggcgaggcggcggtagccgtgcgaaagcataccggcttcggcacgcgtcaaaatccgctgtttgagcaggtcgggcaggtcggtcgccaagccttgcgccttcgctatccaaagcagggtgtggatatcgcgcagaccgcccggacagcttttgatattcggctccaatactgcccccgaaccttgcgatttggcgtggcggtgttccatctccaccagttttgcctcgacaaacgccgccacattgcgctgcgcgttcattttttccgccagtttatccaccgtttggcggttgccaaacaaaaacctagcctctaaaaacgctgtgtcccccgtaatatcattgcgcacgctttcacatagttcatcaacgctgccgctttttacagacggcatcagtttgcagtcccacagggtttgaacaaaccgggcaatctgttcctgaatgccgtctgaaagcggggcaggggagacaaccgccaaatccacatccgaacagggatacagttcgccgcgtccgaagccgcctaccgccatcaggcataacgcgctgttttgaaaatactctgcccacaatgccgccagtaaggtttcgactgccgccgtgtattctctgaaaaataccgacacgcggttggctttcaaataatgcgcttcggcggcatcgcgctgctgtttgaaggtttccagtgctgaagacaggtttgcaggcatttttattctttcgattggcgggaaaaagggaggcggatggttcggcggtcaaataccgctttcagacggcatttgtcgggtatcggcggaattggtcatcagcttcaaccgttcctgcggcggcagcagcaactgatacgccgccacgcccaaagccgccgccattttttcgatattcgacagggcgatgttccagcgtttgcgctcgactgccgacacataagtcctgtccaaaccgcattgccgcgccaattcttcttgcgaccaacccttgttcacgcggaaaagccgcatattgtatgccaataccgcccgcaaatcctgttcgtcaggcagttcggcaggcagagtcaatttgttgcccatcatttgcttccagataaatggttaaagttaagcatttgctgttacggattttacttcacataaaagccaaaaaaaaggggtggcggcagccacacccaaacacacacacatcaagaggaaagagataaaatcaagacagattgggaaacagcaaacaagcaccctgaatttcatatcggtattatcaaacaaaaacccttatcaggtattgattcaaatcaatttagattttattcgcaaaccgaaaaagaaaaacggcatatccgtttatacggatatgccgtctgatggtgcgggggactgctgtatttggcagtggtttgtgttttagtcctcttgcgccgctgtttgcaggtagttcggcagaccgattttgccgataagctcttgctgggtctccagccagtctatatgttcttcgttggtgtctttttgtttttccaacaaatcgcggctgacgtaatcctgttgcgcttctgctgtggcgatggcggcaagcagggcttcgtgtttttcctgttctttggtcaaatcgcaggcgatgatttcttcggtggactcgccaatcagaagcttgcccagttcttgcaggttcggcagaccttcgaggaacagaatgcgctcgatcaaatcgtcggcagctttcatttcaacgatggactgtttgaagaaatgttcgcccagttcttcaaagccccagtttttcaaaatacgggcgtgaaggaaatattggttgatggttaccagcagcaagcctaagtttttgttcagctcgcggataaccaaacggtcgcctttcatacggactccttttattccgaatacggattacagttggctttggtagtagttgccttcgccaattaactcgatcaggcgaagctgctgttccagccagtgggcgtggtcttcttcggtatctttcagttgggcaaccatcaggtcgcgcgtaacatagtcttgagcctcttcgcacagtttgatgccttttttcaacgcatcacgtacttcatattcggtttgcaggtcggctttgaggcaggaaaccacgtccgtgccgatattcagttcggcgcgtgccattttcggcgtaccgcccagcatcaggatgcggcggatgaagtcttcggcgtgtgtggtttcttcttccatctcgtggttgagacgttcaaaaagtttggtgtagccccattcggagtagaggcgggagtggataaagtattggtcgcgtgccgccagctcgccagacagcaattcgttcatataatcaacaacagcttgattgccttgcataatatctctctttctgtaacttggttttcggtatgtctgaacagcatctgtgtcgctattcgggatgcgtgcattgtatgcaaaagctgtcggcatgacaaattttctatttaaaatacaaacaattatcaaaagaaatagggcgtattccccgatgccttccaaatcagtatgctgtttcttatcggtttttttgctgctaaaactaagaatccatctcatccataaagaacatttacacttattaaccatagcaaaaaacaaatagagcacggttttttatcaaaatttataatgaatcgttctcattaaccgacagattcttttgagattatcggattttgggaataaattatgccgtctgaggggctttcagacggcatgcctgcccggacagacgctgcttggagcggctgtcggtttgaaggtgtgtttaatgcgaagggcaatctgtcgtatgatgtgtttgcggcaggggctttgaagaagcccggtattttaggacgaagcgcgcggctgccggggtcaatatccgctatttattccaaaccttattaaaacttaaatttaaaatcatgaagatagaaaatatcgatattatttcgccggaactgttcccgcaggaaacattcaatgaaaccgaagcattcggcgctttggtatggttgtgggcagtttcgcctatttatcagcatgccggcgtacaagaagccgccgtcaatatcttgccggtattgaaaaacgggcaatttgccttgttcagcagcaacggacaccccgtcgcctactgcacttgggcttatttcgatgaagaaaccgaatggcaatatctccaatccaatgatgttctgcgccactcggaaaactggtgcagtggaaacagaatgtggcttatcaactggttcgcacctttcggcgacagccgtatgatgaaaagaattctggtgcatctgtttccgaaacgtgaaataaggtggctgtaccaccgggggagtgaaaaaggaaaacggattatgaggtttccagcgttgtcgaaacaataaaacaaggctgcctgaaagtttcccttcaggcagccttgtttcagttctctcgaggccattcgtattttttgttttcgggataaatgtcgtcacctacacgataccaacctctttttctcatgcaggcatctgctttacttcctcctcccccacctattgggtcatagccgcactctttccagtctttttttccttagcaaaaagatcatctatttgtttgctatattcttcataagaatatatgcgtaaattgatatttttactcatcattgccggatattcttgttctatacgggaatacttccagtataccgagtcatcgggcggaggtttgaatcccccaaacgaacaggcagccaatcccatagccaaagagattgatacgatatatttcattttgtttttccttcttctcgaggccattcgtattttttgttttcgggataagggtcgaaacccttacgacaccagccttttttcctcaggcaggcatctgcttcagactttccgccgtctattgggtcatagccgcactcttgcatgtctttcagttgccttcgtcttgctttcgatggatattggtcaagtgccgccgaggctgatcccggatagggattggcgtaatttttcaattcccaaaatgacgcggcgtcccacggatttggtttaaatcccccaaacgaacaggcagccaatcccatagccagagagattgatacgatatatttcattttgtttttccttcttctcgaggccattcgtattttttgttttcgggataaatgtcgttacctacacgataccaacctctttttctcatgcaggcatctgcttcactcccaccgcccccacctattgggtcatagccgcactctttccagtcttttttttctctagcaaaagaatcatgcagttgtcttcgtctctcttcaggtgggtattggtcaagtgtcgctgaggttaatcccggataaagtttggcgtaatttgtcaatctccaaaatgccgagtcatcgggcggaggtttgaatcccccaaacgaacaggcagccaatcccatagccagagagattgatacgatatatttcattttgtttttcctttcggatgttgcagatcataaatgcgtacaggacggtacataatttcgatttcgttggacactcctctttcaaatacacctgtcggactttgggtttgtttattttcagggtctcgataaccatctgttacacattgtttattagccataccgtagcaattatgcggcgaggtgtaatcccctataatatcccttatagcctgccattggcttttttgccgggtattggttccgactgttgccggatttctgccaatcagcatgccgataaggtctaattcgtggttttctatttggatggactgacgggcgaaatctgccgttctgggtgtcgttaccccctgctgcagttgaaacagccttttatctgcccggacaacgttggcggcagggccgaccattttcagttcggtattggataaaattttcttatcccgattggcttgggtattcaaggtattgagtacattgtcgaccaccagggttccacggctgtgcgagccgacaaacaggccgtttttatccttcccgtagtcttccatgatattgcctaaagccaagcctgaattgctcaagccgataacggtcttattgcctatttttgccccttcgagcattttatgaaaggccgcaacggcgatttcgggcaattttgaaaagccccgcccattggtttccggattgtgcaggaaataaacattttcataggtgcgttcatatcggtttttctcgggattgaaacgccccacatattgttgggcggcaaatttggcggctgcttgtatattattgaaaatgccgttgacgccgacaacgattttttcaacggttttgccggtctccgggtcggtgtaacgggcagttttcagatttttccgttcctggtcggatacttcgcgcaattcgtagatatttcccccaatggctttataggcttcccaataatctttaaatgaggcaaattcttttttcaactttactgagttgtcaaactgtttatttatatcctcttcaagctgcttatcttcaatcggctcgccgttttcatccattttaaaggtcatcaggcggtgttctgcaataaactggctgcggtaggcttcgtctgcaatgccgccgatcagcgtctcattgataaactctttggcaacatccctattgagttcgacttctttcagcaagccttcgcggtctgcttttgccaatgccttatgtgcggatgaagtgcctttttcaataccggcaatatttttcctgccctgcgcggaagcaatttgccaatctccctcactgatgacggagcgggtaatggattggcggctttctgattctttggcattgcccaacagattgcccaaacccatttttgccaaggcgtatttgtcgttgctgtgtatatcgttttgcttcaaaccgaatttcaagccgccggcgttgttttgatttaaatttgcctctttaaaggtttcccctttttcaatacgctcacttcgatatttttcgttcaactcgtcgtctttcgccgaaacctggtcaaaacgcatcaggctgaccggtttgccgccgattttaccgatttctgcttcttttttggtggaatactgtccgctggtaggcttcgggctgtatgaaaaaccgccgctcaagcccaaggcggaagcagccgccgaagcatggttttgaatatctttatgccagatttcgcttgttttcagcaggttttttgatttgtcggcatctgaaacaacagcggcgccgaccaatccggttttgccgtttacgcgaatccgatagccgtctcctcctgcaaagataccgctttgctcgttgacggatgcataatccgagctgcttttcgagcggttatagctgccaccgacactaaagccgtagcctaccgtaacttgggcggaaacattttcctgtttgcctttaaacacggcggtatcctgcaaactttcgatatgcagactctctgccgttacgccaacgcctttgcctttaagctgcccgcctttgatgacggtatcgccaccgctttcaatagcggtttggctgtctttgctgccgatatggctgttgcggtaggcggtttcgtcgccgttgccgtaacctttgccgtagtttgctccggctgtgaagccgaaactgatgcctttgttgatggcgatggcgactccggcattaaagcctgcggatttgttttcgctgcgttcctgatgcgtttggcgggcggcttcaatctgaacggcattttctgctttgaggcgtgttcctttgccgccgtacacatcggagccggtaatcgtgatgcgggagtctttgcctgcgcctgaagcagtcagggaaactttgccgccgccggtgattttgccctcttgcacctgcgtgcctttgatgcggctttcggaggtgttcttctgttcgccgtaggtaacggagacactgatgccctgaccggctgcttttttgggatttcgggcggcattatagagtgccacgccggaatctactcctttattcaaggcgttggcagcagccatggcattgacccggctgtttttgcttttgccgacggtttggactgcttttacggcgtcaaccgcgcccattacggtattcacaaccggaacgctaatggcgacggttacgcctttttgttcgtaaacctgcttactctcttggctgtaacggttttgtgcggcatcgatgctgatttttccggaggaaatgccgacatcgccttggggcgaggatatggtcgaaccggtttgggtgtaatgttttcctgccgaaatcagggtattgccgttcaggctgccgacgacgctttctgtgtggctgacggtctcggatcggttggtttgcgtgtcttttttgctgcccgccgtaaagccgatgccgccgctgcccatcagtccggatttttcttttttgttcatttcggcactgcggctgcgtgtttcggctgctttaaggacgatattgttttttgccgagagaatggtatggttgtctgcaatgatattgctgccagtaacggtaatatcgcgtcctgaaaccagaatgatttctttgccgtccagcgtgccggatacggcttgtccgttttggttcttgagatggcgggtcatcttctgtttgatgccgcccccgcttctaccggtgtatttcagggcatcttcggtttcggtatgggctttgccggcttcgactttgatatcccgtccggctgccagtttcagacggccttgttcgctgccgacctctgctgcacggatacggatgtctccttttgcattcagactgagattgccccgggtgcggatggtgctgccgacttcgttttgttctttgcgaatcacatagttgtcggaatcaaagatagtgttctgattgcgggaaatgcccgtcgtatccgagcggatgtcgccgccggcattcagtacggtttgaccgtcttcagattgattggtcaattcggaagccgtcaggacgatattgttgcctgcatccagcaagacgcttccattctgcctgccggtcagataaatgcctgccacccggccgatattgcgtaccgagccttgctcattctgattgctgcgggtctcgctgcggctttctatattgttactcgctttgagcagcagggcgttttctgcgccgatgctgccggtattcgtaatgtcgctgcctgctgcggcgaagatgtttttgccctgcaaatcaccttgcagatttttaatattctgtgcgtttaaaattagtgcttcgcgcccggcaattaagccgccccggttttcaatggcgccgctgccgatatcaacaacgctgccggacagcaacgccccttgtccgttcatatctttggggcgtgcgcggacatagactttgggtttcaatacggtttgagttgtcccgtcgggcagggtaacggtctcgttttccagccaaacaatgtcggaagtcagacgggcaacctgttcggcagacagggcaatacccggagtaagctgcaattctttggctatggtaatgccgttatccatcaaagccttgaattgctcttcgtcattggtataaccgtccaagcggcggtagcctgtcagcttggcgatttgttcgtttaccagtttctgctcgtaatagccgtcgcccaaacgcttgtggatatggttcgggtcttgttgcagtgcggcaagcatatagccgctgcccagccatttgcggtagtcggtaaaggcagggtcggtttcaatcaaatagcctttgttgtttggcgcaatggcaaacaagctgctgttcggcagagtaaatgtaggatggatgccgttttcagcaacaacgggtacaacagtgccgggtatatcagatgcctgttggggcgcatagcctttataggctgaaatacccatacggatggagctgacttcgggggccggttcgtagggagaccgactgtatcccgtagaatcccgccctttcttgtgatgacggtggtaacggtgcaagtcccctttatcggttatggtttttgttcccaaagtttcatcattgtccaatgcggattcgggcgtaccgacgatcaatctgccgccggcaataatccggctgttatgatttttcagcttggcggcatctaaaaccaaattgccgccactgatgatttgaccgggcttggattcggtaattttgctctcggcggtgattcgttcgtaatcgtatttgtaccagacagagtgggggctgccgtccggagtccgcatatgtaaagactcatcttcaaatatttcccagcccaactctttttgagaaccttccggatagcgttctgttctgccttccgcctgatattcgatacggtgttcgcgatgggtttcttccgtatggaaacgcagatgctcattggtattctgcaaatcttttgtagcgatacggatattgcctgatgattcgattgccgcactgcggttgtgcagtgatgtatttgctccttgcacctgtcggcttccattcaatgcagaaccgatatgaagatcgccggagctggacaataatgccgcctctcggttctcaatttcccgcgctccaatatccaaccgctcccgcgctgcaattaccgccgctttggtttcgccgttgaccgtttcttcccggttcaacaaggtatctgcctcaactgccacacggctgccgtaaattctgcccgtgccggcattgtccgacttggcttcggtttgcagcagcgttataccgttgctgttgattaaacccctgttggtgatgccgtttttgccgtttaacccggtgcggtttccggattggattttaccggagacagtgttgtcgatttgggcggcggtcagggatacggtatcgcctgcctgtatgatgcgggtgtttttcagacggccttgggtggagaacgtgagtgtgcgtccggcttcaatatcgcgtttgccggcaaaatcatcatgaagagaaacggaaacatcgcgtgcggcggttaatatgccgtcgttgtccagtgattttgcctgtaaggaaacatctttgcccgcaataatcgtgccgtctgtgttattgatatgcaggctgcttttgcctgtatcgcgaatatccagcaaaccggccgagccgattaagcctgcttgattatttatgccgtctgaaaccttcaatacactgcctttgccgctgcggataaagccttggcggttatcaacggtttgagcggaaatggtgatttcggcagcatcaatcgaaccgctgttgctcaatttgccgtctgcgcttaacgtaacgccgcctgttgcggcaaaaatccgacccttgttgcggattacggcgccgttgtcggtgctgattaaagtgattttgtctgcgtacatcccacccagtgtggcggtgtcgatggcaacggtaggagtaacagaatccgaagaagatggcgcagaagctgttttggcaagagagccgtcaaaatccaatttgttcttacccgaaaccaccttgacatctttaccccaaacgcccgcattgatttcagcagcacgactaaggatacgggtgtaatcggcatcagaggtatccaaacctttgcccccaatcacgactttacccgaagaaacatcaaagcccgtcagattgccgttattcaaaacaggaacgcccgaagtcagcgtaaccgaagcggcattaatcaatccgccgccattcacacggatgcccgacggattggcaacgactacttcggcgcgtttgccgccgacttcgatataaccgttcaacaacgaaggattactgctgtcaatctggttcacaattacccgcgcttcgccgcgtgccagatggggattgccttgaatccatccaccgagttgcgtttgcgtattgctgcggctgttgtttagtattacgcctttttcatcaacatcgaactgcttgaatcggttaacagaaacgccttgggatgacggagtttgaatattgacttgcggcaaaccgtttgctgtctgaagaataacggcttgttggtttttaggggcggatttgtcggcaatgatgccggaagcaggggcaggggaaaacgcagcaacacccaaagccaacatgacagaaaaggcagccatacggaaaccgaaggctgcccgggcagaagaaacagaagcggcaccggtcactcgaaccgaagccgcctcactatcctgcatactcttgccgtcacgatgaacattctctgctacagccatcatacaactgcgtttcttgttgaagataaccttgtagcatcgcttgttcatgatgggttttcttaaatgaaatgtaaggaatagttaaggacaaaatataggaaatttgaattaaattgtcaataaaaaactgacagcgtaccctgataatcagatgttgtacgctaattgtgagaagtatgtcgggatgattattttgaagttttctttttattcaaaagagttactatgaaagttaaccgggcgtaaataggcttcaataaacaggttatcgttatttttcaattgggaaaaaatcttccctaacccatccattcgccaaattattatgtgggaattcggcaatttcaataacggctgttgatccatatctgctcggtcatttagcgttataaagtcgcaaatagcgtcagaatttacaagattatcggattttgggaataaattatgccgtctgaagggctttcagacggcataggcggctaacacgggtgcggcttgcgccaaacggcgcggcaggcgcagggaatcgctttttactttggcgcggtgttccgggtttaatgatgcccgcaaccgccgtggctttccctcaaggcttccgccgcctgttcgtcggcgtggtagctggaacgtaccatcgcgccgatggcggcattgctgaagcccagttcgtatgcttctttttcaaagattttgaactgctcgggcgtaacgtagcgcaggacgggcaggtgtccgtctgaaggctggaggtactgtccgatggtaatcatttcgatattgtgcgcccgcatatcgcgcataatttcacgcacgtcttcgtctgtttcgcccaagccgaccatgatgccggatttggtcgggatgtgcggcatcatttctttataacgttttaataagtctaaagaatgttgataattggcaccgggacgggcttttctgtacaggctcggatgggtttctaggttgtggttcatcacgtcgggcggggtttcggcaaggattttgagtgcgatgtccaagcgtcctcggaagtcggggacgaggatttcgattttggtgttcgggctggtttcgcggatggctttgatgcagtcggcgaaatgctgtgcgccgccgtcgcgcaggtcgtcgcggtcgacggaggtgatgacgacgtaacgcaggttcatggctttgacggattcggcgaggtttctcggttcgtcggggtcgagcatattgggccgaccgtgtcccacgtcgcagaacgggcagcggcgggtgcagatgtcacccataatcatgaaggtcgccgtgcctttgctgaagcattcgccgatgttggggcaggaggcttcctcgcaaacggtgtgcatcttttgttcgcgcaaaatgtctttgatttcaaagaatttgcgcgatgggagtttggcgcgtatccattcgggctttttcagtttttcctgaagggggacgactttgatggggatgcgcgcggttttgtccgcgcctctgagtttgatgccgcgtttggggtcgtcggttttgatttcactcattgttgtctgctttcggtgtgaattgtgtttcaaggtgtgcggtgagtttggcggcgacttcgtccggcgtggggcagggttggacaaaatccgcgatttgcgtcatttccataccggcgtagccgcaggggttgatgtgggtaaacgggcttaaatccatattgacgttgagcgcaagcccgtgatagacggagccgtttttgatacgcagccccagtgaggcgattttgcgttctccgacataaacgccggggcgtttggggtctgccgccgcttcgatgccgtattctgccaatgtggcgatgatgctgttttcaagcgcggaaacgatgtttctaacactggttttgcgccgtttgaaatcaatcatcgtataaacgaccaattgcccgggcccgtgataggtaatctgcccgccccggtcgatttggacgacgggaatgtcgtcgcgaatcagcaggtgttcgggttttcccgccagtccttgtgtgaacacgggcgggtgttcgacgacccacagttcgtcttcggtgtcggcattccgtccggcattaaaggttttcatcgcttcaaaagtcggcagatattcgaccaaacctttgtgtatgattttcatctcaaagtaccactttgaccagttcgtgcgaagtcagcgcacggtagatgttgtccaattgttcttggttttcaacctttacctgtacggtggcgccagtatagttgcctttgctgctcggacgcgtggtgatgtggtgcgcctgcgtgtcgggggcgtggaggcggacggtgtctaaaaccgcctgctcgaactcgggatgcaccgcgcccattactttcaatgggaaggtgcagggaaattcgatgagggatgttttgtttttttgttcggtcatgatgtgctgccttgtcgtgtacggtatgccgtctgaaggcgggtttgcctttcagacggcatcggatgtgcgttattttagcctaaaccgcgataacaggctatcgggaaggcggaggcttttttgacggcgcggcggttctgctatactggcgcacaatattatttttagaagggtggtttttatgtatcggaggaaagggcggggcatcaagccgtggatgggtgccggtgcggcgtttgccgccttggtctggctggttttcgcgctcggcgatactttgactccgtttgcggttgcggcggtgctggcgtatgtattggaccctttggtcgaatggttgcagaaaaagggtttgaaccgtgcatccgcttcgatgtctgtgatggtgttttccttgattttgttgttggcattattgttgattatcgtccctatgctggtcgggcagttcaacaatttggcatcgcgcctgccccaattaatcggttttatgcagaacacgctgctgccgtggttgaaaaatacaatcggcggatatgtggaaatcgatcaggcatctattattgcgtggcttcaggcgcatacgggagagttgagcaacgcgcttaaggcgtggtttcccgttttgatgaggcagggcggcaatattgtcagcagtatcggcaacctgctgctgcttcccttgctgctttactatttcctgctggattggcagcggtggtcgtgcggcattgccaaactggttccgaggcgttttgccggtgcttatacgcgcattacaggcaatttgaacgaggtattgggcgaatttttgcgcgggcagcttctggtaatgctgattatgggcttggtttacggtttgggattggtgctggtcgggctggattcggggtttgccatcggtatgcttgccggtattttggtgtttgtcccttatctcggggcgtttacgggattgctgcttgccaccgtcgccgccttgctccagttcggttcgtggaacggcatcctatcggtttgggcggtttttgccgtaggacagtttctcgaaagttttttcattacgccgaaaatcgtgggagaccgtatcgggctgtcgccgttttgggttatcttttcgctgatggcgttcgggcagctgatgggctttgtcggaatgttggcgggattgcctttggccgccgtaaccttggtcttgcttcgcgagggcgtgcagaaatattttgccggcagtttttaccggggcaggtaggcggttccgaaacatatagtggattaacaaaaatcaggacaaggcgacgaagccgcagacagtacaaatagggcaacgccgtactggtttttgttaatccactatatttgaagcggaatacaaccttgcccgggtttaaataaaaatgccgtctgaaccccgaaaactggacttcagacggcattttcatcacggcttatttggcggttttgctgctgtcgataattttcataccggcagaaatcaggctgccgatgtcggcaacattggcgggcataatcagcgtattgctttctttggcaagattgttgaacgcagcgacgtattgttccgcaatcttcagattgaccgcatccgcaccgccttgggtttgaagggcggcggcaatttgacggatggcttcggcattggcttcggcaacaaggcgcaaggattccgcttcacctttggcgcggttgatgcgggcgattttctcggcatttgacgcattgaccgcagcctgagcctcgccttcggattgttggatttcggcttcgcgctgaccactggcaaggttgatttgttcgattttacgaccttcggattcggcgatacgggcgcgtttttcgcgttcggcagtaatttgcgcctgcattgagcgaaggatttcttgcggcggaaccaagtctttaatctcataacgcaaaaccttcacaccccaagccccggccgcctcgtccaaagccgcaacaacagtactgttgatttcgtcgcgttcttcaaacgttttgtccaactccatacgcccgataacggaacgcagcgtcgtttgggcaagctgggtaatcgccataatgtagttgctcgaaccgtatgaggcgagtttggggtcggttacttggaaatagatgatgccgtcaacagtcagctgcgtattgtcgcgcgtgatgcagacctggctgggtacgtctaaagggatttctttcagcgaatggcggtaggcgacgcggtcgataaagggaatcaaaatattcaaaccggccgtcagggcgcgatggaaacgccccagcctttcgacaacgtggacttcctgttgtgggatgacaacaaaggatttgaaaccgaaaacggcgacggctaccaacaagataatgaaaaattccataattcctccgagtgttaagggtgtgtgataataagaaggttgccttccttgcggacaatgagggcgcgagttcctggttcaagctcttcttgccccgtattttgagcctgccagtgcgtaccgcgataaaaaacttcgtaacggttgccgcctgtgtgtcggaggatttcgacatattgtccggcatccaaatcctgatatgaatccgtttcaacttttctaacggcggttttggcgtgtacgaaccaaatacccagcgcggaaagcagagcggcggtcaagacggcggcaggcgtactgccggtcagcccgtaagcaatgcccgaacccgccaaagccgcgctgacaaccaaaagataaaccgttcccgtcaataattcgatgattaagacggcaacagcggcaacaaaccatacagtcatacatttccccacaaagcgcgtcgtttgacaaaataacgcaatatcagcagtatagccgaatttgaaaggatagggcagatatggacacttggcacgatgcactcggcggcgaaaaacagcagccgtattttcaggaaattttaaatgcagtcaggcaggaacgtttgtcgggacaaatcatctatccgccggcggcggatgtgttcaacgcattccgcctgacagcgttcgaccgggtcaaagccgtcattctcggacaagatccgtatcacggggcagggcaggcgcacggtttggcattttccgtccggcagggtatccgcataccgccgtctttactcaatatctacaaggagttggaaaccgacatcgaaggcttttccattcccgcgcacggctgtctgacagcgtgggcggagcagggcgtattgcttctgaacacggttttgacggtgcgtgcaggacaggcgcattcgcacgcccttttaggctgggaacgctttaccgataccgttatcaggcagcttgcgacacaccgcaagcaccttgtcttcatgttgtggggtgggtatgcacaacaaaaagggaggctgatagacagtcaaaatcatttgatattgaccgcaccgcatccgtctcctctgtcggcatatcgcggttttttcggctgccgccatttttcacaggcaaacagctatttgagccggcacggtatcgatccgataaactggaagctgtgaatgccgatatagccgttgccgccggcgtgttaaaatcgcgtttgatttgtaatttccatttattaggcaaaaccttatggcaatcaaaaaaaaatcagctttatgcatcactttgggcgggctgcgacgagttgcgcggcggtatggatgcgagcctttataaagaactatgtgcttacgctattgtttttaaaatatgtttctgataagcataagtacggcggcggcatgattgagctgcacgccggtacgacttttgacgacatcgtcaaactcaaaaacaccgccgacatcggcgaccgcctgaataagattatcgcccaaattgccgaagccaacgacttaaaaggcgtgatcgacgttaccgacttcaacgacgaagacaaactgggtaaaggtaaggagatgatcgaccgtttgagcaggcttgtcggcatttttaaaaagctcaacctttcttccaaccaagccgaagacgacgatttgttaggtgatgcctacgaatacctgatgcgccattttgcgaccgagtcaggcaaatccaaagggcagttttacacgcctgccgaagtctcccgcattatggcgaagattatcggaatcagcgcagattgccgtccagcaccagcgtttatgacccgacctgcggctcgggttcgctgttgctcaaagccgccgcccaagccggcagccaaatcagcctttacggtcaggaaaaagatgtggcaaccgcgtcccttgcccgtatgaatatgattttgcacaacaacgaaaccgccgaaatcaacaccgggaacaccttgtccgattcgtctttccgtgatgaaaacgacgggcttaagaccttcgattttgccgttgccaatccgccttatcccgcccgaaaaaaacggcgattacgcctttttgctgcatctgctcaaaagcctgaaaccaagcggcaaaggtgcgattattcttccgcacggtgtgctgtttcgcggcaatgccgaagcgcgtattcgcacggaattgcttaaccttgaccttattaaaggcattatcgggctgcctgccaacctgttttacggcacgggcattcctgcctgcatcatcgtcatcgacaaagaacacgcccaaaccgcccaatttgccgaagagggaacaaaccaagttatcagcggcggcagcgtgtttatgattgacgcatcgcgcggcttcattaaagacggcaacaaaaaccgtctgcgtgagcaagacattcacaaaatcatcgacactttcacaaacctcgttacagccgtatggtgcatttaagcgaaatcgcagcacaagattacaaccttaatctgcctcgctatatcgacagcggagaagtcgaagacctgcaaaatctcgccgcctatctatctttatggcggcatacctgcgcacgatatggacgcattggaagcctattggcaagttttaggccgtatgaaaaacgagttgtttgccgaacacgatggccactttaccactatacaacggaatcgattgcaaatctttcccactctcaacagcttaaaatcctgcgggattggtgtggaatttagggctaatctagtacagccccaaatttaatccactataaaatcgaaagcagccaaatcaaagcccatatattggcgcaccccgattacgccgccttcaaagccggacacctagcaaagtttgccgcgtggcacactcaaaacgaccttgccgccatccaaccgggcaggcttatccggaaatggagcgaaagcctgctggacgcgttcaaacccggcagcctgattgaagaatacgatttctaccaaatcctgacggactactgggcggaaaccctgcaagacgatgtttatctcatcgcccaagatggctggaaggcggttaaaaacctggccgaaatcaccaaagaaagcgatgaagccgcgaacctgaccgtcgtctttgaggaaaccgaaaccgacaaaaaaggcaaagccaaaaccaagcgcatcagcaaaaaataccgcagcgaagtcatcgcccccgagctggttgcccgccgctacttttcagacggcatcgccaagctggaagaaaaacaaagcgagctggaacgcctaagccaagaattggaaaaccacatagaagaacacggcggcgaagagggtgcgctgaacgacgtattggatgcaaaaggcaaactttccgccaaacttctgaaaaccgcattggaagaaagcggcatagaagaaggcgaacgggctgttttacaaaccacccaaacactgatgacgcaggaaaaagccgcgaaagacgcagtcaaaacccaaatcgaagccctgaaccttgccgtattcaaacaatttggccgactttccgaagccgaaatcaagcagcttgccgttcaagacaaatggcttgccgatttacaaagccgaatcgaaaatcgcttggaaaacagtattcagcagcttatcagccgcttgaacacgctggaagaccgctaccgcagcccgatggccgagcttgcccgagaagtggaaaagtggcaaagcaaagtcaatgcccaccttgaaaatatgggttttggaggctgaaatggcagcacagacaggctataaggcgagcgggttttgagacctttgcaaaattccccaaaatcccctaaattcccaccaagacatttaggggatcgcggttcgggtgtccgcaccgcttaatacgtcgtcgtccacgaactgacccatttgctcgaacgccatcgcaacgcccgttttatggcgcatatggacaactttctcccaaactggcaaagcatcaaacaacagcttaatgccttggagttatttgcacaaatatataatttaacataatatacattatgcgaactatcggaaacagttgtacgtgtccctgtggtctttccaagtaggaaaattaaagtatggccaatgcggctgaatgtatagcccggagcatccgcgtatccgaaggtactgaacgacatgccctgcatccctttcgacgcttccatccagccggtattgggaaatacgttgaccttcaatataatatacaggcagccgacacacaggatatgccgctgctttttcatcatttcttctgtcaaatccttggaacggtcgatttgaaaacacggctttacatacgccccagttccctttgcagggcttgaatattttgctgcctgtccaatacattgctttgtaatgcatttatttcttgatggttgatgttgccgccctttgccagacgtgcttgtgataacattttttgggcttcaaccaatgctttgcgttcgttgctcaattctgtttcgagaatggagcgtctgctgttgtttgagggtgcttgttgcggcggcggcgtattggattttgccggcttggatactgttttgaccggggctttatatttgacaacctgtccgccgtttgacggtgatgataccggttcgggcgtttggggcgggatatagcgttcgctgctgtagttgccgattgggggcaaatcggttgagtggcagcttttggacggcttggtggtgtaaacggtttctccgttgattgtgcaggtgtagattttggccgcattcgcacccaatgggcttgaaatcagggaaaagttgattaggattaagaggagttttgatttcataatgtgcttgattttcggataatcatttgattttttggtattttttgtaatgctttcttggcgttttacgggcttttcttttcggttggttgcttttgattttctttcggggctttggcagcctgcttgttctttttcccggcaggttttttgtttttctttttactttctatgtgtattttggcttcttaactgagttttttaattttcaggcggtatccgcctccctgatggctgctgattttaggtaaatccgcatcggcgcacaatcctgctggggctgatgtatatacgcttttgccatttgagttgcaatggtatacggaggcttgcgccgccgcgccggaaagggacaggagacccaaggcggcaaaaagtctgatgtttataccggtaaaaggcggtgataacgcccgaattataccgttattggcaggcaaagataagcaccctgcccgcgcttctttatcgctcggcaaactgtttctcgatttcagtttcaatctgttccaattcttcttggcaagccagccaaacctcttcgatttgggcaagttgtgttttgacttttgccagctcggataaggtgtcctgcaatttttctttgttttcctcgaagtaagcttcttcttgtgctaaaaatgcttcacatgccgtctgaatttcggaaagctgcgccatttctttttcggcacggtctattttctgctgtatcggcttgccgcgtcgggctttttcctgacggatttgcgcttcgatgcgcttggtgtctttgcggctttggctttgtgcggatgctgcgggcgcgacggcggcgttttcctgtgccaaacgccattggcggtagtcgttcaaatcgccgtcgaagttcttcagacggcctttatcgatcaggaggaagctgtcggtcgtggcttcaagcaggctgcgatcgtgcgatacgacgattaaggcgccttggaaactttgcagagcgagcgtcaaggcgtggcgcatatccaaatccaaatggttggtcggctcgtcaagcagcagcaggttcggcttttgccagataatcatggcaagagcgagtcgggctttttctccgccggaaaatggttcggttttctgcaacgccatatcgccgacaaaattgaagcctccgaggaaatttcggatttcttgttcgcgtacttcgggagaaagctgctgaatatgccaaacagggttttggtcggagcggatggtatcgagttggtgttgggcaaaatagccgatattgagtttttcggaacggacgatgctgccggagagtaaatcgattgtgcctgccaaagctttgataaaggtagatttaccgctgccgttgacacccaataaaccatagcgcgcgccgctttccagcgacagggtaatgtcgtgcaaaacagttttgccttcgtaacccaaatctgcgtgttctagctttaacaaaggattgggcagatggtcgggatggtaaaactcaaaggaaaactcgctgtccagatgcgcgggagcgatgcgttcgagcttcgccaaagccttcatgcggctttgcgcttgaacggctttggtggctttggctttgaagcggtcgataaaggattgcaaatgtttgatttgcgcctgctgtttgacataggcagcttgttgttgcgcgagacgctgcgcacgttcgttttggtaaaaatcgtaattgccgccgtattgcgtgagtttttgctgcgataattcaatggtttgggtagtttccgcgttgagaaaatcgcggtcatgggaaatgatgatttgcgtgcagggtaaagaagcaaggtggttttccagccacaagacggtttccaaatccaagtggttggtcggttcgtcaagcaagagcaaatcggcgcggcaaatcagggcttgcgcaagattcaggcgcatacgccagccgccggaaaaggatttgacggggcggctgtgttcttcttgcgaaaaacccagcccgttcaacaattttgccgcacgcgccggcgcggtataagcgtcgatttcttccaatttagcatgatattccgcctgcttcatgccgtcattttgcgcttctgcctgcctcaatgccgtctgaaaagcctgcaactcggcatcgccctgcaaaacgtaatccaaagcggaaatatccaaatcgggcgtttcttgggaaacggaagcgagccgccagtttttcggaatcgagacatcgccgccgtcctgagtgatttcacccttgattaaggcaaacaggctcgatttgcccgttccgtttttgccgatcaaaccgacgcgctgaccgggattgacggtagcgttggctttgtcgagcaggactttcaaaccgcgttgcagggtgaggtttttgatttcaatcataacggaaacatcgtcgggcgggaaaagcccgtattttacctgaaagtcagtgccgatgccgtctgaaacgggaaatttacggctgaagccaagcccaagccctgcgcccttccgagtgcaggaaaaccaatgtcctgaatgccgaatcggtattcatgcattccacgctgattccgattcgggaaaaatccgccatgattttgggatggataaactcctgagccgcgcccgtcccgataatcaatatttccggatagtcaacaggtttgacgtcggacaacaggttttccggagtcagatcggacaaggttcggcattgcgacaggcagaccgaatccttatgtacaagcacgggtttatggaaactttgccccgccagccggattccgcccgcaccgcattcatattccgcaaactgtccgtctatcggattttcttcaaacaacatttttttaccccgttgccgcatcatctacaccgaaagggatgcaaaatcagacaaattcatgtaggattggcagatttcatctgacccgcctgccgatttcagacggcatttgattcaaagtgcggcacaattatatcggcagcggatattttcgtctttcaatatttacatttcagtcggcttacaaggagacacaatgaagccagtaaacatcggtcttttaggtttgggtacggtcggcggcggtacggctgccgtgttgcgggacaacgcggaggaaatttcccgtcgcttggggcgcgaaatccgtatttctgccgtgtgcgatttgagtgaagaaaaagcccgacaaacctgcccgtccgcagcctttgtcaaagatccgttcgaactggtcgcacgtgaagacgtcgatgtcgtcgtcgaattgttcggcggtaccggcattgccaaagatgcggtgttgaaagccattgaaaacggcaaacacatcgttaccgccaacaaaaaactgctcgccgaatacggcaacgaaatcttcccgctggcggaaaaacaaaacgtcatcgtccaatttgaagcggcagtagcgggcggtatcccaatcatcaaagccctgcgcgaaggtttggcggcaaacaggattaaatccatcgccggcattattaacggcaccagcaacttcatcctctccgaaatgcgcgaaaaaggcagcgcgtttgccgatgtactgaaagaagcgcaggcattgggttatgccgaagccgatccgaccttcgacatcgaaggcaacgatgcgggccataaaatcaccatcatgagcgcactggcattcggcacgccgatgaacttttccgcctgctacctcgaaggcatcagcaaactcgacagccgcgacatcaaatacgccgaagaacttggctatcgcatcaaactgttgggcattacccgcaaaaccggcaaaggcatcgagctgcgcgtccaccctaccctgattcccgaaagccgcctcttggcaaacgtcaacggcgtgatgaacgccgtgcgcgtcaacgccgatatggttggcgaaaccttatattacggcgcgggcgcgggcgcattgccgaccgcttccgccgtggttgccgatatcatcgacatcgcccgcctggttgaagccgataccgcccaccgcgtaccgcatctggcgttccaacccgcgcaagtccaagcgcaaaccatcctgcctatggacgaaattaccagcagctactacctgcgcgtccaagccaaagacgaaccgggcacgctggggcaaatcgccgcgctgttggcacaagaaaacgtgtccatcgaagcactgattcaaaaaggcgtgattgatcagaccactgccgaaatcgtgattctgacccacagcacggtcgaaaaacacatcaagtcggcaatcgcagccatcgaagcactggattgcgtggaaaaaccgattaccatgatccgcatggaaagcctgcatgactgagccgaaacacgaaatgctgacgaaagagcaggttgccgcgcgcaaaaaagcaaaagccaaaatccgcaccatccgcatttgggcgtgggtcattttggcgttgctcgctttaaccgccctgctctcccaatgcgcgatgtccaaaccgcaggcaaaacagaaaattgtcgagtcttgcgtgaagaatattccgtttgccgaaaaatggcaaaacgatttgcgggcccgcggtttagattcaaacaatacccgcctcgccgtcgactactgcaaatgtatgtgggagcagcctttggacagattgagcgagaaacagattagatccttcggcaaactcggcgcacaagaacagcttgacctgctcggcggcgcaaatgcctttgaagcacgtgacaagcagtgtgttgccgatttgaaatcagaataatgtggaccgataaaaaagccgattctttaaagaatcggcttttttcataaaaaacggcttacagtgcgtctttcaaagctttgccggcgcggaatttaggcgttttggcggcggcaatggtcagaggctcgccggttttggggttgcggccttggcgttccgcacgttcgcccacgtagaaagtaccgaaaccgaccaaagtaacggtgtcgccttgtttcagggcggtggttactgcattggtagtggcatccaaagctttttgtgcggcggctttggaaatgtcggcttcttgagcaatcgcttcgatcaattcagacttgttcacaatcagtcccttcctgtcttaaaaaatgatgaaatgcccgaatactcggggtttgtactgcttgagcaactttcgctttatagcaattctgaaattgccgtgtcaagcaaaaaatacggaatcaccctatttgacaggctttcaggacgaaaccgcatttttacaacacatttcctgcgtttcaatgtttggttgccctgctgcggggttttggttttgaagcggattccgccgccgcttccgcaccagaaggttctgcccaaggctcaggctggctttccaaacccagagccaatacctcgtctatccatttgaccggatggatggtcaggccggttttcacgttttcagggatttcttccaagtctttgacgttgtctttcggaatcaggacgtgtttgatgccgccgcgcaaggcggccaacagtttttccttcaaaccgccgatgggcaaaacttcgccgcgcagggtaatttcgcccgtcatcgccacatcggcgcgtaccgggattttggtaaaggcagataccgccgccaaggtcatcgcaatacccgcactagggccgtctttcggcgtcgcgccttcgggaacgtggatgtggatgtcttttttctcgtaaaaatcaggagccaaacccactgattccgcacgggagcggacaaccgaccacgctgcggacacggattccttcatcacatcgcccaactggccggtgcactgaatcacgcccttacccggcaatgctgcggcttcgacggtcagcaattcgccgccgacttccgtccacgccaaaccggtaacctgcccgatacggttttcgctttcggcaacgccgtaatcgaagcggcgcacacccaaatagtcgtgcagatttttctcatttactttaaccgctttaggtttggctttgctggttttcttggtttcagacaacctcttcttatcttcgtccaaggtaatctgcatcaccaccttgcggcagattttggcaatttcgcggtcgagcgaacgcacgcccgcctctcgggtgtaataacggataatatcgcgcaccgcgctttcttcgattgccaattccccttcttttacaccgttgcgcttcatttgcttcggtacgaggtactgcatcgcgatattgattttttcgtcttcggtatagccggacagacggatgatttccatacggtcgagcaacggagtcggaatattcagactattggatgtggcgataaacatcacatcactcaaatcgtaatccacttccgcataatgatcggcaaacttgttgttttgttcgggatcgagcacttcgagcaacgcgctggcgggatcgcctcggaagtcgttacccaatttgtcgatttcgtcgagcaggaacaaggggtttttcacgccggcttttgccatattctgcaaaatcttaccgggcatagagccgatataggtgcggcggtgtcccctgatttcgctttcgtcgcgcacgccgcccaaagccatgcggacatatttccgccccgttgctttggcgatggattcgcccaaagaggttttgcccacgcccggagggccgaccaggcacagaatcgggcctttgagtttgtccatacgtttttggacggcgaggtattccaaaatccgttctttgactttttccaggccgtagtggtcggcatccagcaccagtccggctttggcgatgtctttgctgacgcgggattttttcttccacggcagctcgagcaaagtgtcgatgtagttgcgtacgacggtggattccgcagacatcggtggcatcattttgagctttttcagttcggacaggcatttttcttccgcttctttggtcatacccgcctttttgatatctgcttccaaggcatccagttcgccgttttcgtcttcttcgcccagttctttgtgtatcgctttaatctgttcgttcagataatattcgcgctgggatttttccatttggcgtttgacgcgtccgcgtatgcgtttttcggcctgcataatgtcgagttcggattccagctgtgccagcaggaattccatccgtttgccgatttcgggaatttccaaaatctgttggcgttgcgccagtttcaactgcaaatgcgctgcgaccgtatcggttagccggctgttttcggcaatgccgttgatgctgccgataatttcggcggggatttttttattgagtttggcgtattgttcaaactgcgccaacagggtgcggcgcacggcttcgaggtcggtattgccgcccgtgtcttcttccacgaccgtctctatatgggaaacgaacagaccgcccgtgtcttcaatggtcagaacacgtccgcgatacagcccttcgaccaatacttttaccgtgccgtcgggtagtttcaacacttgcaggacttgtgcgaccgtaccggtctgatacaggtcggcggcaatcggttcttctaccgccgcatcggtttgcgccaacaggaaaaccggctcctcgcgggtaatggcgttttccagtgcggcgatggatttcggtctgccgacaaacagcggcagaaccatatgcgggtaaacgacgacatcccgcaaaggaagggttgccaaggcggcatattcctcaaaatgcttttctttttgtgtcataggtactctcttgtgtctgacagattgccgattttcgcgtacattggggttgaaggtattatttcaagcatatgtggtttatttatggagtttgatgcgatgccgtctgaaacattccggcttcagacggcatgggcttggaaagacaaggcgggaacaaaaaactgttctgtgttgccgctccttgctgtaccatccgtatggtttgcggttctgccgccctattttcaaaacatgacgcaggtatcccatgtcttcttttatttttcccgatgacgggttcgaatggcgcaacgaaagtctgcaaaagccgcccaaaggttggcattatgtccgcgaaagcggtgcagacggcattttgaaggctgcctatcaaaatattgcaactgtctagcagggcgatttccacaatgccaaacaggtgctttctgcaatgaagaagagggttcgcaaacctgccgccgtccgttccgatgcggatatcgccgcccttttccatgcccaccgtatgaagcaggcgcagcagagccgtattctgaatatgcttgccgttgaaatccgccccggttttgtgttggacaacaaacgcgcgcccgatatacgctccgctttgctcgacgtgtacggagaggcggacggcaaaccgtttttcctgccgctcaatctgctgctggggtttatgggtgcgcacgagtggcataagaaaggggttgccgttccgcagctgggcggcagcatacacgttcctttcggcgtattctcgccgttgcgcggcgaatacctcgacctgctcgcccatgcgccgtcaacgggttttcagacggcattcgatatcgggacaggctccggcgtgcttgccgccattttggcgaaacagggcattccttccgtcatcggcacggataccaatccgaaagccgtcgcctgcgcccgtgccaatattgcccgtttgggctttgaaaaacaggttgagatacgggaaaccgatctgtttcccgaagggtttgccgatctgattgtctgcaatccgccctggcttcccgccaagccgacttccgccgtcgaatccgcgttatacgaccccgaatctgcgatgctggctgcgtttttgcgggatgcgccgaaacatctgaatcccgacggagaaatccgcctgatcatttccgatcttgccgaacatctgcacctgcgtccatccgattttctggataaggcatttgctcaggcgggtttgcgtgttgccgatatgatgaaaaccaagccgaagcacaaaaaagccgcgaatccgagcgatccgcttgcttttgcgcgaacccgggaaaccactttcctataccgtttgaaaaaggcataaggggcggcggcgcggcattcgggcggattattcttgtgaaaatacccgctcgagcatactgcccaatgccgtctgacgcgttttgacggtggcggcagcttgccggaaggcttcttccccgccgaagaatacgaacttctctctcgcgcgggtaatggcggtatataacagctccttactcaatccggacaatgcatcgtccccttcgtccgaaggtgcggcggaaggcggcagcagccatacttcccggtattccgaaccttggcttttgtggacggtcatggcgaatgcgggttcaaattcgggcaggcagcttaccgctacctttttaaatccgtccgcatcggcaaaataggcggcaaggctgccctgccgtccgacatcttccataatcagtccgatgtcgccgttgaacagttcaagcgcgtagtcgttctgcctgatcataatcggctctccggcaaaatatgccaaatgttccggtatgttcattttgcggcgtacatggcggcaataggcttcgttgaagtcttccgcatcctgccgccaagctgccagaaccacgatatccgaaatgcccgcgtatgcggcttcgatattgccgtcttttaccgcctgccaataggctttgtgtgcccggtacaacctttcgactcgagcgttcggactgcattccgaatgttccagttcgtccggaaaccggtcaaacaatgcccacgccccttcatcgcccgatacggcggcacgggcaaggcagccgatgccgctgttgtcgccgaagcggtggctgaacgacagatgggcggtgttttgcgccaacacgggtggatttgcgctgacgctgaaaccgtgttccggaaggaagccggccagcctttggtgcgtttctccgtccaaaacggttttttgtgacaaaacggacagcaccgcccctattccgacggacgggagctggttttcatcccccagcagaatcacgcgcgcgccggttttgaccgcttttaaaagttgcagcatcaatgccgtatccagcatagaggcttcatcgataaccaatacgtcaaacggcagcgggtaaacagggttgaacgccgcctgcattttgggcgggcgcagcttcagcagtcggtggacggtttgcccttccagtttgagcaaatggcggcggacggcctccggcgcgtcaaaaccgttgattgcacggtgcagcgcgcgcgccatatgtgccgccgctttgcccgtcggtgcggcaagcgcgatgttgggaagattttcgtcttcaccgcaaatcagcgccagcagtttggcaaccgttgtcgttttgcccgttcccggcccgccggtaatcaccataaaagactgcaacagtgccaaggcggcggcatcgcgctgcccttcgctgcccgtgccttgaaaccattttgcgaggttttgcctcgcgcctgccgcgtcgggggcggatgtgccggctgccgccaagcgttttatctcggcagccaaatcgtattccaactgccacatcctgcccaaaaacagccttctgccttccaaaatcaaaggcgcggcggatgttccgacaacgggtgcgagtgccgacagcgcgtcagcctcgccaccgctcaaacggataaacgaatgaccgttttgcaatgcctgaaacaggcgttcggtgcagtttgcaagcacttcgtcgccggaacccgcatagtgttccaaaaaacggattgccgcccttgccgccgcttgggcaaattcatctgtctgccgttccattttattccttatccaaatgccgtctgaaggcgtggggcttcagacggcgcggtgttgtttcggctgtttaggcgtttgcgccctgtttggggtgcaggctgccgtctttcatgaccatcacgcgctcgaagcggccggcgagttcgtcgtcgtgcgttacgaccaccagccccgttcccaattctgttttcagttccagcatcatatccaaaacattcctggcgttcgcacgatcgagattgccggtcggttcgtcggcaagcaggcatttgggttgggtaaccaaggcgcgtgcaatggcggcacgctgccgctcaccgcctgaaagttcgcccgcgcggtgcgtcgaacggtgtttcagtccgaccttttccagcatcgccattgccgcctccgcagcctcttcacggctttttttgccgatcagaagcggcatcatcacattttccagtgccgaaaattcaggcagaagatggtggaactggtacacgaaaccgagatggcggttacgtaaatcgcccaaacgccgctggtttaaggtacgcaaatcctcgcccatcagcagcaccctgccttcagacggcatatccagcccgcccaaaatatgcagcagcgtcgatttgccgctgcccgaagaaccgatgatgccggtgctttcccctgcgtggatttccaaatccaagccgtgcagcacccgaacgtccaaaccgccgtcccgatagcgtttgcccacgccttcgcatttcaaaatcaactcactcataacgcaaagcctccgccggttgggtttttgacgcgcgccggctcgggtagagcgtggcaacgaaagacagtcccaaagaaatgcaggcaatcagggcaacgtcgcccatatcgacatcgctgggcaggtagtcgataaaataaacctgcgaattgatgaggtggacaccgagcaggttttcaaaaaacgccacgaccctgccgacgttccaacccaaaagcacgccgcagaccacacccgccagcgtgccgaaaaagcctgaaaacgcgccctgcaccataaaaatcttcatcacgccagcaggggaaagacccaaagtccgcaaaatcgcaatgtccgcctgcttttccgtaaccgccatcaccagggaagagacaaggttgaacgccgccacagcgataatcagcgtcaggatgatgaacatcatccgtttttccagttcgaccgcttcaaaatagctgcggttgctgtacgtccaatcgcgcacccaaaccgcgtccctttgcgcctccggaatcagtgttgccgtcaaggcgggagcgttttgcggatcggcgagcttcagccgcagccccgcaacttccttatccaaacggtacagcacgcgcgcgtcttggatatgcgtcattgccaatgagttgtccacttcgtaaacgcccgtcttaaccagaccgaccacggtaaactgtttcaacctcggtacgactccggcgggcgtaacattgccctccggcgtgatgacggtaactttattgccgacttccgcccccaaagcctccgccaagccgacaccgaggataatgtcaaactcgcccggaatcagatcttcaaatttgcctgccggcattttgtcgccgtattccaccactttgcgttcttcagacggcaaaatgccgcgcatctgcacgcccctgatttcgcccgcattggccagcaatgcctgattggaaacatagggcgcggcagccaaaatacctttgcggttttcggtaaaccgaagcaggttgcgccaatccgtatccgtattatcgatatagccgatttcggcgtgcggcgcgacattcaggagctgcccgcgtatttctttctgaaagccgttcataaccgacaagacgacaatcagcgcggttacgcccaaggcgattccggcaatcgaaaccatcgtgataaacgacataaagccgttgcgctttttcgccctgagatacctcaagcctatccaagcctctagagaaaacataacgctaccttaaaaatgtctgcaaacgtgccgccccggacggcggtttgggggcggcggcaaaagtttattgtaccgtaaaacccaggcagcgtccgaacgcccgagtgcgggggacggggcggcagagcgggcggaaaacttgcacaacgcgtcaaactgccctatcctttccttcagaaaaaccgtttcttgaggaaaacaatgaatatccgaactgcttttgctttgtgcgccatcgccttatccgccgctgcggctgcctacgccaaagaaatcaaaatcgatgccaacaacacgccttattccgaagccgacgcgcaaaagctggcggcaacggcagtcggtatgggtgttaaggaacctatcagcctgaacggcggcagcggcagcattaccgtgtccggcagcagcgcgacgcagtgcgtgttcaaagtcggcaacggaggcgcattgcagattcaagggctaaactgcaagtaaaccgcccggaaaaatgccgtctgaaggcttcagacggcattttgcattggcggcgttatgccccgccttctttaatcaggcggcgttcgtacaccgcctgcgccagcgttcccgcatcgacatattccaattcgccgcccaagggaatgccctgcgacagcctgctgactttgtaaggcaggtttttaaaaaactcggacaggacatacgccgtcgcattgccttctgcggtaaaagcggttgcaataatgatttcttcgacttccccgccgcccagccgttgcgccagcctgtccaatgcgatggcggatacgtccattcccaatgccgtattgatttgccccatcaggacgaaatacagcccgtcgtggcagtttgccgcttccatattcgacacgtcggcaggcatatgcaccaccatcagccgccgcccgtcgcgtgtttcatcggcacaaatatcgcacaatccgccttcgcaaaacgtgttgcacatcgcgcaatggtaaacctgcttcaatgccgtctgcaaggcatccaccagtttttcagcctctttgcgcttgtgttggagcaaatgatacgctatccgctgtgccgatttcggcccgacgttgggtaaaaccttcagcgcgtcgatcaatccttggaaggcatcttgttttttgtggctcatcatattccgccgtatgggaaaacggccggaatattccgaccgttattttgtcaacaaaagtgtcaattactgaccgtcgccgttgtcgaccgattgcgctcctttggtctgtttgattttgccgttgaaataacgtatcaacaagtcgaaagtattggcagactgctgttgcgccaaagcctgttttgcaagcggaagctgtgcggcgatatcatccggcggggttacagcctgtacttcgacaatcacgggtgccggcagaccgatcagcctgacgtaggcgggtttgccgtttgccggttttgctttcagcagttccgcataagcctcgggcggcatggactgccttgcctgctgtgcgcccaaaacggacacttccgaccatttcacgtcaacagccttgccgccgttcagttgggtaagcacgtcttttgccttgttttcggcaagtttggcggcttcggtacggatataagcctgacgtaccgcgtctttggcttcggcaaacggcagggttttctcttcgcggacttctttggcgcggacgacccacgcggtttcgctgttgatggtcagcacttcggaattgtgttttttcttcaatacgtcgtcgctgaatacggcattgatcaggttttcgggcataccggacatttgcgcgtcctgcctactcagccaagtttcttgggtttcgactttcaaaccgctgtttttggcggcttcggcaagcgaggaaggatggttgaacgcatcgtcgcccaatttttcttttgccttgttgaagtcggcaaccgcctttttcattttcaattcgttttcgacggcggctttttcctgctcgaaagaaggtttggcttcatttgccggcaaacgcgccacgcgctcttcaaatgcatttttcacttccgtttcactgacggtctgcttgtctgcaaaatccttcagattcaaggcgacatattccaatttgaccgcctgcggcagcagatagtcttttttgttcgcattataaaatttctgcaaatcggcttcagacactttgacttgggcgatgaactcgtcggggttgaaagtgtgcgaacggatggtgcggttgacctgtgtcagcctgatcagctgttccgcctgcgcgtcgccgaccaatacgccgttttggacgaggtttaccaaattctgcaaggcaaactgatcgcggatttcttcgacaaactggtcttcagacatatggcgttgggaaaggtagcggtttaaaagcgcgtggtcgaatttgccgtttgcgtcgtggaaattgggatcgtccacgataatttgcttgatttgttcggaagaaaccgaaatgcccatcagcttcgcgccctgtttcaggtaggcgcgttgcagcagggattggaacaccgcgtcgcgcgaagggccgccgccgtccgcctgttcgttctgtatggcgttgttgatggagtggtcgctgattttttcgtcgcccacttggacgatgtagtcggcacccggatgggataccgtgctgaccccgaagccgacgaaggttaatgcaatcaggcccaaaaggacttgggcgggcgttctgtatttttcgatggaatggaacatattttaaatcgggatatagaatgggaacgggaaattcaagtcgggtattgtaacggtttttatccctgtctgcacggggcttgccggttgaagatgccgtcgtaggtttcttcgctgaagccggcgtaaaccttgccgccgcactccaatacgggacgcttgatcaggctcggcatttcggacatcagtttgacggcctccgccgtcgaggacagcactttttgctgtgtttcggcatcgagtttgcgccagcttgtcccgcgtttgttgagcagggttgccaaaggcacttgttccagccacgagcagatttccgcttcagacggcctctgttttttaaaatcccgaaattcaaactccaagccgtatccggcaagccggtttttggcttttttgaccgtatcgcaatttgggatgccgtgaaggactatcatttggaaaccttttgtctgaaataataaaacggatattttactataagtgtctgaaaatttgcccgtctgtttcagacggcggggcggttatgttacaatccgaaaattcgaaaaatttaatctcttgttcaataaaggctttaccaatcatgatttctaccaacggcatcaccatgcagttcggcgcaaagccgctgtttgaaaacgtatccgtcaaattcggcgaaggcaaccgttacggcttgatcggcgccaacggctcaggcaaatccaccttcatgaaaatcctcggcggcgatttggaacagacggccggcgaagtggcgattgaaaacggcgtgcgtttgggtaaattgcgccaagaccagtttgcctacgaagacatgcgcgtgctggacgtggtgatgatggggcataccgaaatgtgggcggcgatgaccgaacgtgatgcgatttacgccaatcccgaagccaccgaagacgactacatgaaagccgccgaactggaagccaagttcgccgaatacgacggctacaccgccgaagcgcgtgccgccgaactgttgagcggcgtgggcatttccgaagatttgcacaatgcgaaaatggcggaagtcgccccgggcttcaaactgcgcgtattgctggcgcaggcgctgttctccaagccggatgtattgctcttggacgaaccgaccaataacttggacattaataccatccgctggttggaaggcgtgttgaaccaatacgactccacgatgattatcatcagccacgaccgccactttttgaacgaagtctgcacgcatatggcggatttggactacaacaccatcaccatctatccgggcaactacgacgactacatgctcgcctccgcccaatcgcgcgaacgcgccctgaaagacaatgccaaagccaaagagaaactgcaagagctgcaagagttcgtcgcccgcttctctgccaacaaatccaaagcccgtcaggcaaccagccgtctgaaacaggccgacaaaatcaaatcggagatggtcgaagtcaaaccttccacccgtcaaaacccgtatatccgttttgaagccgatgaaaaagccaagctgcaccgtcaggctgtggaagttgaaaaactggcgaaacgctttgaaacccagttgtttaaaaacctgaacttcatccttgaagcgggacaacgcctcgccatcatcggcccgaacggcgcgggcaaatccaccctgctgaaactcttggccggcgcgtacaaccccgaatattcagacggcctgttgccggacgaaggcaccatcaaatgggcggaaaaagccagtgtcggctactatccgcaagaccatgaaaacgacttcgacgtcgatatggacctgagcgaatggatgcgccaatgggggcaggaaggcgacgacgaacaagtcatccgcggcactttggggcgtttgctcttcggcagtaacgatgtcgtgaaaaaagtgaaggttctctccggtggtgaaaaaggccgtatgctttacggcaaactgttgctgttgaaacccaatgtcttagtcatggacgaaccgaccaaccatatggacatggaaagcatcgaatccttgaacatggcactggaaaaatacaacggcacgctgatttttgtctcccacgaccgtcagttcgtttcctccttggcaacccaaatcatcgaactggacggcaaaggcggatatgaacactacttgggcgattacgaaagttacttggagaaaaaaggcgtagcataaccgccggttggaacaatgccgtctgaagccgcttcagacggcattgttgataactttaaaataggaagcatatgcagacttatctcgtcggcggtgccgtccgcgattatcttttgggcttgcccgtcaaagaccgcgattgggtggtcgtcggcgcagacgcacaaaccatgctggcgcaaggcttccagccggtcggcaaagattttcccgtgtttctccatcccgaaacacacgaagaatacgccctcgcccgcaccgagcgcaaaaccgccaaaggttacgtcggtttcagtttccacgccgacaaagacgttacgctggagcaggatttgatgcgccgcgacctgaccatcaacgcgatggcgcaagatgcggacggcaagattatcgaccctttcggcggacaacgggatttggcggcaggcattttgcgccacgtttccccagcctttgccgaagaccccgtccgcatcctgcgtactgcccgctttgccgcgcgttacaagtttgaaatcgccgaagaaaccataaagctgatgcggcagatggtggaaaacggcgaagcggacgcattggttgccgaacgcgtctggcaggagtttgcgaaaggtttgatggaaaaaaatccgcgcaaaatgattgaagtgttgcgcgaatgcggcgcgctcaaagtcttgctgcccgaagtcaatgccctcttcggcgtgccgcaacgcgccgactaccatcccgaaatcgacagcggcatccataccctgatgacgctgcaacgcgccgccgatatgggcttgagcctgcccgaacgctatgccgccctgctgcacgacttgggcaaagccaaaacaccgtccgacatcctgccgcgccaccacggacacgacctcgccggtgtcgaacccgtgcgcgaagtcaatcagcggctgcgtgcgccgaaacattgcgccgagcttgccgaattggtttgccgttggcacattattttccaccaagtcggacagcttaaaagccaaaccattctgaacgttttgaaaaaaaccgacgctttcagacgacccgaacgctttcagacggcattgaacgtctgcattgccgacacgcaaggccgtctgaaccgcgaacacacgccctacccgcaacgcgcgcactggctcgccttactcgaagccgccaatcaggcggattcgggcaaaatcgccgccgaatgccgcgcacagggaaaagcgcaccttatcgccgaacaaatcgaccgggcgcggctggcacaaatcgccccattgcaaaaagcgtttcgagcggcgcaagacaaaacagaaaaacattaaaacgtccaatgcagccacttttatagtggattaacaaaaatcaggacaaggcgacgaagccgcagacagtacagatagtacggcaaggcgaggcaacgctgtactggtttttgttaatccactataaagttttgaggacgatacccaatccaagctttgcaacagccgccgccatatccgctataattcacgcttcagccattccgcccccgacataaaatcatgaccctgaaaaccgatttattgcctaaaatcaacaacgaagattatcaacgcctcatcctcaaacacagtgcggaatttagcggtggcgaaatccgcctgttgaacgaaatcctcgaaaaattcaatttcgacgttgttcaggcgcaggcattggcgcaagccgtcatgcagcaaatccgcttcgaccccaacgcctaccacatcgacagcgacgacgaagacaccaccggcatctgcccccactgcatcaacccgcctatgccgcccctgcgcgactatctcgtttggcgcgaaacccgcggataaaacgcttttgaccgttatcttttcaatgccgtctgaaacgccgccgaccgttcggacggcatacccgacaaagggaacactatgctgcaaaccgacaacctgaccgccgcgcaaccgcaacgcatcgttgccgcccaaaccgcctccgcacaggaagaactgctcgaacgcgccctccgccccaaaacgctggacgactacatcgggcaagacaaagccaaagaacagcttgccattttcatccaagccgccaaaaaacgcggcgaagcactcgaccacgttttgctcttcggcccgcccggactgggcaaaaccacactggcgcacatcatcgccaaagaattgggcgtaaatttgcgccaaaccagcggccccgtcctcgaacgcgcaggcgacctcgccgcccttttgaccaaccttgatccgcacgatgtattgttcatcgacgaaatccaccgcctcagccctgttgtcgaagaaatcctctatcccgcgctcgaagactaccggctcgacattatgataggcgaaggacccgccgcccgttccgtcaaaatcgacctgccgcccttcacgctcatcggcgcgaccacccgcgccggtatgctgaccaatccgttgcgcgaccgcttcggcatcgtctcccgccttgagttttacgaaaaccgagaccttaccaccatcgtcagccgttcggcacaactgttgcagctcgatatgtccgaagaaggcgcggaagaaatcgccaaacgcagccgcggtacgccgcgcatcgccaaccgcctgttgcgacgcgtgcgcgatttcgccgacgtgaaaaacaacggcacaatcgacggcggcatcgccgatgccgctttaagtatgctggacgtggacgcgcaggggctggacgtgatggacaggaaatttctcgaagccgttttgcacaaattcggcggcggcccggtcggtttggacaatgttgccgccgccatcggcgaatctacagacaccatcgaagacgttatcgaaccctaccttatccaacaaggcttcctgcaacgcaccccgcgcggcaggatggcgaccgaacgcgcctacctgcatttcgggctgcccgtcgaaaaataacgcaatgccgtctgaaacagagctaattttcagacggcatttctatttcaatcattggcgcaaggttcagcctgccgcttttttccagttccgccctcatcgcatcaatcaccgccttatagtctggtttgccgaaaatcgcagaaccggcaacaaaggtatccgcaccagctcgggcaacggcggcaatattgtcggttttgatgccgccgtccacttcgatggcgatgtgccgcccgctttgtgcttcgtaccgatccagcatcgcccgcacccggcggattttttcaagggtgtgcgggatgaagctttgtccgccgaatccggggttgaccgacatcagcaaaaccatatccagcctgtccaatacgttttccaacagatatacgggcgttgccggattcaacaccagccccgcctgacagcccatatcacgaatcaggctcaagctgcggtcgatatggcggctcgcctcgggatggaacgtgatgattgatgctcctgctttggcaaacgactgaatcaggtcgtcaacgggttcgaccatcagatgcacatcaatcggcacgcttgcataaggcttcaacgccgcgcaaaccatagggccgaaggtcaggttcggcacataatggttgtccatcacgtcaaaatggatcagatctgcacctgccgcaatgacgctttccacctcttctccgaggcgggcaaagtctgccgataaaatgctgggtgcgatacggtaagtagtcatgttttttccttcaatatccttttatagtggattaacaaaaatcaggacaaggcgacgaagccgcagacagtacagatagtacggaaccgattcacttggtgcttcagcaccttagagaatcgttctctttgagctaaggcgaggcaacgctgtactggtttttgttaatccactatacgttccgattccgccgttatgtctgcctgccggacatacgtacgcattattaacaaaagttaaccgcgataataccatctttcacacgtcaatctagtatatttcctaaaatttccaacaagaggaaaagccgtgccactgcctgctccctgccgttttgccaaacctgccgcctcttttttaagtatggctttgctttcctgtcagctttcccacgccgccacggcttatatccccccgaacgattttcaaccgaactgcgacatacgccgactcgggctgacccaaagtcagcacaatgagctgcgtaaaatccgcaccgccttcaaaatggcgggcgacagggcgcgtttgaaggttatgcattccgaacacagccgccgccggtctgtcgtcgaaatcatttcctcggatgtttttaatcggaacgaggcgcgcgattatgtcgaaagccgctatttgtccggtatggattttgcggtggacgaattggaaatccaacaccggttcttccatatcctcacaccgcaacagcagcaaatgtggctttcttcctgcctcaaataatccccgaaacgctcacaacgcccgttgtttcggcagcctgcccgcccagtcgcaggcaaactgccacgcggaacgtcccgaacggctgccccgcgtctgcgcccactgcaatgccgccatctgtgcggtttcatcatacggcacgccgaaatcttccagccaattttgcaccgccgccagataatcgttttgatcgaacggataaaaactgagccacaatccgaatcggtcggacagggatattttttcttccaccgcttctttctgatggatttccccccgcatccccgtcgtaccggcattctcgtcaaaatattcgggcatcaggtgccgtctgttggaagtcgcgtaaaccaaaacgttggcgcaacgttgagacagaccgccgtctaacgcggttttcaatgccttataggtttcatcgccgctttcaaacgacaaatcgtcgcaaaatacgataaatttttccggacattccttcaaaagcgtcaacaggtaaggcaggccgattaaatcgcttttatcgacttcgatcaggcgcaatcccttatccgcatattcgtgtagcagggctttgaccagcgaggatttgcctgttccgcgcgcgccgctcatcaatacattgttcgcgggtctgccgacaatgaactgttcggtattacgcaccagcaattcggtttgcctgccgactcccgccagccttaccaagggaaaggtgtgcggatcgggcaagtgttccaaaaaaccttttttgcccgcactctgccagcggaaggcaagcgcgttccaatccgtatgcccgggttcgggcggaagcacggcatccaaacgccgcaaaacggcataggctttatcgagaaattcgttcaattccatctctgcctcactttgcatatctttgcgccatcagccgttcgacggtatcgacgattgcctgcgtattcggatcgatttcgatgttgatcctgtcgccgacctttctgctgccgaacagcgtccgttccaaagtttcgggaatcagatggacattgaaacggccgtcttcgactttgcctatggtcaggctgcaaccgtccaagccgacgaaccctttggtcaggatatagggtttgagttcatgcgggagcgaaaaccaaaccgtgcggttgaacccgtcccgttcgatttcgacaataggcacggttgccataatgtgtccgctcatgacgtgtccgccgatttcgtctccgaaacgcgccgcccgttcgatgttgacgcaatcgccttccttcagcagccccaaattggtttttgccaaagtttccgccattaaatcgaaactgacgcggtttccttcgatttcggtaatcgtcaggcagcagccgttattggcgaccgatgcgccgcgttgcagattgtccgccgcctcttgcggaagctcgacgacataagtgtgaaatgcctccgacgggcggtggattgccgtcagttttcccaatccttgaacaatgcctgtaaacataatcctgtttccctgtgtcggtaaaaatggtgcaaattgtagcatctccccgcgaaaaatgccgtctgaaatgccttcagacagcattatgcctccgattcgggcaaaaaccgcccggtatggcttgacctttcctttccacgccggtcggcggtcttgcccttatccctcctgcaaatcgatttgcgtgttcaagtcggcaaaatgcccgtcaaactcgaatctgaccggccgcgccctttgctgctgcaaccagcttcttaatgttttcatacccgaaaacagatagggaatcgcgctttgcagaatctgcgggcggatatacataatgttgtagtgcatcgttatcggcgtttccacataatacgcattgcacaacggtgtgcgtttcgacacggtttcaaacctcgccaccaaatcgtccggcagatacggcatatcgcacggcacaaccaaaagccagtcagcagccgccaactgcaaatcgttggctgcggtacacaatgccgaaagcgggccgaaatgctgccactgccgcgcatcgggaaaaatatgcggacttcttcgagcatattcttccaaattccggttggtgctgatggcgatatggctgacctgcggcctgaccctgtcgatgacatggtctatcagtgccttacccccaaaagagcaagccctttgtcctcgcctcccatacggctcgcctgaccgccggccagtatcagggcaaaagttttcattgcggatgttctcttggaaaagttcgaggttttcatgattgcagtctgccgttcccaatgactcaaaatgccgtctgaagcagacggcaaataaattcatattatctgaattttatcataacatgatttaacactgaagcggtgcggattaagttttccttaaccaattctttctgagcagttgtatctaattccaaagaatgatattgtttgcattatttggaacaatttttcgccgagcatgatactgccagcccgtttttcagacggcatcagcctttccctgcgcctgaaactcctgaccggactgtgggtcgggttggcggcattgtctgtcgttttgacactgctgctctctttgcgtctggaaaacgcggcctccgtcatcgaagaggcgggcaacttgagaatgcaggcataccgtctggcatacatggcgggtgaaggctcgccccgtgcgcaaattgacaatcaggttgccgaatttgaaaaaagtttaaaacgcattgcccaaagcgatgccatccatccgctgattccttcggacacccctcttgcttatgatttgatacaatccatgctgattatagattggcaggcacacatcctccccccgctccagtcctaccggcgaccgactcaggtcgatctctaccgctttgccggaaacatcgaactgtttttgcaggcattggaaaatgccaacgaaaaaaacacatggtggctcaggcgttttcaatgggcaattatgttgatgacgctggtgtcgtctgtactgatgctgttttggcaccagatttgggttatccggccgctgcaggcgttaagggaaggtgcggaacgcatcggacggaggtgtttcgatattccggttcccgaaggcggtacgccggaattcaaacaggtcgggcgttgtttcaatcaaatgggcggcaggttgaaaattttatatgatgatttggaaggacaagtcgccgagcagacacgcagtctcgaaaaacaaaatcaaaacctgaccctgctgtaccaaactacacgggacctgcaccaatcctacataccgcaacaggctgcagaacattttctaaaccgtatcctgcccgccgtaggagcagattccggcagagtttgtttggacggcggatccgatgtttatgtttccattcatcatgcggattgcggcacagcagcttcggatttggggaagtaccatgaggaaatcttccccattgagtaccagaacgaaacattgggcaggctgttgctcagctttccaaacggcatttctcttgatgaagacgaccgcatcctgcttcaaacactaggcaggcaattgggcgtatcgcttgccggcgcaaaacaggaggaagaaaaacgcctgcttgcagtattgcaggaacgcaacctgattgcgcaaggattacatgacagcatcgcacaagcattaacgttcctaaacctacaggtacagatgctggaaaccgcctttgccgaaaacaaacgggaggaagccgcagaaaacatcagctttatcaaaacaggcgtgcaggaatgttatgaagatgtccgcgaactgctgctcaacttccgtaccaaaatcagcaataaagaatttcccgaagccgttgccgacctattcgcccgctttacgcaacaaaccgggataacggtcgaaaccgcctgggaaaacggttcgttcctgccgcctcaggaagcgcagctccaaatgatttttatcctgcaggaaagcctgtccaacatccgcaaacacgcccgcgccacccatgtaaaattcaccctttccgaacacggcggacgctttaccatgaccatccaagacaacggacaaggtttcgacacggagaaaataggagaacccacgggcagccatgtcggactgcacatcatgcaggagcgtgccaaacgcatccatgccgttttagaaatccgttcccaagctcaacagggaaccaccgtctcattgacggttgcatctgaagaaagcttgaaatgactattaaaattattctgatagacgaccataccctcttccgcagcggcattaaagcccttttgtcgcgccaacacggttttgaagtcatcggcgaagccgcagacggcctctcgggtatcaaaatgatcagtcggctgcaacccgatgtcgtcctgcttgaccttgatatgcccggtatgaacggacgcgaagcactctcccaaatcatcagcatcaatccgcagcaggcagtgattatgctgaccgtttccgaagacagcgacgatttgaccgaatgtatgcgcatcggcgcgcgcggctacctgctgaaaaacatcaacgccgactttctgctcgaaagcatacgcaaagccgctgaaggcgataatgtattctcgcccgagatgaccgccaaactcgtcaaaagcctgatttccccccaacctgcccaagggacgcaggcactctcctcacttacccctcgtgaactggaaatcttgggctatctcgccgcaggacacagcaacaaaatcatcgcccgccacctcgatcttgccgaatccaccgtcaaagtccacgttcaaaacctgctccgcaaactcaacctcagcagccgggtgcaggccgccgtttacgccatccggcacaacgtcccccaacctgtgccggaataggcgttcagacggcatattaggggttttaatccccgtacggtcattcggataacagaccaagcatgtaagtttatgcccccataagtacgcttggcatagcagtaatattgttcggtttagtgttttccgtttgcccctatctgatactgcaatatcagctatgccgtctgaaaacgcatcatcatgatattttcagacggcataataaaaagcggaaatactaatgcagggtaaaatgttccattccgaatcccataaatatacaatggcttatatcgtttaagcatgtgtaacccaccctcatatcaatcaatatatagtggattaacaaaaaccggtacggcgttgcctcgccttgccgtactatctgtactgtctgcggcttcgtcgccttgtcctgatttttgttaatccttggattcggatttcaagtgcaacactagtgtattagtggttggaacagattcaagaataaaacacttggcgtttcgtagccaagtgtttttcttggtcggtggttcaactcatcttgaaccctgcgtatctcccgatcactgatgttacggaaatcggtttgtttggggaagtattgccggatgagtccgttggtgttctcattcagccctttctcccaagaatggtaagggcgacaaaaataagtctccgctttcaatgctttggttattttggtgtgttggtagaactctttgccgttatccatggtaatggtgtgcaccctgtctttatgtgcctttaatgccctaacagctgcccgggcagtgtcttcggctttgaggctatccaatttgcagatgatggtgtagcgggtaacgcgttcgaccaaggtcaataatgcgcttttctgtcctttgccgacaatggtgtcggcttcccaatcgccgatacgggatttctggtcgacgatagcgggtcggttttctatgccgacacggttgggtactttgcctctggtccatgtgctgccgtagcgtttgcggtagggtttgctgcatattctgagatgttgccacaacgtgctgccgttgcttttgtcttggcgaaggtagcggtaaatggtgctgtggtggagcgtgatctggtggtgtttgcacaggtaggcgcatacttgttcgggactgagtttgcggcggataaaggggtcgatgtgctgaatcagctgcgaatcgagcttatagggttgtcgcttacgctgtttgatagtccggctttgccgctgggctttttcggcgctgtattgctgcccttgggtgcggtgccgtctgatttcgcggctgatggtgcttttgtggcggttcagctgtttggcgatttcggtgacggtgcagtggcgggacaggtattggatgtggtatcgttcgccctgggtcagttgcgtgtagctcatggcaatctttcttgcaggaaaggccgtatgctaccgcatactggcctttttctgttagggaaagttgcacttcaaatgcgaatccgccatcctctataaaaatgccgtccaaacccatgtttgagacggcatttcgctatagaagcaatcaggcaacctgggtttgatgctcgtctccctgacgctcacggatcaaacctaaacggtaaactgtttcaccttgttcacccaagagaccctgaaccgcatcggcatcttcggcagcaacaataacgaccatgccgatgccgcagttaaaggttcggtacatttcttgggtttccacattgcccgccttttgaagccattggaagagcttgggcaattcccacgatttagcatcgatttgtgcaaccgtgttttcaggcaacacgcgcggcacgttttcggtaatgccgccgccggtaatgtgtgccatacctttaatggtaaatttttccaaagcggcaagaatcggtttcacatacagacgggtcggcgcaataacagcctcccgcaaggttttgccattatcaaactcggcatccagatcgggattgtcgcgttcgatgattttacggataagggaatagccgtttgaatgtgcgccgttggaagccaaacccaataccacatcgcctacgccgatgctgcggccggtaatgacattctctttttccaccacgccgacggcaaaacccgccaaatcgtattctccgacgggatacatacccggcatttcggcagtttccccgccaatcagggcgcaaccggattcttcgcaaccttgggcaatgcctttaataacatcggtcgcgcgcggaacatccaatttaccgcaggcaaaatagtccaagaaaaacaagggctcagccccttgaaccaaaatatcgttgacactcattgcaacaaggtcgatgccgaccgtatcatgtttatcccaatcaaaggcaagcttgagcttggtacccacgccgtccgtaccgctgaccaatacgggattttgatatttcttgccgatttcgaccaatgcgccaaaaccgcccaaatcccccaatacttccgggcgcatcgtgcgtttggcaaacggtttgatgttttcgaccagttggtcgcctgcgtcgatatcgacacctgcatcgcggtaactcaatgaagtactcatcgtttttccttggtaaatggggattggacggtaaaataacggggcgtattctaccttatttcacgtttgcaggttcagatttttagacaatattgtaaacagtccgccatatgcccgcgcgtgtcgggtttggcgggaccgtccgcaggattaacgggcagaaacccgcctgcccttcccctcaattccttatatatcgcgttccatcaaaagacgcattgcttttcttaaccattccttttggcagacgagcggaaggggttttttgatgccatcatcaaaatcaatattttcttctttccggttgaaaccccggcattaggggtggtgaatctgattgcgtgcggaagcacccgtttccgattcggtgcggaacaaatggcggcactttatgtaccgttctgcgtgttgaaacatataggcagataaaaaagccgcccgctgaaaagcagacgacttatgttttgtggcactaatttgtcccgataagcattaactatataatttatttatcattattggtgcggacggagagactcgaactctcacacctctcggcgccagaacctaaatctggtgcgtctaccaatttcgccacgtccgcatgggaattggacgattatacagattttgtttttttgtgcaaggttttcggcggggctgttgatggcttggggtttggggcggtaaaatctgtttttcgtccgcctgacatcggaatcgggcggttttttgtttttattgacggaatttgggtatgcctgctgctttgattaaggattttctgctgactcagggtttgaagctgccgcttgacgaggttcgggcggcgtatctgacggcgcagacggtaatggatatggggacggcttcgatagaccgttcggttttgtggcgcagtgatgagggttggaaacttgccgattacctgtcgtgcgacaatgtccgcgaagatgcactgaaacggcttttcatggctttggattcggtgttttcgcgctcgacaggcgtgcggagtgcggcggtctatgccttgatgccatctgaaaaccaggctttccaactgatatgcctgtcccgacagggcgaggttttggaaaacctgtgggatttggatgaagcggcaggcaaggtttcgctggcttgccgttcggcgcaaagcggttggatgaatgttgcctcggatgtacgccgttggttggatttgggggagctttcgggagaacgcaatcatgcttcggcggcgcaaatttccattccggtctgcacggaaagtggcggtgtgttgggcgtggttcatgtggaatttgaatgcgcagagtgtgcgggtacggcagcacaggtggaatgggtggctcttgccttggctttgtccgaacctttgaaactgctgttgggtatgtctgccggaaaagatgggagtgaagatgtctgaaatgttgaaccatgtggcatcctgccgcctgccgaccgaatggggcgtatttacgatgcacggctttgaagaggcaaacgggcaggaacacgtcgcgctgaccgtcggtaatttttcagacggcaatccggttctgacgcgcatccactccgaatgcctgacgggcgatgcgctgttctcgagaaaatgcgactgcggacctcaacttgaagcggccatgagggcggtacagacagaggggcgcggcatcatcgtctatctgcgtcaggaaggacgcggcatcgggctgattaacaaaatccgcgcctatcatctgcaagaccaaggtatggatacggttgaagccaatttggcactcgggctgcccgtcgatgcccgcgatttccgtttggcgcaatctatctacgaatatctgggcatccgctcggtcaaactgctgaccaacaaccccgaaaaaatccaaaccctgaaagatgcggggattaacgtggtcgaacgcatccccctgcacgtcggggaaaaccttgaaaacaaacgctacctccaaaccaaagcagacaagctgggacatctgatgtcggaataaggcaaagttgcagggaacgggcatcctgcgccgcctttcgggaaacaggtttccataccttgataaagcaataagttttatagtggattaacaaaaaccagtacagcgttgcctcgccttagctcaaagagaacgattctctaaggtgctgaagcaccaagtgaatcggttccgtactatttgtactgtctgcggcttcgtcgccttgtcctgatttttgttaatccactatataaagttacagggtgcggatgcaaacgcattgcgagcgcgggtttgaggcatacgcgcaaacatcttaatataatggattgatatttatgattttctccatcatcgtccctatttacaatgtggaaaatacctccgctgctgcgtggattccgtgcttgccgaaaattttgccgattatgaaatgattttggtcgatgacggttcgccggacggctgcgggaagatttgcgacgaatatgcaggcaaatatccgcatataaaagtgattcatcaagaaaacggcgggctgtcggatgcccgcaacgccggtatccgggcggcaaaaggcgattacctaatctttttggacagcgacgattattgggccgataccaaccgttcaaaaaacgcggggggggattctctttgatttacaacaacttgcagacaaaaaggttgatttgatcctgcatccctcgtccttcaattaccgcgacatccccaaaggggcggacttttcggataatgattttgtccgccattttgaaacgctggtggaggggcggtactatatcgccaacgcgtggacaaagattgtcaggcgggaaatcatcattaaaaacaatctgtttttcccaaaaggatacattcacgaggatttcccgtacagtttgcaattggcgcgttttatcaagacttttgccttttacgataaccctttttaccagtaccgcgttctcggcggctctatcagccacaacatcaaatacaaaaatttcagcgatgtgctgacgcatctcgactggggtgtggattttttagtcgaaaacaaaaattcccccatctacggcggtttgcaaaaatttgtcttcgacaatatcggctatctgaggtctatattggtaaggctttatttttccaaaaacattatcctcatctaccggaaatatttttcatttaaagaaaaatgcagaaagatattcggcgcgaaggcaatccgtccggtttttatcgggaagaccgcattcatcataggattgccgatattgcgcctgctcgtaccgcctatgctgtacccggcaatcaaggccgtttatcagaaatttttttcggaataagcttccggcaaaccccgaatcggaagcgggcgggaagaaacagccgccccgccggcggggattgcggcaatgccgtctgaagccacgaatccggcttcagacggcatctgtttaccaaaaagcaaataattcggtttggcgaaaaaaacagatttgctttttggtaaatacgcgattacaatccgctacatccgatttctacaaaggatgaaacgatgaccgacacagccggtctgcgccgccacaacctgcggcagtggatagaaaaatactacggcggtttgcaaactcgttttgctgaagccgttgccctcaacacaggcgaactctccgcccttttgaaaaacaaatccttcggcgagaaaaaagcccgtaaaatcgaacaggcggcaaaaatgcccgccttttggctcgataccgaacacaccgcccgcccgtccgaacacacaggaaaacacaccatgtcccatatctcccccatccccgaaatcctagccgacatcaaagccggcaaaatggtcatcatcaccgatgccgaagaccgagaaaacgaaggcgacctgctgatggcggcgcaattcgtcacgcccgaagccatcaacttcatgatcaaacacgcgcgcggcttggtctgcctgccgatggacggcgaaatggtcgaaaaactcgggctgccgatgatgacccaaaaaaacggcgcgcaatacggcaccaactttaccgtctccatcgaagccgcacacggcattaccaccggcatttccgccgccgaccgcgccctgactattcaaaccgccgtttccccgaccgctaaacccgaagacatcgtccaacccggtcatatctttccgcttcgcgcccaaaaaggcggcgtactcgtccgcgccggacacaccgaagccggcgtcgacctggcgcaaatgaacgggctgattcctgcctccgttatttgcgaaatcatcaacgacgacggcacgatggcgcgtatgcccgaactgatgaaattcgccgaagaacacaagctcaaaatcggcacgattgccgacctcatcgaataccgcagccgtaccgaaagcctgcttgaagacatgggcaatgcgcctgtacaaaccccgtggggcgagttccaacaacacgtttacgtcgacaaactctccggcgaaacccacctcgccctcgtcaaaggcacgcccgccgccgacaccgaaaccctcgtccgcgtccacgaacccttcagtgtgatggacttcattcaagccaacccgcgccattcatggtcgctgcccaaagcccttgagcacatccaacaagccgaaagcggcgtcgtcatcctcttacaccgcaccgaagacggcgcatccctgctcgaccgaaccctacccaaaggcgcaaaccaagcctacaaatgggacagcaaaagctacggcatcggcgcacaaatcctcgccggcctcaacgtcaaaaaactgcgcgtcctcgggcagccctcatctttcaccggcctgaccggcttcggtttggaagtcgtcggctttgaagaagcggaaaaataatatagtaaattcaaatactttatatttgctttatttattgcattatttccgtgcaaacgaaaacccggtctgttgggttggattttgttttttcaaatttcgggtaacttctaattcgtcattcccgcgctggcgggaatccggttcgtcgggtttttgtcatttccgataaattcctgtggctttggttttttggattctctctttcagggaaagaacggcataagtattttccaaaccaaacaaaatgccgtctgaaaggctttcagacggcattttaagtttgaccggtttcattcatcggtatttatgaattgaatttcaacatcgccaatctatccttaatctctttttccaattcggcagattcggcgaaaagtttatccaaatccgctgaaaatcccgccattttttgcgcaaattcgtcggcggaaatatccacataatcaatctttacctcgaaatactgccccgccgacaagctgtgattcttcgctttgatttcatcgtagccgattaccacactgaaatcttccactgcctgtttgtgcgtgaaggtattgcagatttttttgttcttcttcgcgggaaagtacggtttttttgccgtctttaattttttcgcccaagcccgatgcgtcgattaatatagtggattaacaaaaatcaggacaaggcgacgaagccgcagacagtacaaatagtacggaaccgattcacttggtgcttcagcaccttagagaatcgttctctttgagctaaggcgaggcaacgccgtactggtttaaacttaatccactataccacgttgtctttattggctttatcaataaacaggataagacctgaaaaaaagccgatacgcctttttggtgtaccggctttgccatactgttctgcttcagacagcattgcttcattttgcctttaatacttcttcgtccagcgatttcaaccattccagcttttcgccgattttgatttccaacccgcgcgggacgggttggtagaagtccggttcgtccaagccgtcgggcatatagctttcgccggcggagtaggcgttcggttcgtcgtgggcgtagcggtattcgcgtccgtagcccaattccttcatcagcttggtcggggcgttgcgcaggtggacgggcacttcgtcgctagcgttttctttgacgaagtggcgcatttggttgtatgccttgtagcccgcgttggatttcgcggcggcggcaagatacaataccgcttgcgccaaagccagttcgccttcgggcgagcctaagcgttcgaaggtggcggcggcatcgttggcgatttggaaggcgcgcgggtcggcaagcccgatgtcttcccaagcgatacgcacgatgcggcgggcgaggtagcgcgggtcggtgccgccgtcgagcatacggcagaaccaatacagcgcggcgttcggatgcgaaccgcgcacggatttgtgcagggcggagatttggttgtagaaactctcgccgcctttgtcgaaacggcggatttgcgccccgagactgtcggcgagaaattcggcggttaagtttttcagacgacgtgtatcggcggcgcgtaaaagttgttccaacaaattcaacaatctgcgcgcatcaccgtcggcggtattcacgagtaatttttgcgcatccgtttcaatcgtaaactcttggtattcaggcaaagccaataccttggcaatcagctttttcaggtcgtctgaagacaagggttgcaaaacatacacctgagcgcggctcaacagcgcgggattgacttcaaacgacggattttccgtcgtcgcaccaataaaggttagcaaaccgctttcgacatgcggcaaaaacgcgtcctgctgcgccttgttgaagcggtggacttcatcgacaaacaaaatcgtcgcgcgtccctgctgcaaagcgatttcggctttatcgattgcctcgcggatgtccttcacgccggaaaatacggcggaaacaggcaaaaactgggcgttgaaactctgcgccaaaatccgcgccaacgtcgtcttgcccacgcccggcggcccccacagcaacatagaatgcggcttgccgccttctaccgccacgcgcaaaggtttaccttcgccgatgaggtgttcctgccccaccacgtcgtcaagcgtatgcggacgcaatcgttcggcaagcggcgcgtcgggttctcgggcaaacaaatcggtcataacggctccgtcaacaggttttcaaacaatatgattatacggcagggaacggcggcgtgccgcatacggattccgcccctccgtttgccttaagccgatattaggcgcatactggaaaagacgagagacttcacacaatatatccggcacggagaccgattccgcatcggcatgacaatacccaaatcagcgtttcaattaaacattaaggagactaaaatagaaaatttgctttatctaccattgctttgttgatttaatcggcattatgttttgaggcggaagcccatgaatatactaatattcaagagatggaatgggtgtctttattttctgatccgcaaagagacgatgatagtcttataacccttaaagatgaaaaaatcactgtaaaaaactatattgtgccttggtggaaaaaaggtgaaaactttagaaaattagaacttggcggattcgcatttgaagtgcaactttccctaacagaaaaaggccagtatgcggtagcatacggcctttcctgcaagaaagattgccatgagctacacgcaactgacccagggcgaacgataccacatccaatacctgtcccgccactgcaccgtcaccgaaatcgccaaacagctgaaccgccacaaaagcaccatcagccgcgaaatcagacggcaccgcacccaagggcagcaatacagcgccgaaaaagcccagcggcaaagccggactatcaaacagcgtaagcgacaaccctataagctcgattcgcagctgattcagcacatcgacccctttatccgccgcaaactcagtcccgaacaagtatgcgcctacctgtgcaaacaccaccagatcacgctccaccacagcaccatttaccgctaccttcgccaagacaaaagcaacggcagcacgttgtggcaacatctcagaatatgcagcaaaccctaccgcaaacgctacggcagcacatggaccagaggcaaagtacccaaccgtgtcggcatagaaaaccgacccgctatcgtcgaccagaaatcccgtatcggcgattgggaagccgacaccattgtcggcaaaggacagaaaagcgcattattgaccttggtcgaacgcgttacccgctacaccatcatctgcaaattggatagcctcaaagccgaagacactgcccgggcagctgttagggcattaaaggcacataaagacagggtgcacaccattaccatggataacggcaaagagttctaccaacacaccaaaataaccaaagcattgaaagcggagacttatttttgtcgcccttaccattcttgggagaaagggctgaatgagaacaccaacggactcatccggcaatacttccccaaacaaaccgatttccgtaacatcagtgatcgggagatacgcagggttcaagatgagttgaaccaccgaccaagaaaaacacttggctacgaaacgccaagtgttttattcttgaatctgttccaaccactaatacactagtgttgcacttgaaatccgaatccaagggcattttaaaatcccgaagcagacggcacgcgccccgaacattcgttctttaacgcccgttttcagaatgcccgcctgcgggcatattttgcccgatcagttcggctatcctctcgccgtcaaactgcgttttgaacaccaccttgatttctttggaaatctcggcaaacagcttttcggcatgtttgattttccgctcttcgctttttcgcaaatcttccgccccgtcagtccctttggcttcaatcacaaagttcaggatctcgccgcttttggttttcacgatataggcaaaatcgggcgaatacgtgccgccgccggcaacagggattttgatggagtttctcggtattttggtaaatacgattacgccttcaatttggttgttggcgacattttcatgttctatatccgaatcgtagaaaatctcgccgaagagatagccggcggcaggccggtgctccgtatcttcaaatctgcccaaatctgcttttttcaccgcgcgcggtttgccgtctttattggtaaatttggtcggatggattttgctgccgacaagccggtaatccagttcgaatttatggaaggaatgatgaagcaaaaaccggttgaagccgtttttgatttgggcgatggtttgcatattcaaaaaatcgccaatgttcagttcgttgcggatgcagtaaaacgcctgatgcaaagtctgcatacggatttttgccgtttgtgccagtttttccagaaactctcggtaagtcattgtgttgaaacggataaaatcttcatcttcaaaactgtctatgcggcgggaaagcataagcccgttgttgatataagcttcgtttaccgccgtgcgtatgcctgcctgtgggaatttggcagcgttttcatgcaaataggcggtaaataaatcggcaaattcggcttcatccttgattttatactgcaaaacggctttatggtgaatcagctcccacaaggctttgagttcttcatatttgccttcgcgcatgatgatggtgtctttgccttcgtctttggcgttgctgactttgcctttgtccaaacctttggggaaggcttcgggataggcggcttttaatttgtcatagccgtcttcggcaaagttttcattgtcgtcaatgatgccatctaaaaacagttggtttaccaataccagcggtttgatatcggggtatttttgcaatattttttgtttcagctcttcggtaaactttttggagatttcttcctgaaaagaattgtcgttgatttcgccgacaagctgcttcacaaagtctttttcgctgctatcgacaaaataattcagtttgtacggtacatcgcgcacccgcgccatcagctcgtttaccggcaggcgcaggccgcgtccgacttcttgcagcttggaagtcgtgctgccgctggaacgcagtttgcaaatctggaaaacgttgggattgtcccagccttcgcgcagcgtccatttggaaaaaataaagcggcgcgggttgtccaaagacagcagtttttccttatcgtgcaggatttcattgatttcctgctcgattctatcgtcgctgtctgtattgtctttggaaaaatagccgccgtggcaggcggatacatcgtccaacgtcttttgcaggtaatcgcggtaaaacgggtcgctttccgttttcagacggcgtgccgcttccgcgcgaatccagctttcaaatttatctttcaggctgcctgaaagctcgttgccgctgcggtagcccgcgatatcgtcaataaaaaacagcgtcagcggcttgattttgggctgtggcgcgcgttctgccaaaagcgcgcgttccagcttgaaatgttcggcaaccgcccgctgcatcatcgcatcctgcaccgtttgcgaataggaataagggttgatgacggcacccgttttcaactccaagccgttgcttaacaccaccacggttttattcattttgtcgattttcaaatccgaaatagccggatggatttgcgccaaatcttcgccttttgccagtttgaacgtctgctttttgtccttttcgtttaattcaaatttcgcttctttgccgtccgacgacaccagttttaccgccgcatccatgccgccctgcatttcttcctgaaacacgcgcacgcctttgaccagcccgtcgttaaacgcgtctactgccgtcaaacggtaaagcaagttgtaatattcatcgttaaatgttgcaccgtagcgcaaaatatattgcggttttaagcgtttgatattgccccacgttttcgcgctatctcgggtcgggaatttatgcggttcgtccacaatcataaacgggcgcacggcagccaatgcatcaacgggattgtcaaacaaatccttcaatgccttgtcgcccgtatcgttcatggacgacgaattaaccatgcccgcgttaatcagcagcacatgaatttcctttttgttttccgctttgacaaattgctcaatcgttatgggcgcattggactttttgcccttattctttttcgcgctttccaccacataggttttcaggcgtacgccttcataatcgccgccgaaatcctgttcaaaatgctctgccaaagccttgctttgcaaaaactgctgtgttcccgccttaatggacaaagtcggcacgaccacgataaatttgaacacgcccagccaacggtgcagctcgaacatggtttgtgtgtaggtataggttttgcccgtgcccgtttccatggaaatatcaaggatattttggtcgtccgaacggtcggggaatcggccgtctataccgttttggctttgcactttcaggatattgtttgcgtattgttttgcagcaaacaaaagttcgggattttcgtctgccgtccgatatttgggcgttgccccgtcaaacacgcccaaaaccgccgaaaccgcccgcatttggtgcggctggtttttctcgtaattaaaaccgctcatgaattgcctccgtcaaaccctgataaccacattcaactcaatctcttttttattggcataaccgcgaaccgcctggtcaagttcgtgctgcatggcgcttgccatattgctgccgaatacaatcacgcggttgggattgaaatccgcatcgtcgtccagcttgcggataaacgccaacaaatcggcggaagtaaaaccggcattcatcagatacagccgtttttcgcacagatacgccgtgtaagcccctaaccgcacaggctcaaccggcgtggtcagtgccgccccgtcatacagcgtccaggtggtcagaagcgtttgcagctgttcttcgcttaattcatcgttaagcggcaaatccggttgttcgggcgaaaaatccttgtccggatgctgcctgaaattgtctgccgtttgaaagattttgaagcccgaatcgcccgtgtaatcgggatgttcgacgcggattttggcggcggctttttctatgcgggctttggtgatgtcgaagatggtcgggtagcctgctttacgggcttcggatttttcagcggttttttcgggaagctgtacacagatatagcggcggttaccgttttgtccttcggcgttaagctgcatcacggcgtgggcggttgtgccgctgcctgcgaagaagtctaggattaggtcattactctttgaacttattgaaactaaaaatttaatcaattgactaggcttggggaaggtaaatattttgctaccaaataaatctgtgatttcttttgtgccttctttagtcattccgatattttcaggtagcgtcctactaaaaatagccaaatattcggctactgcatcggctaatgtaccaacattttcaggtaatctactgcttacagctactttgccaaaatcctcgccagcttttttcatgtcgtcatctttaaagtaacgcataactggattgctgatatttaagaaatcataatcatcagggaaaacgatttttcctttattataataatcttgaaatgtatctttggttacacgccaagttgcatttggatttgctggatatttttttcctgtcttgggatcaaccattgtgaaaaaactatttggcctttccgccgcagttgtttgtttcgttaagtcgtgggtacgccaaggacgatcggggaaatcatcagtctcataatagcgtcgttccttgcctttagttgctgcaataaattggcaagattttgcgaatacaaatatccattcataatcctgcgaaataccaaaaggcacatctgatttagctgttctttttcgccaaggcaattgtgcaacaaaattcccttccccaaacacttcatcacacaacaatttcaactgcgccgcttcgttatcgtcaatcgagataaaaatcacaccgtcgtcctttaacagttcgcgggcgacatacaggcgcggatacataaaggtgagccatgcgctgtgcgagtttgagcctttgtcggtgaaatctaaaatccgcgcggcttcgtcttcatcaatattggctaggcgggcaagttcagcgggtgtgaatttgcggtcgtcctgatagacaaagccgtctgatccggtgttttagggcgggtcgatgtaaatcatcttcacgctgtttgtgtaggcgttttttaagtgtttcaacacttctagattgtcgccacgaatcagcaggttttggctgcctgcattttcgggcttggcgttgtgcgtcttgtcttcacttatcagggtttcgggcggcaggttgcgaagcaggcgagcatatgatttgcccagccagttcatttcgtaaaattcgcgtccgatgtcggtctgcggcgcgatttcggcttgtaatctgtcgataaggaaatttccgtctgcgtcaaaacaggcgggaaacagttttttgagctgttcgagttgggtagagttggcggtaatgccgtctgaagtgtagattgcctcagtgttcgccccggctgtgtcgcttagatcagggcttgggttgggttgggttgggttgggttgggttgggttgggttgggttgggttgggttgggttgggttgggttgggttgggttggcagcattttaaaatcctcggtttgaatttgtcaatatcaactgtctgttttaaaatatttttttactttaaacggcgttttttgggaaacgggcgacgccgtctgaacgtctgtctgcgtgttactgcccgacaacaacgcgacggattttgacgggctgtacgggtacgttttgataaaagccgcgcgtggcggttttgacgcgggcgattttggaaacggtgttcatgccgctttcgaccctgccgaaaacggtatagccgtattgtccgtttttgtagtcgagcgaagcgttgtccgccagattgataaagaattggctggtggcggaatcgggggctgtcgtccgcgccatggcgatggtgccggcggtgtttttcaagccgttgccggattcgttggcaacggccttatcgcttgccttttgtgccaagtcctcggtcaatccaccgccctggataacaaaaccgtcgataacgcggtgaaaaacggtgtcgtcgtaaaagccttttcgggcatagcgcacgaaattagcaacggttttgggggctttggattcgtccaaaaccaaacggatattgcccatatcggtttccatcaaaacatgggttgccgccatagacggcagggaaaccgccaaaagcagcgcggttaaaacggttttgaatttgggtttcatcccgtcctcctcagaccttcagacagcattttcatttcctatgccgtctgaaggctcgttaacgctattccaatgcgtctttgagtttttgttcgattaaatccgcatcaaacgatttggcaatcaattcaaaacgcgagtcgcgccgccaagacacttggttcgcaccccattgcccgtccacccagttgagccacacccacgttcccaatacttggaacacgcctttggcacggacgagtccttcggtcatattgggcaaatcattgaagaagttggtcaatttttcaccgtcgaaatcgcgtccggcggggaatgtgaaaccttgcgactggaagcccatcgtgttgtccggcagggctttgaggcggtagcgtgatttttcgatgacggggatgtcaagccattggatatcgagttgtgcgttttgaacttcgaccactttagccttgggcgggaacagttttgcggctttgtcgtgaaattcggcaagctgttcgggggtgcataaatcggttttgctggcaaccaatacgtcgcagatgccgatttggtctttatacaatgcctgctgcgcgtaatcggggttgatgaactggcgcggatcgacgacggtaaagactgcgccgatttccaaaaggctgtccagcggtttggttttcagttcatcaatgacactggcggcgtgcgccagtccgcttgcttcaatcatcaggcggtcgggcttggcgtcgcgcagcattttctgcacggttacgcccatttgcgggccggcggtgcaacacaaacagccgccggcgatttctgccacagggatgccgttgtcgctcaataccgcgccgtcaatgccgatttcgccgaactcgttgacgatgatgacccatttttcgttcgggtctttttgcgccatcaggcttttgagcgcggtggttttgcctgttcccagaaaacctgaaatcaggtggactttggtttttttcatttctatgtgatgtcccactttaaaatttgaagatagggtgttttaaatgattaaataatgttaaaagtgatggcagctgttatcatgttcttcatcaattgacaattgttccagcaaattcgatatatcggctgacatcgccggtatgacgttcaaaaccgtctcccaaacgacagacaggttcatttcaaagtagccatgggcaatcctattgcgcaataccccctcatccctatccaattcaaatatttggtttcctcggcaaattccggatacgatttaaggatatgggttgcgttttcaccgataaggaacaaattaaaaacgactgcctgcacagtctttgtgtcggcagaaaattgcccataatccattttgtcggtatatagccggatatattgcgctgcctgcaatatctgtttcaaatagaccgacaattctttctgcattttcataatgcgacagcctcagtcaacaccttatctctaaagtgggccgagatgtcatcgggtgtcagcaaatcgacctttatgcccaagagtttctgcaattcctcttgcagcccgcccaaatccaataatgttgtccctgtttttgcatccaccaacaaatcaatgtcgctgttttccgtatcatctccgcgagaaaccgaaccgaatacccttggattgcaaatcaatggatatttcccgaaaactgccaatatttctttctttctgctttgcaacaaaagagacggtttcattatctgctcctttcgaaaggcttattatcaatgcaaaccaccgattactgctgacattttttacaaatcccggttaaaacaacgtgttcttctttcagcgcaaagccgctttcggcaacgcctgcgcgcagtgccgcccactcgtggctcagggtttgctcgtccgccgtgccacattcggtgcagaccaaaataaacgcgctgtggtgcgcttcggcttcttcgtggtcgtggcaatggtcgtcgcactcgtgctgcgcgtggctgcacaaaatatagccgttgaccgccgccactttgtgcaaaacgccctgctccgcccaaaaatcaagggcgcggtaggcggtaggcggtgcaagcacgccctcgctttgctgctgcatctgcgacaagacgttgtaggctttaatcacgccgctttgctgcaagacaatatctaatacctgctcgcgcaaagcggttacctgcaagccttcgctgcgtgcctgttcgataattttctgtttgaaatttgttttcataaattctctgtttatgccgtctgaacaaccgatacggcaggaggcggttttatatttgtattcaattgctttatttggaaatcttttccaacaatgcccgacagcccgcatccgcaagcctgaaggtttcttcaaaatcgcccgtataccacggatcggggacatggtcgtaaccgctttcgggtatcaggtcggtcagcttgaatattttttccggccgcctgccgaaggttctttccaattcggacaaattcttgccgtccatcgcgatgatgcagtcaaacgccgccgcatcgctttggcggattttgcggctggtaaagcctgaagcatcgataccgtgttttttcaatatctttgccgtctcgcggtgcatatcttcgccgtcgtgccagcccgatgtccccgcgctgtccgcttcaaggggaatgcccgcttcggcggcgcggcggcgcaaaatgtattccgccatcggcgaacggcagatgttgccgaggcagacaaaaaggattttcggttttttcatatcccctccctgttccggcgcgatgccgtctgaagcggaaaccctttcagacggcatcggtcggttaatcgtaaccgcataaggcagaaccagccaaaacatccatctggaagaaatggtttggctaaatcttaggcatatttaataagtgtccaatattagaagccgtatgctccaaatagaggctggcatttttcaaactatcttctaaaggttcacttttctccaaaatagaaaaggcagcttggatattttcaaatggcagggaaggcaaatcttcaacgagactgccacaaatagcgacaacaggaactccgacaggggttctttttgctacaccaataggcgctttccctgctaaactttgacgatctagtcttccttcaccaacgataaccaagtcaacatctgacactttcttatcaaagtcaatcaagtccaggcaggtgtcaattccagatacgatacttgcctgagcaaaggcgcacaaaccaccagcgatgcctccaccagctcctgctcctttaagttttaatgttgcaggggagactttttcataaaaatcttgtattgcctgatctacggcctcaaacatagtagaatccaaccctttttgcttgccaaacgtataggtcgcaccttggtgtccacataagggactcacaacatctgctaaaatacgaatgtgaacatcttcaggaatttcatagcgattttctgttgaaacagaagctaggtttagtaaggattgaccgcaaacgggtaaggcatttccatcctcatcataaaattgataacctaaaccagcagcaatcccaatacctccatcattactggccgtaccgccaacgccaatatagatttctttaatttcttgactaatgaggtggcgaatcaattctccaataccacgagtttggatttgtaatggatttcgtttctctagcgggatttttccaagaccaaccaaatcagcaacttcgaatagggctagttgttctttttgaaaatagcgcatgacttctttttgtccaaaaggtcctgtcacttggagacatttttcttctaggtcaagagaatgtcggatagcatctacagtgccttctcccccatcaccgacaggacagaggagacattccacatctgctatcgattgttggaagcctctttttattgcttcagctacctgttgagctgtcaagctttccttaaacgaatccggtgcaattacaatcttcatatttataattcatcctttcgtttcactcaaggcacaacacagaatgaaaaagtgttgtgctctttattttgatttattatataaatgagaaagcctatcactactacaaatcactatgcgctgaaaaacggattgtgcccttcccgtttcaatgcttccgcatagctcgggatgctttcctgttcgcccaagggattgtgcaacaggtaaacgtgttccacgcggcactccgccatcaggtcgaggaaattttgctggatgacggcgatgttgtcggtaaaggaaagctgccacgaaaacacctgcggcacgacttcaaacgcgccgtcggtcgcattaaacccgaataaaatctgtccgcccgcctttgccgcagcgaccacgccgacgcgcggactctgcatacggacggcgcgtatcgcgtttgccgcaaacacatccatcgccatacgttggcgcgtgtggctgccgtctgaaagcgcgcgtaccggagaatccggggaaagcggattggcaaacagcgtaacgccttccgatgcaagattttcctgccatacctgcatcaggggcagacctgcctgaagaaggttctgacccaatgccgtctgaactttgccgctgccgaaacccagcgcgtaaacgacgtggacggactgcccttcgggcaacagcaaagggcgcggggcgaaacggcgcaagtgttgcgccgccgcttcggtattttgtttggcacgccaccactcatccggcgcgaccgcgctcaaatcggaagaatgcacaagataaggcagccattgcgtctcttgcgtcaacgcgcgcaggtgcggatagttttgcaggcaggcaaacaatgcctccgtcggcagcttcatctcgattgcacgttcttttttgcagccggacaccagcacgaccggcagggcgaaccactgcacttcgccttctttctcgcaatcgagtaccgcgttcacactggaaagcagcgcggcataagttccggcatcgggcgacatcgtcagcgcgagggaaaggttgatatagtggttttgctcaagcattcccctgatttcggtttgaagttggccggacgagagtttgcgcgaagcctgggaagaattatgcgccaactggtaggcattgagcagcaggtggtttttaatcggattttggggatacgggcgcgtatcgggcaaggtaaatgtctggttcatatgtgtcgtgcaccgcttttcgcagtgtgtgtctttcctgtctgaaaatatatcggacggattgccgccgggacttgcccgtcaatccgccgaaacgagaaaatgcctgtctgccaagtctgccaatatttcttccacatacacttcggcaggcggatggaatgtcaaaccgtcgggcgtggtgctgacgatgttcaagttttcggcaaccgtttcaatcaatgcctgtttgctcgtcggccgcgacaattggcgcataatgtacaaatgcccgtatccgaatgagggggtgctttcgttgtaacggttggcaggccggacaaacgcttccgcgccgtgttccacaaaggcggcggcatagtttgtaaagcgcgccggcacataggttttatggtcttcaaaaaatggtttgcccgcattgtctgatgaaacagaaaaacgcccgagaatggtttgcaataaaagctgggaattgattttcatgcggtcaaattccaaaccgggaaatcggcgggcgagattttccgcaacatcttccgttttaaacgcctctccggttttcatcacatcgcgtatgcccgaaagcaggatatcgttttcatcaaagttgattgtttcccctcttgccgggcggaaattcaaactttctatcacttcgacggcaaccgactcatcacgcctgacagtatccccgacttcctcacggcataaaagcgaacggcggaattggcggtcggataaaatatcactgtaaaattctttggcaatataatcgtcccctgccaatgccagaatccgctcccgcgtatgctccgccatccaagaaacaaaagacacgtgcaaattggtatccccgatatatgcgagcctgtggcggttagcccattcgatgaagccgttgacgtaaatcgggtcgttaaacgcctccatatattcgtgtgcgatgtaataaaaattatgattcaatattttttgaatcgccggaagtttgccgccgccgtccaagcccttgtcgttttccaaaatttccgccagcgccttgagcgcgtccaagcctttccgcgtccgcgcttccaagggttcttcaagcacatccctgccggcaaagtacataatttcgcgcaactgctcctgccgtttccagccggggtaaacattgtatgaaatataggcaatgccgtgtttggtcaggttgttccagcaaatcgaaaaaattttgtctttaactgcgtcaggcacccacgaccaaatgccgtggacgatgatatagtcaaacttcccgaatgactcatcgatggtcaaaatatctttttcttccagacgcacatttttcaagcccattttttcaatgatggcgttgccctgtgcaacctgcctgccggacaggtcgataccgacaaattccgcatccgggtaataaagtgcctgcgtgatgatgtttccgcccatcgaacagcccagctccaagaccttggcattggcggcgggcgcgggctgcaaacccatcaggcgggcgcgcgcctccaaattattgatggcggtttgagagaatgcgccggattcgtacatcaaatcatcatatgaatttttgatgttggacacgtccggcacaccgttctccgttgcagcacgcgcaaaggcggcttttttcttcttgttcggcatattttgtttgtctgaaggcactattgcccgcaagtttaaccaattcatcctacccgttcaactaaatcaaatgccatctgaaggcgcggagcgtacttcagacggcatctgggaggcgcgaaggcttcagacggcatttttgccgctttatttcaacgcggcatcatagccgccgtcttcaacggcttcaatcaacgcccctgcatcggtttgcgcggggtcgtatccgacggtcgcacttttgttttcaaggctgacttcgacgcttgccacgccttttacgccttccaatatccgggtaacgcttttgacgcagccgccgcagctcatgccgccgatgtcgaggataagggtttccatgatttttcctttcgttggtactgcattctgacgggcgttattgtaagtcggggcgtgaacttgggcaaacgcggaaacggtgcggcggtttgaaaaaatacggacgcttgcgcataatggcggcaattcccatcaggacaacaacaatgaacgcttcgcaaaaaccctggttgagcatcattgccttggcaatcggcgcatttatagtggattaacaaaaaccagtacgtcgttgcctcgccttagctcaaagagaacgattctctaaggtgctgaagcaccaagtgaatcggttccgtactatttgtactgtctgcggcttcgttgccttgtcctgatttttgttaatccactatacaacgtcggtatcggcggcggcgcgctgctggggcattgggttacgcaatactcgggcatttcctgcatcggcgttgcgggtatgctgacggcggcggcaggtttgtgggtctgcctgaacctgaaccgccatatccgaacctgaccgcacgatgccgtctgaagcccctcccgcccttcagacggcattttgattgaagaaatatccacccctgcttaaaataacgggctttgccgtgttttaacgcctattttttgttccaaggatggtttatgccgctgctgtctgtcgagttcgcactgttctttctcgccttcctgccgatttactggggcttggcgaaatacccgtccgtccaaaacctgctgcttttggctgccggtatgggctggctctaccatatcggccctgtatttgcggcaatcatcgtcctttattcctcctgcgtgtaccttttgggcgaactgctccgttccgatcgcgaaaatacgcgccgtttctggctggggtgcggcattgccgcctcgctgaccgtcttgggctttttcaaatatttcgactttttccgcccgatgattgcccaatatgccggaaaaggcggcgcaatcgacatcctgatgccgctggggctttcgtattacaccttccagtcgctcgcctatctggtttactgcttccgcgccccgcacgccgcgcgtttcagctggcacgagctgctgctgcacctgagttttttccccaccgttacctccggcccgattatccgcgccgccgcattcaaaagcgcagacggcgagcaggcaggcgcattggcgcaaatccgtacccgccgagcgcgttcgcccgtccgccccgcactcgccgtttccctgattctgctgggtattgccaaaaaatggtggctggcggggatgctggcggaaaactgggtgtcgcccgtatttgaaaatcccgcccaattcgacggctggggcgtattgggcggcgtgtacggctataccttccaactctttttagacttttccggatattccgatttggttatcggcatggcgatgctgctgggctttaggctgcccaaaaatttctccgcaccgcttcgtgctttaaacatccgcgcattttgggacaaatggcacatcagcctttccacctggatacgcgactacatctacatccccttgggcggcagcaaaaaaggctttttacggacacagctcaacctgatggcggcaatggtgctctcaggcatctggcacggctacggctggaacttcctcatttggggcgcgctgcacggcacggcactggtgctgctcaacacgggcgaccgctatttcggacgcgacgcgctatgccgtctgaaatacttcgcgccgctctcatggctcattaccttccatttcgtctgccttagctttgtcgtcttcaataccgcaaatcccgacgatgcaggcgcagttttcagtgccctctttgccaatgccaacggctggaatgcgccgcaacaggcaaacatgctgttgcttgcctcgtttgcatccgtgatgctgctctacccttacctgcaacgcgctttcgacggcgcggtcaaaggtttggaaaaaatcccgatgtggctgtggtttatccccgtttccgccgtcctgctgctgattatcgtcctcgccccctcggggatacccggctttatttatgccaatttttaagggtttggacatgaaaaactttctttcccttttctcctccatactgatgtctgccctgattgccgtgtggttcagccaaaaccccatcaacgcctactggcagcagacctaccaccgcaacagcccgctcgaaccgcttgccgcctacggatggtggcggagcggtgcggcgttgcaagaaaacgcctacgccctttcagacggcatcaaagccttcctgtccggcgaaacgccgccgacggctcaagacggcggttcggcagatatgccgtctgaagccgccgcatccgaagccgtccctcaaaccggtgaaacagaatggaaacaagacaccgaagccgccgccgtccgcagcggcgacaaagtcttttttgtcggcgactcgctgatgcagggcgttgcccccttcgtgcaaaaaagcctgaaacagcaatacggcatcgaatccgtcaacctcagcaaacaaagcacggggctgtcctacccctcattcttcgactggccgaaaacgattgaagaaaccctgcaaaaacatcccgaaatcagcgtactcgccgtcttcctcggaccgaacgacccgtgggatttccccgtcggcaaactctatctcaaattcgcttccgacgaatgggcgcaagaatacctgaaacgtgtcgaccgcatccttgaagccgcacacacgcaccgcgtccaagtcgtctggctcggcatcccctacatgaaaaaagccaagctcgacggacagatgcgctacctagacaaactgctttcggaacatttgaaaggcaaaatcatcctgattcccaccacgcacaccctgagcggcgggaaagaccgctacaccgactccgtcaacgtcaacggcaaacccgtccgctaccgcagcaaggacggcatacactttaccgccgaaggacaaaaactgctggcggcaaaaataatggaaaaaatcgtttttgaaccaagtacgcaaccatcaagtacacagccatgaaccccaaacacctcatcgcattttccgccctattcgccgccacgcaggcagaagccctacctgtcgcctccgtcagcctcgacaccgttaccgtttccccgtccgccccctacaccgatacaaacgggctgctgaccgactacggcaacgcctccgcctcgccttggatgaaaaaactccaatccgtcgcacaaggcagcggcgagaccttccgtatcctgcaaatcggcgactcgcataccgccggcgacttctttaccgacagcctgcgcaaacgcctgcaaaaaacttggggcgacggcggcataggctgggtttaccccgccaacgtcaaagggcagcgcatggcggccgtccggcacaacggtaactggcaaagcctcaccagcaggaacaacaccggagacttcccgctcggcggcatcctcgcccacaccggcagcggcggcagcatgaccctgaccgcatcggacggcatagcaagcaagcagcgcgtttccctgtttgccaaacccctgcttgccgaacaaaccctgaccgtcaacggcaacaccgtctccgccaacggcggcggctggcaggtactggatacgggcgcggcactgcccctgaccatacacaccgaaatgccgtgggacatcggcttcatcaacatcgaaaatcccgccggcggcattaccgtttccgcgatgggcatcaacggcgcacaattaacccagtggtcgaaatggcgtgccgaccgtatgaacgacctcgcccaaaccggcgccgatttggttatcctttcctacggcaccaacgaagctttcaacaacaacatcgacattgccgacaccgaacaaaaatggctggataccgtccgccaaatccgcgacagcctgcctgccgccggcatcctcatcatcggcgcacccgaatccctgaaaaacacgctcggcgtatgcggcacacgccccgtccgcctgaccgaagtccaacagatgcagcggcgcgtcgcccgtcaggggcagacgatgttctggtcttggcaaaacgccatgggcggcatatgcagcatgaaaaactggctcaaccaaggatgggccgccaaagacggcgtacacttctccgccaaaggctaccggcgcgcggcggaaatgctcgccgacagcctcgaagaactcgtccgctccgctgcaatcaggcaataatcggacaggaggcggacggtatttccgcaacagggggatgccgtctgaaacgcataccttcatattgcttcagacggcatagccaccccgcgcacggtttgccggacgcaaccggcattcgcctcaggcatcggaaggacgcaggcgaacctccggcatacggcgcaaaggcggcgtttgatatgccgtctgaaggcaaagatgataaactgccgccttccgttttcagacggcatattgttttcaaatgagggcgttctccgtccgcaaccataaaggaagtttcatgaaccggacttatgccaatttctacgaaatgctcgccgccgcctgccgcaaaaacggaaacggcacggcagtgttcgacggcaaggaaaaaaccgcctaccgcgcgctcaagcaggaggccgaagccgtcgcggcgtatctgcaaaatatcggcgtgaagttcggcgacacggtcgcgctggcggtttccaattccacagaatttattaccgcctatttcgccatctccgccatcggcgcggtcgccgtaccgatgaacacatttttgaaaaacagcgaatacgcgtatatcctgaacgactgcaaggcgcgcttcctgttcgcctcggccggcctgtcaaaagaattggcgggcttgaaggcgcaaacgcccgtcgaaaaaatcatttggacggacaaaagccgtccgaccggcgaaacggcggaaggcgatgccttttttgaagacgtgcgccgcttccccgaaaaacccgacttgggccgccaaccccggataaatgatttggcacacatcatctacacctccggcacgacggggcatcccaaaggcgcgctaatcagttacgccaacctgttcgccaacctgaacggcatcgaacgcatctttaaaatttccaagcgcgaccgctttatcgttttcctgccgatgttccacagcttcacgctgacggctatggtgctgctgccgatttatatggcgtgttcgattattttggtcaaatccgtttttccgttttccaacgttttgaaacagacactgctcaaacgcgcgaccgtgtttttgggcgtacccgcgatttacaccgcgatgagcaaggcgaaaatcccttggtatttcagatggttcaaccgcattcgcctgtttatcagcggcggcgcgcctttggcggaacaaaccatcctcgatttcaaagccaagttcccccgcgccaaattgctggaaggctacggactgagcgaagcctctcccgtcgtcgccgtcaatacgcccgagaggcaaaaagcccgcagcgtcggcatccccctgcccggtttggaagccaaagccgtcgatgaagaattggtcgaagtgccgcgcggcgaagtgggcgaactgatcgtcaggggcggttcggtgatgcggggctacctcaatatgcctgccgccaccgatgaaaccatcgtcaacggctggttgaaaacgggcgatttcgttaccatagacgaagacggctttatctttatcgtcgaccgcaaaaaagatttgattatttccaaaggtcaaaatgtctatccgcgcgagattgaagaagaaatctacaaactcgatgccgtcgaagccgccgccgtcatcggcgtgaaagaccgttatgccgacgaggaaatcgtcgccttcgtccaattgaaggaaggtatggatttgggcgagaacgaaatccgccgccacctgcgtaccgtgctggcaaatttcaaaatccccaaacaaatccactttaaagacgggctgccgcgcaacgctacgggcaaggtattgaaacgggtgttgaaggagcagtttgacggaaacaaatgaacgccgtgccgtccgaagccccgtccggcaaaaaaatgcggtgaatctgattcaccgcatttttttgacaaacaccggagggagggcatttactctgccaattccacctgctcgtgcgccatcagttcctgaccgacatcatccaacaacatcaaataacgttcgtagtttttcaaaatgtcggcaatcagctcgtccttgttcatatactgcacatcgtacccgacgcgcccgtcgaaaaaataagcgtagggtttgtaagttgtctgatgccggatatgcggcagcttgccgtcgttaatcaactggtcggatacatcctgcccgacagacttaatcccgtacataaaatcgcgcatcgtctctttccgaatgacgaactcgattgcgggctcgtcccgatgaaacattttatcgacccggacgctcaagccgtattcttccgaaagctcccgttgcaactcgtgcatagcgggcgatgcagtctgtttgaggaattttaaaatatcctgctcctgcgtctggctcattatctgcaccagccgttctttccacttgccgcccgtccaaaatacactggtagggttaacccgggtctcaaaatatttcttatccgcactcaagcctttccacaggctgaaacacattatcagcatcagcagggcaaacggcagggaaacaatcagggtcatagactgcaggttgccgagtccgcccgagcgcatcagcaaaacggcaacggcagacatcagcacgccccacataaccgcctgccaccgtggcgcgctcaagcctttgtcccgagaggtaatattgttcaggacataaatcccggaatcggcagaagttacaaaaaacagagaaatgaccagcaggctgacgatgctcgtcaattcgggcagggggaggtaattaaagaatttaaaaagcagcgtttccggagaggaggtcatcttttcgagcattccccccgcaaccccgtcattcagccaaatcgccgtattgccgaagacggtaaaccacaaaacgccgaacaggccggggatgagcaaaaccccgaagacaaactcgcggatggtgcgcccctttgaaatgcgcgcgataaacaaacccacaaacggcgcccaagaacaccaccacgcccaataaagcaccgtccaagattcaaaccacggcttgtgttcccgttcgtacgcataagttttaaaactgaggcgcaccagatttccgaggtagttccctatgttgtcgccgaatgccgacaacaggtaaacagtgggtcccgccgccaaaacaaaaaacagcagcaaaaacgcaaggcccaggttcaactcgctcaacaccttcacgcccttccccacgccggatattgccgaaacgacggcgagggacatgacggcggcgataatcaaaacctgcacgctgaagctgttttcggcaatccagcccatttcctgcaatccggcgcccagttgcgaagccccgaaccccaatgtggtgatgatgccgaaaaaagtagcaagcaacgccataatatcaatggcatcgccgaaccttccggaaattttttctttcaacagggggtaaaaacaagaacgcagggcaagcggcagcttgtagcggaaaccgaaataagccaaagccaatgcaatcgtaccgtacaccgaccaagcgtgaacgccccaatggaacaccgtgtgcagcaatgcctgctgctgcctgtgttccggcgtgccggccgtaatgtccgaaaaataatgcatcaacggctctgccacgccgaaaaacatcagacccacgcccatcccggccgcaaacagcatcgccagccacgacaggaagccgaattccggcacatcttcatcccgtccgagcctgatgtttcccaaactgctgaccgagagtatcagcaggaaacccagaaaaatggaaaacgttaaaacataaaaccagctgaactcggtaaaaatgacttcttttgcccgatcgagccacatctgcacctgatccggcacggttaaaaccaataccaccaaaacacacacaaaaaacaaagtcgtcaaaataaccatcggattaaatgacgttcggcgttctataaattcagacagggacaaaccttctcactcctttgttaaaaacagacaaacccggtcatcgggcaaagcggtcaaaacctgccggtaaaataccggcttccggatgacgaaatgcacaaaccggccgaaattgttataatcgaaaaaattaaaaatcaatacggattattctatcagattgatttatcgatatttattatatcattaatatagtttgatttcaaaccggcggaaaatgcgccgcccaccgcaggcgcgccctccccgctatcggggcgtttaacgccggattgccgatgcggtacaatggctgatatgaagaaaattacccctcaaaacctgcgccccctgctttcggaaagcttgggacataccgattttgtcaacgtcctcaacgcactgattaaatttttgcgccgtggcggcaaaaaatgtgcgggggaacgtttcgacctgattatcgacacattcaaacaagacagggaattactgtcccgcttcagccggtgtttttacatttggctcgcgcaaatacacatttatccggcactcatcaaactcggcatcttctcgcgccacagctttgcccgggaaatgggcatacgcatctacgaacgcttcagcccgtcatataaagattttgccaacttgggcgaagtcttcctttatcttttccattccgaaaacgacgacaaatggctgcaaacgctcaatatccgccaatggctggttttatacgaactcatccggagccacgccgagccgtccaaattgcagacggcgggcatccgccttgccgatgcgcgtttgcgcgccatcgaaatgctgtctgtctggacggcatccgaagccatcgaacccgacctcatccgcatcgccccgcgcctgctggaagccgattcttccttcgtcgccctccaacgcgaaaccgccaaactggtcgaacactaccgcaacggcaccacgccttacgacaccgcccacctcgaagtgatgttcgaccaatgtttcagccagattgactatttgcgccgcaaagggacgggcgccggctccggttcgtcggtcaaagtcgcccacctgctcgaacggctccggcagaccgtagaccgtctgaagctgctcaccgacatccaaaccggcgccggcaacagcaaccgcctgaccatcgcgctgatgaactccctcatctacgcggcggtcgaacaatacagcacccgccacctgcgccgcagcagcatccgtatgctcgcccgcagcattaccgaaaacaaaagccaccacggcgaacactacatcacccgcaaccgcaaagaatatttcaaaatgttctactcggcggcaggcggcggcatcatcatcgccctaatggcgctgctcaaaatccgcatcggctcactcggcctcagccccttcctcacttccttgtcggctgggttcaactacggcatcggctttatgatcatccatatgctgcactgcaccgtcgccaccaagcagcccgcgatgactgccgccagctttgccgaacaggtcgatctcaacgaaggcggcaaagcggtggacaacaaactcgccaagctcctcatcgacgtatgccgctcccaaagtgtcgccgtcttcggcaacgtttccatcgccatccttttggcgtgcgccatatcgttcggctatgcccatctgtaccggctgcccatactcgatgcccacaccgccgcctaccagttcaaatccatagacatcatcgcttacccgacgctgtggtatgccgccattgcaggtctgtggctgttctgctccggcatcatcgcaggttttttcgacaaccgcgccgactacctcaacctgcgccaacgcctgcccttcaaccccttgctgcgtaaaatcatgcgccccgggccccgccgcgtcctcgccgcctacatccacaaacactacggctcgctggtcggcaacttcatcttcgggatgctcttgggtatgaccggctatttcggacacctcctcgggctgccgctggacatccgccacgtcgccttttcctccgccaacctcggctatgccgccgtcagcggcaacgtcggtttgggcacgttcgtactcggcattttcagcgtcctcgccatcggcctggtcaacctctgcgtcagcttcagcctcgccctcttcgtcgccctgcgctcgcgcggcacgaaaatcggcagcatccgcaatctgattaaaagtttttggaatcagattaaaagcaatccctgcatacttttcctcccgcccgccaaagaacagggacatcctccttcggacaagccttgaccggcaatgccgtctgaagcgggattcgccccgaataccgccctgatgcgggaaatccccataaaaggatgcaaaaatgccgtccgaaccgaaacgtggttcagacggcattttaaaaaacattacaatcccgggccgccaagcgaattggcaatgtccctgaccgccgttacatacatccggctgtggttgtactgccataccgtataaaaattgttcaagcccaaataatattcaaacacgcccggtgcggtttccagtttgaacaaaaccgccttttcatcatctgcaagctcttcgccggggatgatgccgtacgccttcaaatccgccaccgtccgcgtcagggcggttttttcgccaatgattgcctgaacatccgcacccggcgccaatgttgcagacaccagcattttcccgcccgtgcgccaaccgtgctgcttcatataattggcaaccgatgccgcgacatcgccgacgttgccccatatgtcccgatgtccgtccccgtcataatccaccgcccatttccggtagctcgaaggcataaattgcggcatccccattgcgcccgcatagctgcctttaaaggcgaaaacatcgccgccttcttcttttgccagctttaaaagctcgaccaattctttttggaaaaacccggcgcggcgggggtaatcaaagcctaaggtcgccaatgcgtccgccacacggaaactgcccgtatttttgccgtaattcgtttcaatcccgataaccgccacgataagttcggcaggcacgccgtatttttgcgccacatcatcgataagcgcgcggttttccgcataaaaccggcgcgcgccgcgaaatttcgccttgcccgaatttcccgtgcggaacacataccacggacgcgatgtggaggggcggtgcataatcttgacgatgtccgccttgtaagccgctttgtcaaaaaaatcctgccattccgcccgggaaaaatcccctttcccgacttcatcgtccacaaaacggcggacatttgcattggcggcaaacccgctgtcggataccggtacggctgccgcgtcaaatacggctgccgcgtcaaacgcggggcggctttcttttttcatttcaaccgcgcggggggcttgggcttcatttgcccggggtgggcgtgcctccatcgccgtacaggcagacaaagccgccaaacaaattgccagcggcagtatttttctctttttcataaatatgttccgaacaaatagggtaagtgggaaagcggcacaagggggcggcgcgaaatgcggcatccgccgcaatcggcggctttgcggaatgccgcacgttgcctcttgcaccgcccgaaatccgtatgtcgtcgccgaaaatgccgtctgaaggcacttcccctttcagacggcattgcctgccgccgtatttgcccgctacccgcaatatcggcagtccaatatatctttgcggatgtcgttcagcaggaaggctgcggtgtcttcgtgtttcgcctgtacgaagacaaagagtcgggcgatgattttgccgataaagactttttgcagggcgcaggcatcggtcagggtgtgttcctgcaggaagctgcggatgtcttcaggcaaagtgtagtcgcgggcgacggcggcaaagcgggcatcggtttgcaggcggtcgagcagggtttggtttttgtccaacttcatgcctgcttctttttcttcggcggtggcgcggacaaactggtcgtaaatttcggcataaagcatatcgttcgggccttcaaaaatcgtgaaggggcggatgtcgatagcgatattgccggcggtgtgtccgcgttcaaaacccttcgcacccaagagtttttgcaacatttgcgcggcggcgtaagtgtattccgtggcgagggttttgacgatgttcgcctccatcagctgatgggcgacgggggcaacaggcgaaacggaatggcagacgtagcggtaaagaatctcggaaacctgatggcggcgccggatttcgcggcgttcgtaatcgacgaatttgatgtcgttgcggacgtatcgttccagattttcaaggatgtattccataatgccgtgcgtcatgccgatcagttgcaggcggctgcggataaagatgttttggaacgcgcgcaaaccggcagcgtcgctctgggagagtttcatcacggcggttgcaggcatttcggcatcgatgcggttgacggcgtaacggacggcgcgcaagccttcggatgcgagggtttcgcagcggatgtatgttttggggacgagcagcaggtcgatgactttggcgagtttgccgtttttgcgctctttggcggcaacgaggaggaagtcgctttgcgagttgccctgccagtatttcgcggcgttgacgtaaatggtttgtccgtcgatatattcgtagtaggactgcatttcgcgtgcaatcgccgcgccggaggtttcgggttcggtaacacccaaaccgccgccctcgcctttgaaaatcatctccaaaccttgcgcgacttgcgcttcatcgccgaactcttgcagtggctgcaacaccagcgcgccttcgatgccggtacgcagcgtaacgggcacgccgtaatgccccgcaatccgcaggacttcttggatttcaaactggctgcccttgcgcccgccgtattttttgtcgaggaagggcaacagcaaacccgcctgcttcaaggcaagccatttgtcttcgggcaggtatcgcatcaggtcgataccgtctgaaaaaatgcggcggaatgcggattcgatgtgctttaaaaaagcagccgtgtccatagttgacggctgcgcgctcggttcggtgtgtatcatcggcttcctctgtcggttcccattaatcggcggccggtcaaaccgcctgccacagtttagagttgattttctaaactttaccacaaagtgcgccgggcaacaatccgccgacctttcagacggcatcgcgtcccctcccgtgctaaaatgaccgtttgcatcactgtccgccgattgccgcactatgacctaccccatccccaaaccccgtgaaaaatcccgttggcccaatctttcgcaaggctcgctgcccttggctttggcgcgttatctgccgcacaagcggctcaaggtcgtgctgacccaagatgcggaacaggcgttgcgccttcagacggcatggcggtttttccgtccgcacgacacggcggtgttcctgccggactgggaaacgctgccttacgagcgtttttcgccgcatcaggatttggtgtcggagcggctgtcggcgttgtggcagattaaaagcggcgcggcggatgtgttgttcgtgccggttgccacggcgatgcagaagctgccgcccgtgccgtttctggcagggcgcacgttttggctgaaaacggggcagactttggatataggccgtctgaaaagtgatttggtggatgcgggctacaaccatgtttcccacgttgtcgcggcgggcgaatttgccgtgcgcggcggtatagtcgatttgttcccgatgggcagcgaaatgccgtaccgcatcgatttgtttgacgatgaaatcgacagcatcaaaaccttcgataccgaaacgcaacgcaccatttcccccgtttccgaaatccgcctgctgccggcgcacgagttccccaccgacagcgaggcgcaaaaaatcttccgcagccgcttccgcgaggaagtcgatggtaatccgaacgatgcggctgtgtacaaagccgtcagcaacggtcatttcggcgcgggcgtggaatactacctgccgctgttttttgaaaacgagttggaaacgctgtttgactatatcggcgaagatgcgctgtttgtctctttagacgatgttcatgccgaggcaaaccgtttttggagcgatgtcaaatcgcgttacgcgatggcgcagggcgacgaaacctatccgcctttgcttccacagtatttgtatctctctgccgatgtgttcgcaggccgtctgaaaaactacggacaggtgctgcccgatgtttccggcaaggaatacaccctgcccgaccttgccgtcaaccgccaagcagatgagccgttgcaggcattgaaggattttcagacggcgtttgacggacggattttgctgtgcgccgaaagtttgggacggcgcgaaactatgctcggtttcttgcagcaaaacggtttgaaagccaaacccgtgtccgactggcagggctttttatcggcacacgagccgctgatgattacagtggcgccgttggcatacgggttcaaactgggcggactgcaatcgccgaaccaacagcaacctactccctcccccgtgggggagggttggggagagggcaaagcagttgccgctcaaactgaattttccgcagccgcaataaaccctctccctagccctctcccacaggagagggaacaaagtgcagccgccgtttcagacagtctgaaagcagccgccgtttcaaccgaaagcagcctgcccctcggtacaagtaatctgcacgggcaaatccgacagcaacctgccccttcccccgtgggggagggttggggagagggcaaagcagttgccgctcaaaccgaatttcccgcatccgcaacaaaccctctccctagccctctcccacaggagagggaacaaagtgcagccgccgtttcagacgacctgaaaaccaaaagcagcctgcatcccgtcgcaaataatctgcacgggcaaatccgacagcaacctactccctcccccgtgggggagggttggggagagggcaaagcagttgccgctcaaaccgaattttccgcagccgcaacaaaccctctccctagccctctcccacaggagagggaacaaagtgcagccgtcgtttcagacagtctgaaagcagccgccgtttcaaccgaaagcagcctgccccccggtaaaagtaatctgcacgggcaaatccaacagcaacctgccccctcccccgtgggggagggttggggagagggcaaagcagttgccgctcaaagtgccatcgccgtcatcaccgaatccgatctctaccaatacgtcgcccgttcgcgcatccacaaccgccgcaagaaacacgccgccgtttcagacgggctgttgcgcgaccttgccgaaatcaatatcggcgaccccgtcgtgcacgaagaacacggcatcgggcggtatatgggcttggtaacgatggacttgggcggcgaaaccaacgaaatgatgttgctcgaatacgcaggcgaagcgcagctttatgtgcctgtttcgcaactgcatttaatcagccgctactccggtcaggcgcatgaaaacattgccctgcacaagctcggcagtggcgcgtggaacaaggcgaagcgcaaagccgccgaaaaagcgcgcgacaccgccgccgaattgctcaacctctacgcccaacgcgccgcccaatcgggacacaagtttgaaatcaacgagttggactatcaggcgtttgccgacggcttcggctacgaggaaaccgaagaccaggccgccgccatcgccgccgtgattaaagatttgacgcaagcgaagccgatggatcgccttgtgtgcggcgatgtcggcttcggcaaaaccgaagtcgccctgcgcgccgcgtttgtggcggtgatgggcggcaaacaggtcgccgtacttgctccgaccacgcttttggtcgagcagcacgcgcaaaacttcgccgaccgtttcgccgatttccccgtgaaagtcgccagcctttcgcgtttcaacaacagcaaagccaccaaagccgcgctggaaggcatggcagacggcacggtcgatattgttatcggtacgcacaaactggtgcaggacgacatcaaattcaaaaacttaggtttagtgattatcgacgaagaacaccgcttcggcgtgcgtcagaaagagcagctcaaacgcctgcgcgccaatgttgatatccttaccatgaccgccacgccgattccgcgtactttaagtatggcgttggaaggactgcgcgacttctcgctgattaccaccgcgcccagccgccgcctcgccgtcaaaacctttgtcaaaccctttagcgaaggcagcgtgcgcgaagccgtgttgcgcgaactcaaacgcggaggacaggtatttttcctgcacaatgaagtagatacgattgaaaatatgcgcgagcggctggaaaccctgctgcccgaagcccgcatcggcgtggcgcacggacaactgcgcgagcgcgagctggaacaagtcatgcgcgactttttgcagcaacgatttaacgtgttgctctgttccaccatcatcgaaaccggtatcgatatccccaacgccaacaccatcatcatcaaccgcgccgacaaattcggactggcgcaactgcaccagcttcgcgggcgcgtcggccgcagccatcaccaagcctacgcctacctgctcacgcccgaatacatcactaaagacgcagaaaaacgcctcgatgccattgcggcggcagacgaactcggcgcaggttttaccctagccatgcaggatttggaaatccgtggtgcaggcgaaatccttggcgaaggacaatccggcgaaatgatacaggtcggcttcacgctctacaccgaaatgctcaaacaagccgttcgcgacctcaaaaaaggccgccagcccgacctcgacgcaccgttgggcatcaccaccgaaatcaaactgcacagccccgccctgctgcccgaagattactgccccgacatccacgaacggctcgtcctctacaaacgcctcgccgtctgcgaaaccgtgcaacaaatcaacaccatacacgaagaactcgtcgaccgcttcggcctgcccgaacaacccgtcaaaacccttatcgaaagccaccacttacggcttatggcaaaagaattgggtatcgatgccattgatgcggccggcgaagcggtaacggtaacctttggtaaaaacaataatgtcgatccaaccgaaatcatcctgctgattcagaacgacaaaaaataccgccttgccggcgccgataagctgcggtttaccgcagagatggaaaatatcgaggtcagaatcaacaccgtaaaaaacgttttaaaaaccttgcaaaacagatgcctgcccaaataaagccgacaccgcaatgccgtctgaaacaccgttttccttgtccgaaagccgccattatgaatttgaaggaaactccactataatacggcattcagatttccagacggcatcgcgcccgtcaaaccgcacacaaaccaaaaggaaatacatgttccgtaccatgcttggcggaaaaatccaccgcgccaccgttaccgaagccgatttgaactatgtcggcagtattaccgtcgatcaagacctgttagacgcggcaggcatctaccccaacgaaaaagtcgccattgtcaacaacaacaacggcgaacgttttgaaacctataccattgcagggaaacgcggcagcggcgtgatttgtctgaacggtgctgcagccaggctggtacagaaaggcgatatcgtcatcatcatgtcttacgtccaactctccgaacccgaaatcgccgcacacgaacccaaagtcgtcttggtagacggaaacaacaaaatccgcgacatcatctcctacgagccgccgcacaccgtgctgtaattccgcaaacggacatcgattatggatattaaaatcaacgacatcaccctcggcaacaactcgcccttcgtcctattcggcggcatcaacgttttggaaagcttggattccaccctccaaacctgcgcgcattacgtcgaagttacccgaaaactcggtattccctatatctttaaagcctctttcgacaaggcaaaccgttcctccatccattcttatcgcggcgtaggcttggaagaaggcttaaagatttttgaaaaagtcaaagcagagttcggcatccccgtcattaccgacgtacacgaaccccatcagtgccaacccgtcgccgaagtgtgcgatgtcatccagcttcccgcctttcttgcgcggcagaccgatttagtggttgccatggcaaaaactggcaacgtcgtcaacatcaaaaaacctcagttcctcagcccctctcaaatgaaaaacattgtggaaaaattccacgaagccggcaacgggaaactgattttatgcgaacgcggcagcagcttcggctacgacaacctcgttgtcgatatgctcggtttcggcgtgatgaaacagacttgcggcaacctgccggttattttcgacgttacccattccctgcaaacccgcgatgccggttctgccgcatccggcggtcgtcgcgcacaggctttggatttggcacttgcaggcatggcaacccgccttgccggtctgttcctcgaatcgcaccccgatccgaaactggcaaaatgcgacggccccagcgcgctgccgctgcaccttttagaagattttttaatccgcatcaaagcattggacgatttaatcaaatcacaaccgattttaacaatcgagtaacacggtttcgccttatgatgcagactttccgaaaaatcagccggtatgtcgcaaccttgtggctcggtatgcagattatggcgggttatatcgccgcaccggtgctgttcaaaatgctgcccaaaatgcaggcgggcgaaattgccggcgtattgttcgacatcctctcttggagcgggcttgccgtttggggcgcggtactggctgccgcctttgccgccctaacccggcggcaaaccgccctgctgctttttttattgtccgcccttgccgccaaccgattcttgattacacccgttatcgaggcactgaaatacggacatgaaaattggctgttgtcgtttgtaggcggatccttcggaatgtggcacggcatttccagtattgtttttatggcaaccgccctactttcagcagttttaagttggcggctttccggcaaagatgccgtctgaagccctcccatttttttacctcccttcacttcacttggagaacattcatgagcgcaatcgttgatattttcgcccgcgaaattttggactcacgcggcaaccccacagtcgagtgtgatgtattgctcgaatccggcgtaatgggacgcgcagccgtaccgagcggcgcgtccaccggtcaaaaagaggctttggaacttcgcgacggcgacaaatcccgttattcgggcaagggcgtattgaaggcggtcgaacacgtcaacaaccaaatcgcccaagccctcattggtatcgatgccaacgagcaatcttatatcgaccaaatcatgatcgaattggacggtactgaaaacaaaggcaatttgggtgcgaatgcgactttggcggtttctatggcggttgcacgcgccgctgccgaagactcaggcctgccgctttaccgctacttgggcggcgcaggcccgatgtccctgcccgtaccgatgatgaacgtcatcaacggcggcgaacacgccaacaacagcctgaacatccaagagtttatgattatgcccgtcggcgcaaaatctttccgcgaagcgttgcgctgcggtgcggaaattttccacgccttgaaaaaactgtgcgacagcaaaggcttcccgaccacagtcggcgacgaaggcggtttcgcccccaacctgaacagccacaaagaagccctgcaactgatggtcgaggcgaccgaagccgccggctacaaagcgggcgaagacgtattattcgcattggactgcgcctccagcgagttctacaaagacggcaaataccacttggaagccgaaggccgctcctacaccaacgcggaatttgccgaatatctggaaggcctggtcaacgagttccccatcatctccatcgaagacggcatggatgaaaacgactgggaaggctggaaactgctgaccgaaaaactgggcggtagagttcaattggttggcgacgacttgttcgtaaccaatccaaaaatcttggccgaaggcatcgaaaaaggcgtagcaaacgcattgctggtcaaagtcaatcaaatcggtactttgagcgagaccctgaaagccgtcgacttagccaaacgcaaccgctacgccagcgtaatgagccaccgctccggcgaaaccgaagacagcaccattgccgacttggcagtcgccaccaactgtatgcagatcaaaaccggttctttgagccgttccgaccgcatggcgaaatacaaccaactgctgcgtatcgaggaagaattggcggaagccgccgactaccccagcaaagccgcattctaccaactgggcaaataaaaaaggttaaggtatgaagtgggtaactgtcgttttatccttcgcacttgtctgttgccaatacagcctctggttcggcaaaggcagcatcggacgcaacagcagtctgagagaacagattgccgttcaagaagaaaaaaaccagacactcgccctacgcaatcattcccttgccgccgaagtctatgatttggaaaacggtcaagaagccatttcggaaatcgcccgggtagaactgggttatatccaagacggtgaaaccttttaccgactcatcaggcataaccggtaataccgtcaaaaagccgtccgaaccaatgttcggacggcttttatttcaacaaactgtcagacagcccctcatcctcccccgacaaaccgcaatccagcctgacatccccctcgacgcaacagcagcacggcagtatctcgtcccgccccaaaaaagccaaaggcggctcccgataagtaacgcttccctccaaaatcttcactcggcacgatccgcaatatccgcttcggcactgatattccaccatatgccccgtccgttccaagccttccaacagagtctcgccctccaagagttcaaaaaaacccttattcgtaccaatgcgcgccatttccgaccaatcaaaaatatagtggattaaatttaaaccagtacggcgttgcctcgccttgccgtactatttgtactgtctgcggcttcgtcgccttgtccggatttttgttaatccactataatccactataatccactataaaaggaacaataaccgatcctacccgctgtttttcccatcatacaacatacaaatgccgtctgaaacatccggcttcagacggcattttttcaaaaaacatttacaactcaaaatcgcccaaatcatccgtattcacttcagaatctatctgaccgatcaaataagaggatatttccacttcctgcggcgcgacctgtacgttgtcggacgacagccacgcattaatccacggaatcgggttttgatttgcgccttcaaatccggccggcaaccccaccgcctgcatacgcagattggtaatatattcgacgtattgggataagatttctttgttcaaaccaatcatcgaaccgtctttaaacaaatatgccgcccattctttttcctgttccgccgcttttttgaagagttggaaacattcgtcctgcaactcggcggcaatttctgccatttcagaatcatcaacaccagaacgcatcagattaagcatatgctgcgtgccggtcaggtgcagggcttcgtcgcgggcaatcagtttgatgattttggcgttgccttccatcaactcgcgctcggcaaaagcaaacgagcaggcgaatgaaacgtagaaacggatggcttccaacacgttgacgcacatcaggcagagatagagttttttcttcaacccgcgcaaagacacggtaacgggtttgccgccgacattgtgcaccccttcgcccaacaggttgtaatactgggtgtattcgattaagtcatcgtaatagcaggcaatgtcttcggcgcgggcggtaatgtattcgttttcgacaatatcatcaaacacgaccgacggatcattcacaatattgcggatgatgtgggtatagctgcgcgagtgtatggtttcgctgaagctccacgtttcaatccacgtttccaactcgggaatcgaaaccaaaggcagcaaggcaacattcggactgcgcccttggatggaatcgagcagtgtttggtatttcagattgctgatgaaaatatgtttttcgtgttcgggcagattggcgtagtcgatacggtcgcgcgagacatcgatttcttcaggccgccagaagaaagacaattgtttttcaatcagtttttcaaatacttcgtatttctgctggtcataacgggcaacattaaccggctgaccaaaaaacatcggctcattcagcgcgtcgtttttggttttgggaaaggtgctgtatgacatagttaagtgttcgcaggacataatctattctctatattaattaaaaatgatctgtaagttttaactaacctgctgagactttatatatttaataaaattttctaaagttaaaacatgggttttcccaaaagttccaaatgtttttacggattctttagggacaactaaggttaaattctcatcactcatttcctgaatttgagtatcagatataccttcttgtagagtaaataaatgcttatgaggaattcgatctgcttcatttaaaacttggcgccagcgatccttacaagtagtctttgaacctagcattgtcagcttttcagtttgaaatatgaaattccctgattcatccatcgcatggtactcttcacttccaggaaataaaaaatctggtttctttttcccttctgtcttcgcttgcgtctcaaattttaaggaaaattcgtcaaatattcttgataaatgtaactctaaagattttcctgctcttgcttttctgcgatttgtaaaagaatgtgcaaaattaatgaagctatccaaatcagtaatttttgatttaataatttcaaattcacgtttttcaaaaatggaaaataattcatattcctttgaaacccattgttttaacacattactaacgttagttttatttaatgcaatattttcccttgccaaaactgccatttcttcagttttggggaagttaggaaatagtgaaaataattttgttaggttatcctctacttcttgttttttaggtaaatataaacttcctggtaaaatgttagtttctgcgataaatatttcaatatcttcatctgaagataaaacaaaagcatggaataataaatctttataacaagctctgcacaataccaataaggaaccactatatttatcacttaaaaattcaaaattcttgccaaaacccgtaattctcgcctcatttctcgtgccttggccgtaatatttaaaattgctattagtgacgcttccatcttgccaattaattttgattgaaatagttttatttgttcccttttggcaaactacatcaaagaggtcgtctgaaaaatgtttttgaatataaaatcctgattggtgactaccagtagtaccaacatcattgggacgaatataacgacagtatactgcaattgatttatttgctgtctgtattgctgaagctactaagtcatcggatttatttactacttgtattgtctgagctgccaagtcattcattttttaactcatttataatttgtttagcaatagcttgaaccaacggtacagcaattgaattgccaaactgcttgtatgcagctgtcttggatactgcatcaataacaaaatctttaggaaatcccattaaacgcgagcactccctaggtgtcagcttcctaggattttttcctttctgagggatgagtatttcggaaccatctttgtaatatcgtgcagatagagttcgtgatattccatctaaatcaactaatccaaaaccaaatccattaccctttgccttatgttttttagcgtaattttgaaggtaaagccataagttatcagaaagagtaaaagaattatctacatcatcttccaaaatttgctttaattttggttgtgattctggtggggaaggaaaattgaaatttatttccttattaaaatattgtctatcaaaacctacaataaaaatacgctccctattttgaggaacataatattttgcattcataacttgataaaatatctgatagtcaagctcttctaaagtccctttaattactttaaatgtatttcctttgtcatgcgaaacaaggtttttcacattctctaaaagaaaaattttaggtcgatgttttccaataatttcagcaacatcaaaaaatagagttccctgcgccttatctaagaagcctgtttctcgtcctaggctttttttctttgaaacaccagctatagagaatggctgacacgggaatcctgctgttaatacatcaaacttacttggaatagctgctttggtttcctttaatgtaatatctccataaggaatatcattaaaatttacttggtaggtttgacgggctttatcatcccattcactagaaaatacacatcgcccaccaacattctccattgcaatgcgaaaaccacctattcccgcaaataaatcaataaaagtaaatttctcattatttaaggtaactatattatctaattgattttgtattttatttttcatattttatatttcagatgatttattaatctaaaggccatctgaaaactccccctttcatcaaatcttacaagccccgcccgcgcagccgtcatcctgaatatcggtctgcgtatcgtccgcaccgtcgcgggtgttatggtagtacagggttttgacgccgtatttgtaggcggtcagcaggtctttgagcatttgtttcatagaaactttgccgccttcgaatttgcccgggtcgtaggcggtattggcggaaatcgattgatcgacgaatttttgcatcacgccgacaagtttcaggtagccttcgttgccgggaagctgccacagggtttcataggcatttttcagggtttcaaactccggcacgacttgtttcaaaatgccgtctttcgatgctttgaccgttaccaatccgcgcggcggctcgatgccgttggtggcgttggcgatttgagagctggtttcagacggcatgagcgcggtcagagtagagttgcgcaggccgtatttgacgatttcggcacgcaggctttcccagtcgtaatgcaaaggctcgccgcagacggcatccaaatcttttttgtaagtgtcgatgggcagtttgccttgcgaataaacggtttggttaaagagcgtgcacgcaccgtattctttggcaaggtttgccgatgctttgagcaggtaatactgtatggcttcaaaggtacggtgggtcagaccgagcgcggaaccgtcgctgtagcggacaccgtttttcgccagataataagcatagttaatcacgccgatgccgagcgaacggcggcccatagtagaggtacgcgcggcttctaccggatatccctgataatctaaaagtgcatcgagcgcacgaacggtcaagtcggcaagcccttccaattcgtccaagctgtttaatgcgcccaagttaaaggcagacagtgtacacagggcgatttcgccgttcggatcgttgatattgtccagcggtttggtcggcagggcgatttccatacacaagttggactgatgaacaggcgcgacgcgcggatcgaacgggctgtgcgtattgcagtgatcgacgttttgaatgtagatgcgcccggttccggcacgctcctgcatcagcgtggaaaacaggtcggcagccggaatgatgcgcttgcggatatcagggtcttgctcgtatttcgtatagagccgctcaaattcgtcttggtcggcaaaaaacgcttcgtacaatcccggaacctcgttgggcgaaaacagcgtaatgttgccgcccttaatcaggcgggtgtacagcaggcggttgatttgcacgccgtaatcaagctgacggatacggttgtcttccacaccgcggttgtttttcaacaccagcaggctttcggcttcgatatgccacaaggggtagaacaaggttgccgcgccgccgcgcacgccgccttgcgaacaggatttgaccgccgcctgaaacattttaaagaagggaatgcagccggtatgccgcgcttcgccgccccggatttcgctgtccaaaccgcggatacgtccggcattgatgccgatgcccgcacgctgggaaacgtatttcacaatcgcgctggtagtggcattgatggaatccaaactatcgtcgcattcaatcagcacacagcttgagaactggcgcgtaggcgtacgcacgccgctcataatcggagtcggcagcgatactttaaatgtagaaacggcatcgtaaaaccgtttgacgtaacccaagcgcgcctctttcgggtatttgctgaaaaggcacatcgccaccaaaacatataaaaactgcggcgtttcgtaaatttggcgggtaacgcggttctgtaccagatatttgccttcgagctgtttgacagcggcataggaaaaggacatatcgcgttcgtggtcgatataggcgttcagttcgtcaaattcttcgcggctgtaatcctcaaggatatgcctgtcgtattttccggcatcggtaagttttttaacgtggtcgtaaaggtgcggcggctcgtactcgccgtaggctattttacgaagatggaaaatcgccaaacgcgcggcaaggtattggtagtccggggtatcttccgaaattaaatcggcagcggctttgatgatggtttcgtggatgtcgtcggtgcggatgccgttgtagaactggatgtgcgatttcaactcgacctgcgacacggaaacattttccaatccgtccgccgcccaagtgacgacacggtgaatcttatccaaatcaatggcttctaatcttccgtctcgtttggttactttcaaatcagtcggtgtattcatcgcttcctcttccactcttgatattcaagacacagtcttttcaaataaattaaggcagacaatatagtggatttttggcattttctccagtcttgacaacggttgtatttttcagtttcaggcaatgcgcgataaaacccgcctgtcgtatttttcctataatatttgttttatctgataattctttaccgataaaaaacgggtaaattttttgccttttgaccggctccggctacaaggcggtgaaataaggattttccgacgaaaaaggaaagcttcctgttttctgcccctgcaaattgttaaattttgcaaagtatgattttgccgcgccgccgccgacaaattccattttcttaccgattggaatttattattgagattaatgtgttatttgaatctgcatatcaaacggcaagttttgtcggctgaatgagtctgaaactgccgacaatttgcccgttccatccttccatcctatactggaaagaatgacaaactgaaaggatcgtcatgtctgtcaaaaagatgcttgccatactgttgtctgcaatattgggactggtatcgacaactgccgctgccggtacgtcagaacccgcccaccgcgataccaaacatatccgcaaggcaaacaagcagatgctgcaccccgaatgcaggaaatatttggaacgccgtgccgcgtggtaccgatcgcaaggcaacgtgcaggaattgcgcgaaaacaaaaaggcgcgcaaagcattccgctccctgccttatgcggaacagaaaatccaatgccgggcggcttatgaggctttcgatgatttcgacggcggcagtttccgccgttaatcccatataaaatatgccgtctgaacacaggttcagacggcattttccatagatacaacaaactatccttacgccatttcgtttgaggtcctcccgttgccgcagccttaatatagtggattaacaaaaatcaggacaaggcgacgaagccgcagacagtacagatagtacgaaaccgattcacttggtgcttcagcaccttagagaatcgttctctttgagctaaggcgaggcaacgctgtactggtttttgttaatccactatacatccacaaaagcgaatcatactgccacattccgacaaccggtttcagacagcgatatccgcatcgtcggcgacaacggcacggatgctttcttcgattttatcttttaaagcataacggtcttcgctttccgccgcatccgccacgcaaacgaaatcgactcttatcgtcaattttttcatagacacgatgcgccacaggcaggtcggcaaaccgacatcggcatatgagggacgagccgtcctttttcccgtttcgtcataataacgcagcgcgaccgccaaaacctttgcccccgcatcgatggcggattggaacagcgcggctttgaacggcaaaagccccaatccggaggaagtccgcgcttcggggaaaaaactgacgttttgaccgcgttgcaaggtttcgcagacggcgcggttaatcggttcgatgtcgcgccgcgaattgcggttgatgaacaccgttcccgcgttctgccccatcttgcccaataccggccagcttttgatttcctgcttggcgataaagctgctcggataaaccgcgctcatcgcgaaaatatccagccaggacacgtggttggcggcaaccaagacaccgttcggatgttcgggtgcgggtctgcccacctccaatccgatatccaaagccgccaaaacccccctgcccaactcgattaccgcccgattgcgcgactcggggcaaccgccgtcaataccgcgcaggtttttcccggttttgaacagccagaccgccaaacggcacaagcggcgcagacgtgtaaaaaatgaagctttatttgaagacatgagcaattctttcccgataatcggtgtttgttgttgaaacgttcggacggcataccgataaaatgccgtctgaaaccgttttcagtcctatttctgacagttcgggcaataaaacgtgccgcgctgccccaaagtttctttcacaaccaaaccgccgcaccgggggcacggctgattgtgccgcccgtacactgtatattcctgttggaagtagccgcttttgccgtcgctgtccacaaaatccctcaaggtactgccgcccgtttcaatggcgcgctgcaacaccgctttgacggtttcaaccaaaagcgcgcactctttctttttcaggcggttggcaggacggtggggcgaaatgcccgctctgaacaggctctcgttggcataaatgttgcccacaccgaccacgaccgcattgtccatcagggcaagtttgaccgcgcgcttctgcgccttcagccttgcatacagataatccgcacaaaatgcctccgacaaaggctccggccccagtttttccaacagcggatgatgttcttcgattccctcataccaaagtatcgcgccgaactttctcggatcgcggtaacgcatgaccgtgccgtctgaaaacacaatatcgacgtgatcgtgtctgtccggcctgccgatacgtccgtccgacggcgtaaaaatccgcaagctgcccgacatccccaagtgaatcagcagcacgcccgtttgaaagcggataagcaggtatttcgccctcctgccgcaggacaacacctgccggccggacaaaatctcccccaaatcgggattaatctgccagcgcagcttcaattggcgcaataccacggcttccaccgttttcccttcaatatgcggcgcgatgccgcgcaacgtcgtttccacttccggcaattcaggcataacccctcccgacatttcttctgacagatgccgtctgaaagacggctgtccctaatccgcaacccttgccgcacccgccgcaagggctttgccgcccaaatacccgtcccacgcgggcaggggcgttacgcccgctgcccttttgaccaaaaccaaaccgtacactgcggcacactgcggccaccaacggtcgcccgccttttccataaaccgccaaaagcgtatttgcccgagcgacgaaaccggcggcagatacaccataaatttcccaaattcaatatcgaaaccgacatccgcaagccgtcttttcaactcgggcagcggcagacaaaaccgtttttccggcaggcgttcgccgtcaaaccaacggctgaatccccagagcgaatacggattgaaacccgtcagcatcaagcgtccgcacggtttcaatatccggtgcgcttccgacaggatttgcgaaggaacaccgccttcaagcgtatgcggaaaaagcagcatatccgcagaaacatccgccaaagccatattctccgccgacatcgacatatctcgcggcacacagacaacatcttcagacaggctcagccacggaccgcccacctgaaccgcacacattcccgaaaaacggtatgaatccagataccgcccgaagaaatcctgttccaattttgcaacataccgccccatcgccgtatcttcaaaccatgcatccatattgcgtccgtttcaaacagattgcctgccgatattctattccaaacaggatttctgtcaaaaaacacatcggccgcccatttccgaatccgcataaagttcctgtaaaacttgacgctttttcagtcaaacagtaccatcggacgataaaatatgtttattccgccgaatataaatcatgtccaaactcaaaaccatcgctctgaccgcatcaggtctgtccgtttgtccgggtttcctatacgcccaaaacacctcatcacaccaaatcggtttggcgattatgcgcttaaactcttcaatactcgacctgcccccgacaaaacaatatttccaatccggcagcctgtggggcgagctgcgccaaggcttccggatgggcgaagtcaatcccgaactggtacgccgccacgaaagcaaattcatcgcaagccacagctatttcaacagggtcatcaaccggagtagaccctatatgtaccatatcgccaacgaagtcaaaaaacgcaatatgcccgccgaagccgccctgcttcccttcatcgaaagcgcgttcgtcaccaaagccaaatcacacgtcggcgcatcaggattatggcagtttatgcccgctaccggcaggcattacggcctggaaaaaacaccggtttacgacggcaggcacgacgtttacgccgccaccgatgccgcactcaactatctgcaatacctctatggactgttcggcgactggccgcttgcctttgccgcctacaactggggtgaaggcaacgtcggacgcgccatcaaccgcgcccgcgcccaagggctcgaaccgacctacgaaaacctgcgtatgcccaacgaaacgcgcaactatgtccccaagctgctcgccgtgcgcaacattattgccactccccaatctttcggcatgaatatcagcgacatagacaacaaaccctattttcaggcagtcgaaccggatcgtccgctcgacaacgaagccatcgcccggcttgccggcatcacgcaaagcgagctgctcgccctaaaccccgcattcaacgtccccgcgtttatccccaaaagcaaacgcaaactgctgcttcctgtcgcgtccgtacaaaccttccaaagcaactacctcaacgccgcacccgacagcctgttttcatgggaagtctatacgcctgccgccaaaaccagcctgtccgacatctcgacggcaaccggcatgagcattgccgacatcaaacgcctcaacaacctgaacggcaaccttgtcaacgcaggacgcagcatccttgtcgccaagaacggcaaaacccttcagacggcatcggaatccgtcgtttccatcgacatcgacaatacgcccgacacctaccgttccaatatgccggcaggcacggtgaacgtcggcattgcccgaatccgacccgccgccgcacagacagcggacattaccgtcgcacctttgccgcagaaaaccgtccgtacggaacccgatccccttgtccgtattgccgaacctgcccttgcgacagccgcagcgcaacctcaaaccgaaaaacagaccgccatgccgtctgaaacccaaaccgcaacactcgcgcagatcatcccccaaaacgacatgcaggcggcagacgaactcatgcagcttgttgcccgaaacaacctgcgccgacaggctgaagaaaccatctccgccgtcatcggcacgcctgacacagttgccgaacacaaaatttccgcatctccgcaacataccgctgccgccgacggcaaacgccgggtacgtttggaaacgcgcgtagccaaagctgccgacggcgaagccgaaatctccccgctccatgccagcatccaccgcgttgtagaaggcgacaccctgttcaacattgccaaacgctacaacgtcagtgtagccgacctgattgtcgccaacaacatcaaaggcaacaccatccaaaaaggacaggtactccgcctggcgcaggcagcccctgcccaaacccgtattgaaaaagtatcctacaccgcgcgcaaaggcgacaccttcaaaagtatcgccgcgcgcttcaatatccatatcgacgacatccgccggctcaatcccaacctgaacaccatcaatccgggacagagggtcaaactgattggaagctgattcggatacggcacatgacaggactttctcagtcctgtctttttcatcccacatttcccataccatcatgaaacttatcaaatacctgcaatatcaaggcataggaagccgcaagcagtgccaatggctgattgccggcggttatgttttcatcaacggaacctgcatggacgacaccgatgcagacatcgattcctcatccgtcgaaacgttggatattgacggggaagcagtaaccgtcgttcccgaaccctatttctacatcatgctcaacaagcctgaagattacgaaacttcgcacaaacccaagcactaccgcagcgtattcagcctgttccccgacaatatgcggaacatcgatatgcaggcggtcggcaggctggatgcagatacgaccggcgtattgctgattaccaacgacggcaaactgaaccacagcctgacttcgccgagcagaaaaattcccaagctgtacgaagtaacgctcaaacaccccacaggagaaacgctctgcgaaaccttgaaaaacggcgtgctgctccacgacgaaaacgaaaccgtttgtgccgccgatgccgttttgaaaaacccgaccaccctgctgctgaccattaccgaaggaaaataccaccaagtcaaacgcatgatcgccgccgccggcaaccgcgtgcaacaccttcatcgccggcgattcgcacatctggaaacagaaaacctcaaacccggggaatggaaatttatcgaatgtccaaaattctgaaataacatccaagaattccatttatattcatccacatactcattaaatatatggtttaacccaatttaacgcaaaaaatcaatttacgatataatccatttgtctgagtaacgcctgttcaagcaggcttatgagtaagacgttttccccgtaatgtgttttgccatctatacttctccccttgtatagatggtttttttatagtggattaaatttaaaccagtacagcgttgcctcgccttgccgtactatttgtactgtctgcggcttcgtcgccttgtcctgatttttgttaatccactatatttcaaattccctctctttcatcattatttaaatgctatcattaatataattaacaaaatttcatttccatacaccgatgtagaagaataacaaattaatctatttataaactccgattcttcctcatcgggttatactcatcagaaatactcactgaaatatatgccttttacatggaaaatcactagacagttgaaaagcaatcagtcagttcctgttaaaaaacgcgtgtagaatttccgctttatctcaatcggacacggtttcaatatgtcttccccttcaaataccaatcgtcaaacctggtccagccgattaacctatatcctgaccgttgccggcgcgactgtcggtttcggcgcgacgtggcgtttcccgtatttggtcggtgaaaacggtggtgcgcgtatgtgtttttattctgtatcgcgatgctggttatcggcatcccgatgattttggtggaaaatgtcatcggacggcgcaaaggcgtgaacgcgctggatgcgttcggcggcccgatgaacggcaaacccattgccaaaatttggaaactggtcggctggatgggctgctcggcgcgttcggcatcatggcttattacatggtactcggcggctgggtaatcagctatatcgttaatattattggaggaaatttgaatatttccagccccgtcgacggtgtggttacaaaaggcttctttgccgaacacattgaaacagcccttgggaaattgcgttttatacgctgctttttgtcgccgtgaaccaatggattttggtcaaaggcgttatcggcggcattgaaaaagcggcaaaatagctgatgccgctgctgtttttgttcctaatcgcgatggtcgtccgcaacgttacccttccgggcgcaatggaaggggttgctttctatctgaaacctgatttcagcaagattaccgccgaactgttcgtcttcgttttggggcaggtattttttgccctgagcttgggtttcggcgtgatgattaccttgtccagctatttggataaaaacgaaaatctggttcagacggcagttatcacggcaattaccaataccatcatcgccatacttgcgggctttatgattttcccgtcgctcttcagcttcggcgttgcccccgattccggcccgactttggtgttccaaagcttgccgattgtgttctcacatatgtgggcgggatctgtgttcgccgtgattttcttctcgctgctcctgattgccgcgttgacaacttcgctgaccatttatgaagtgttgattacgaccattcaggaaaaaaccaaaatccgccgtaccgccgcgattacgattgtattggctgccatcttcattttcggcaacatcccgtccattctgagctatggtccgtggaaagacgttccgtgttcggcaaaaatattttcgatgccttcgactacatcagcggcaacatcttgtttatgctgaccgcgctcggttccgcgctgtttgccggttttgtgatgaaggacgaagcgaaggacgaattgctttataaaggcaaccatacgacggtcaatatttggtttgcttatgtgaaatatcttgtgccgctggtgattctgctgattttcgtcagcaacctgttctaatccgcagcaatcgatgccgtctgaaggtcatacctctttcagacagcattgccttgatgcccgccacaatacccgcaacgccgaaatccgaaccggcttgccggcttctgtcggatgtttccgggcaggcggcgttccgtctgcttagacaatcgtcctttaaaacaggtagaatccgccccaacgggaaacacatccttcagacggcaaaacccataccccaaaccatcaggaatcccccttatgaacagacaaaaagtcatcgccatcgacggcccgggcgcatcgggcaaaggcacggttgccgcccgcgttgccgccgcattgggatacgattatctcgataccggcgcactctaccgcctgactgccctatatgcacaaaaacaaggcgtgggatggcacgatgaagaaaacgtttccgaactggcaaaaaaactgcccgccgtattttcaggcagccgcatcctgctcggcggcgaagacgtttcagacggcatccggacagaagccatcggcatgggcgcatccgcagtcgcacagttgcctaaagtccgcgccgccctgctgcaacgccaacgcgattttctgaccgaaaaaggactggttgccgacggacgggacaccggatcggtcgtcttcccccaagccgaacttaaaatcttcctgacggcagaatccaaaatccgtgccgaacgccgcgccaaacaaatcggcatcccctgcgaaggtttggcattcgagcgcatcctgtccgacatcgaagccagagacgaggcagaccgaaaccgcaaagttgcccccctgaaacaacagcccgatgccctgcttttggacacaagccgcctgactatagaagaaactgtaaaaaaagtgcttgattggtatcgtgaagtttaaattttcaggtataatcgcacaaattacgtttcagacggcataaaaatcccccatatgccgtctgaaaccttatgtacccgtctgccctgccaaggacggcagatatccaccaacccaccccgcaccccttggcggtgtaccgaaaagagttatatatgtctatggaaaattttgctcagctgttggaagaaagctttaccctgcaagaaatgaacccgggtgaggtgattaccgctgaagtagtggcaatcgaccaaaacttcgttaccgtaaacgcaggtctgaaatcagaatccctgattgatgtagctgaattcaaaaacgctcaaggcgaaattgaagttaaagtcggcgacttcgttaccgttaccatcgaatccgtcgaaaacggcttcggcgaaaccaaactgtcccgcgaaaaagccaaacgtgcagccgattggattgccctggaagaagccatggaaaacggcgacatcctgtccggcatcatcaacggaaaagtcaaaggcggcctgaccgttatgattagcagcatccgcgcattcctgccgggttctttggtcgacgtacgtcctgtaaaagacacttctcacttcgaaggcaaagagatcgaattcaaagtgatcaaactggacaaaaaacgcaacaacgtcgttgtttcccgccgcgccgttctggaagccactttgggtgaagaacgcaaagccctgctggaaaacctgcaagaaggctccgtcatcaaaggcatcgttaaaaacattaccgattacggtgcattcgttgacttgggcggcatcgacggtctgttgcacatcaccgatttggcatggcggcgcgtgaaacacccgagtgaagtcttggaagtcggtcaggaagttgaagccaaagtattgaaattcgaccaagaaaaacaacgcgtttccttgggtatgaaacaactgggcgaagatccttggagcggtctgacccgccgttatcctcaaggcacccgcctgttcggcaaagtatccaacctgaccgactacggcgcattcgtcgaaatcgaacaaggcatcgaaggtttggtacacgtctccgaaatggactggaccaacaaaaacgtacacccgagcaaagtcgtacaactgggcgacgaagtcgaagtcatgattttggaaatcgacgaaggccgccgccgtatctctttgggtatgaaacaatgccaagccaatccttgggaagaatttgccgccaaccacaacaaaggcgacaaaatctccggcgcggttaaatccattaccgatttcggcgtattcgtcggcctgcccggcggcatcgacggtttggttcacctgtccgacctgtcctggaccgaatccggcgaagaagccgtacgcaaatacaaaaaaggcgaagaagtcgaagccgtcgtattggcaatcgacgtggaaaaagaacgcatctccttgggtatcaaacaactggaaggcgatccgttcggcaacttcatcagcgtgaacgacaaaggttctttggttaaaggttccgtgaaatctgttgacgccaaaggtgctgttatcgccctgtctgacgaagtagaaggctacctgcctgcttccgaatttgcagccgaccgcgttgaagatttgaccaccaaactgaaagaaggcgacgaagttgaagccgtcatcgttaccgttgaccgcaaaaaccgcagcatcaaactttccgttaaagccaaagatgccaaagaaagccgcgaagcactgaactccgtcaatgccgccgccaatgcgaatgccggcaccaccagcttgggcgacctgctgaaagccaaactctccggcgaacaagaataaggttgcagacatgacaaagtctgagttaatggttcgtttggcagaagtgtttgccgccaaaaacggcacgcatcttctggcaaaagacgtagagtacagcgtaaaagtcttggttgacaccatgactagatcgcttgcccgaggtcaacgcatcgaaatccgcggtttcggcagcttcgatttgaaccatcgtcctgcccgcatcggtcgcaatcccaaaaccggcgagcgtgtggaagtacctgaaaaacatgtaccccacttcaagcccggtaaagaattgcgcgagcgggtcgacttggctttaaaagaaaatgccaattaaaccttagcatcaaaacgccgctgttacgcggcgttttttctgtggtttaacttcatccgttgcttcaataccttgagccaagcaagcaacggattagagcgtggatttttttatagtggattaacaaaaaccagtacggcgttgcctcgccttagctcaaagagaacaattctctaaggtgctgaagcaccaagtgaatcggttccgtactatttacactgtctgcggcttcgtcgccttgtcctgatttttgttaatccactatatcattgcttacaatccgctttttaaacaacaaatttttgatttctattacgaacaggacaaaaatcctgcttattgcactaaaactaagccgtttcaggaatttgcggcaaatttacagcttttaccgagcctaatgctttcgctttttggtaaaacgccaatttgtattcaagcaaatctaaatagcgttttaattcggcaatttgacacttcacattttctatttgattttcaaacaaggaaaggcgttcttcaatggtatcgtcgccaatgacggtacattccgcaaagcgtttgatgtcttttaagctcattcccgtatttttcaagcattgcaataagcccaaccattgcaaatcgttatcggtaaaacagcggttaccgtattcatcacgtccgatattgggcaacaaaccttctttgtcgtaaaaacgtagggtgtgggcggagatgcctattttttcggcggctttggcagtagtataagtcattttccctccttctaaacaaaaacagtaaaaaacacttgctttagagttaactctaaagtgtaaactgttgctatgttgctcaggcaaggcaactttgtcaatgaattaagaggaaagacaatggaaatgaaacaagccgattcaaccatcaaatctcgtgcggcggtggcattcgcccctaaccaacccttacaaattgtggaaatcgacgtagaaatgccgcgtaaaggcgaggtgttaatccgcaatacccacactggcgtgtgccatactgatgcgtttacgttatcaggaagcgatcctgaaggcgtattccctgtggtgcttggacacgaaggtgcgggtgtggtcgttgctgtgggcgaaggtgtgtcaagcgtaaaaccgggtgatcacgtgattccgctttacaccgccgaatgtggcgaatgtgagttttgttgttcaggtaaaaccaacttgtgcgtctcagtgcgtgatacacaaggtaaaggcttaatgccggacggcacgacgcgtttttcttatcaaggtcagccaatctatcactatatgggctgttcgactttcagtgaatactccgttgttgccgaagtttcactggcgaaaatcaaccctgaagccaaccatgaacaagtatgtttgctcggctgcggcgttaccacaggtattggtgcggtacataatacggcaaaagtgcaagaaggcgactctgttgccgtgtttggtttgggggcgattggtttggcggtggtgcaaggtgcgcgtcaagccaaagccggccgcattatcgccattgataccaatccatcaaaatttgagttggcaaaacagttcggtgcaacggattgtttgaacccgaacgattacgataaaccgatcaaagatgtgttgttagacattaataaatggggcattgaccatacctttgaatgtatcggcaatgtaaacgtaatgcgtcaggcattagaaagtgcacatcgtggttggggtcaatccattatcatcggcgtagcaggtgcaggacaagaaatttcaacgcgtccgttccagttggtaacaggtcgtgtttggaaaggttcagcatttggcggtgtgaaaggtcgctctgaactgccgaaaatggtggaagattcaatgaaaggcgacattgagttagaaccgtttgtaacccacacaatgacactcgatcaaatcaataaagcctttgacttaatgcacgaaggtaaatcgatccgcgccgttattcactactaaggtatgcgatgaaactgattgaacaacatcaaatttttggtggttcgcaacaagtttgggcgcatcatgcccaaacgctgcaatgcgaaatgaaatttgccgtctatttgccaaataatccagaaaatcgaccgcttggtgtgatttattggctttccggcttgacgtgtacggaacaaaatttcattaccaagtcaggctttcagcgttatgcggcagaacatcaagtaattgtggtggcccccgataccagccctcgcggagagcaagtgccgaacgatgatgcttacgatttaggacagagtgcaggcttttatttgaatgcgaccgaacagccttgggcggcgaattatcaaatgtatgattacattttgaacgagctgccccgtctgattgagaaacactttcctaccaacggcaaacgttccattatgggacattcaatgggcggacacggcgcattggtattggcgctgcggaatcaggaacgttatcaaagtgtttctgccttttcgcctattttatcgccaagcctcgtgccgtggggagaaaaagcctttactgcttatttagggaaagaccgtgaaaaatggcagcaatatgatgctaactcactcattcaacaaggctataaagtgcaaggtatgcgcatcgatcaaggcttggaagatgagtttttgccgacacaattgcgtaccgaagattttatcgaaacctgccgtgcggcaaaccagccggtcgatgtgcgtttccataaaggctacgatcacagctattacttcatcgccagttttattggcgagcatattgcttatcacgccgcgtttttgaagtaaaccaaagagcgttcagtgttcaaagcagttttgggatagccggcacgagggcggtaagaagtgccggcataaacgtatgccgtctgagccgaaaggagccgactctacggattatagtggattaacaaaaatcaggacaaggcgacgaagccgcagacagtacagatagtacggcaaggcgaggcaacgctgtactggtttaaatttaatctactataaaaggcatttgagctcatatctgcaccatattgaaacgccgcctttgcttatacccccttgtgcgcgtcattattcttttccacggaaaatgccaagtttgaaggaaatcatttataataccgacggtaagcattttctttcttagccgcaagaagtataacaaggttaaatatgagtaatagagaccaactttttaaagccccgccgtttgaaaaccacagcccgctgacctggtatcaggctgcctcacaactgcccaacttcatccgcgacgacgcgcaggcagccgccatcgaacacctcgatcggctttggaccgaattgatgatgttcaaacgcaaaagaaaccgttttttaggcaggagtttgcgttccccgcaagtccccaaagggctttatttctatggcggggtcggacgcggcaaaagctttctgatggacgcttttttcggctgcctcccgtaccgccgcaaacgccgcgtccactttcatgcctttatggcagaaatccaccagcggctgaaaaccctgaaaagcgaaagcaacccgttgaaatccgttgccgccgagattgccaaagaaacccgcgtattgtgttttgacgaatttcatgtcagcgatattgcggatgcaatgattttaggccgtctgctggaaaacctgcttaacgagggcgttgttttggtggcgacttcaaactacgcgccttccgaactctacccgcaaggtcaaaaccggagcagttttcttcccacaatcgcgctcatcgagtccagcctgaccgtcttaaacgttgacggcggtgaagactaccgactgcgtaccctccgccccgccgagattttctttacgcctgccaatgaagaaaatgaggcaaaactggcaaaactgttcaaagaaatgacaggcattaccgatttgaaccccggcatcagcaccatccacggtcgggagattccccacaaagccgagtccggccgtgccatatggtttgatttccgcgcactgtgcttcggcccccgctcacagtccgactatctgtatttggccgaacattatgaaatggtttttatttcaggtttggaacaactctcaccgcaagaaaaggcggaggcgcggcggctgacttggctgattgacgtactctacgatttccgggtcaaactgtgtgccaccggcgcggtagatgtcaaccatatctatacggaaggcgattttgccgaagaatttacccgcaccgccagccggatggtcgaaatgcagtccgaagtttatttggaacagccgcacctgaccctatctcccaaggcttcaggcggataagttatttttttgatagaataccgatttgattcttcttaagtaaaaataaggatatagcatggcgattgaacgtaccatctccatcatcaaacccgatgccgtcggcaaaaatgttatcggcaaaatatacagccgctttgaggagaacggtctgaaaatcgttgccgccaaaatgaagcagcttactctcaaagaggcgcaagaattttatgcggttcataaagaccgccccttctacgccggattggttgaatttatgaccggcggtccggttatgattcaggtattagagggtgaaaacgccgtcctgaaaaaccgcgaactgatgggtgcaactaatccttccgaagccgccgaaggcacgatacgcgcggactttgccacttcggtcagcattaatgccgtacacggttccgacagcgtggaaaatgccgctttggaaattgcctactttttcagccaaaccgaaatctgcccccgttgatacaatacaccgcccaactcctcttcagacggcataaatatatccatgccgtctgaaaactctgttgcaaaaggcttcaaatcaaacttgcctgccctgcaattttttatttgaagccttgatttaagaaaaacacaaacacatgaaaaccaatctgctcaactacgaccttcaagggctgacccgacattttgccgatatgggcgaaaaacctttccgtgccaaacaggttatgcgttggatgcaccaatccggcgcgcaaaattttgacgaaatgaccgatttggcaaaatcgttgcgccataaactgaacgaacaggcaggcatcgaaattcccaagctgatgatgtctcaaaaatcttcagacggcactcgaaaatggcttttggatgtcggtacgggcaacggcgtggaaaccgtcttcatccccgaatcggatcgcggcacgctctgcatttcctcacaagtcggctgcgctttggaatgtacattttgttcgaccggccggcagggcttcaaccgcaatttgactgctgccgaaatcatcgggcaattgtggtgggcaaacaaagcgatgggcgttacaccgaaaaacgagcgcgtgatttccaacgtcgtcatgatgggcatgggcgagccgatggcgaacttcgacaatgtcgttaccgccttaagcatcatgctggacgaccacggctacggtttgagccgccgccgcgtaaccgtttccacttcgggtatggttccccaaatggacaggttgcgcgatgtcatgccggtggctttggcggtttccctccacgcttccaatgacgaagtccgcaaccaaatcgtaccgttgaacaaaaaatatcccttgaaagaattgatggccgcatgccaacgctatctggtcaaagcacccagggatttcatcactttcgaatacgtcatgttggacggaataaacgataaggcgcaacatgcgcgcgaactgatcgaactggtcacagatgttccctgcaagttcaatctgattccgttcaatcccttcccaaactccggatacgaacgctccagcaatgagaacatccgtgtgttccgcgatattttgcagcaggcaggatttgtcgttaccgtacgaaaaacgcgcggcgacgacatcgatgccgcctgcggacagttggcggggcaggttcaggataaaacgcgccgccaacaaaaatggcagcagattttaatcggacaacaggggtaattatgccttttaagccatccaaacgaatctctttattactcgttcttgccttgggcgcgtgcagcacttcctaccgcccctcgcgggcagaaaaagccaatcaggtttccaatatcaaaacccagttggcaatggaatatatgcgcggtcaggactaccgtcaggcgacggcaagtattgaagacgccctgaaatcggaccctaaaaacgagcttgcctggctggtccgtgccgaaatctatcaatacctgaaagttaacgacaaggcgcaggaaagtttccggcaagccctctccatcaaacccgacagtgccgaaatcaacaacaactacggttggttcctatgcggcaggctcaaccgccctgccgaatctatggcatatttcgacaaagctctggccgaccccacctacccgaccccttatattgccaacctgaataaaggcatatgcagcgcaaaacaggggcaattcggattggcggaagcctatttgaaacgttccctcgccgcccagccgcagttcccacccgcatttaaagaactggcgcgcaccaaaatgctggccgggcagttgggcgatgccgattactactttaaaaaataccaaagcagggtagaagtccttcaggccgatgatttgctgctaggctggaaaattgccaaagccctcggcaacgcacaggcggcatacgaatatgaagcacaattgcaggcgaatttcccctactcggaagaattgcaaaccgtcctcaccggtcaataaacagattcaaaccatatgaacacactccaacgccgcaagacgcatcaagtccgcatcgatcatattaccgtcggttcagaagcacccgtcgttatccaatctatgaccaacaccgacactgccgatgcaaaagccaccgcattgcagattaaggaattgagcgatgccggatccgaaatggtgcgtattaccgtcaacagccccgaagccgcgtccaaagttgccgaaatccgccgccgcttggacgatatgggctatgccacaccgcttatcggcgatttccacttcaacggcgaacgcctgttggcggaatttccagaatgcggcaaagcattgtccaaataccgcatcaatcccggcaatgtcggcaaaggcgtaaaaggcgatgaaaaatttgcctttatgattcggactgctgctgaaaacgataaagccgtccgcatcggcgtaaactggggttctttggatcaaagcctcgccaaacgtatgatggatgccaacctcgcttcttccgcgccgaaaccgcccgaagaagtgacgaaggaagcactgattgtctccgctttggaatctgccgaaaaagccgttctattgggactgcccgaagacaaaatcatcctgtcgtgcaaagtcagcgcggttcaggatttgattcaggtttaccgcgaactgggcagccgttgcgcctatccgctgcatttgggtttgaccgaagccggtatgggcagcaaaggcattgtcgcatcaacggcggcattatccgtcttgcttcaagaaggaatcggcgacaccatccgcatttcactgactccggaacctggcagcccgcgtactcaggaggtcgtcgtcgggcaagagattttacagactatgggattgcgttcgtttacgccgatggttaccgcctgccccggctgcgggcgtaccaccagtaccgtatttcaagagctggcacaagatgttcaaaattacctgcgccaaaaaatgtctatatggcgtaccctttatcctggggttgaatccctgaacgttgccgtaatgggctgcgttgtcaatgggcccggagaaagcaaattggccgacatcggcatcagcctgcccggtacgggagaaacacccgttgcccctgtttatgtagatggtgaacgtaaagtaacgctgaaaggcgacaacattgcaacggaatttctggctattgttgaagagtatgtcaaaaccaattatggggagaacggactcaaacgccatcaagggaaggttatcccgatacactccctataaaatccaaccgccagcctaccttggctatttttaaataaaaaccgtttattttcattgatataaaacccatcccattggaaaaggcatttttttaaaccgataaggaatggaggcgcaatatgaaaatacaatcggcaaatacggagatgaattgcaggtataaataaggaaggcgggataccgcttcctgcccttgtcttttctcaataaccgtaccggcagattcaggaggatgcgagtgtcgcgcccttgcaaaaactgctgccccatttggctttcagacggcatccgtccatcacaggcgggaacggggatcctttaaaaaactccaaatccttcttccgtcccgtggatgacggtatcgataccatatcaaacgcagcttgaaacaaatgccgtctgaacgtttcagacggcatcggtttctctcaggtttcttttattaaagccgcaaagaagcgcggttttccaaaatctggtcaatcaaaccatattctttggcttcttcggcagacatgaaattatcacggtcggtgtcgcgttccaaatctgccaaatcgcggtcgcaatgtttcgccatcaggcggttgagtttttctttgatttttaaaagttcgcgtgcgtgaatttcaatgtcggatgcctgaccgcccagaccgccgctgattaaaggctggtgaatcataatccggctgttgggtagggcaaaacgtttgcctttctcgcctgccgacaataagaacgcgcccatacttgccgcctgccccaagcacaaagtcgatacatcgggcttgatgaaattcatggtgtcgtaaatcgacataccggccgttaccgaaccgcccggcgagttaatatagaagaaaatatccttatccggattctcactttccaaaaacaacagttgggcaaccaccagattggcggactcgtcggttaccggtccgaccaagaatacgatgcgctctttcaaaagccgggaatagatatcgaatgcacgctcaccgcgaccgctctgctcgataacggtagggacaagatagttatcaaaagacatttcgtctcctttcatgatggaaaagcaccaaagcgagctttaaaagcggcttcggtgctttcaaaaactgccttcagacggcattttcaggataatcaggcttgcgcgcccatcacttcgtcaaaagacaaagctttttcatttactttggctttgcccaaaacgaaatcaacgacgttgctttctaccgccaaagaagtcggggcttgcaggcgggaaggatctgcgtagtaccagtcaatcacttcttgaggatcttcgtagctttctgcaaagttggcaacaacggctttgatttgctcttcagtcggttccagtttgttttcgtcaaccagtttggctaaaatcagacctaaagatacgcggcgttcggcttgttctttgaacatatccaaaggcagatccaagttggcagcatcagccataccttggttaacaaaattttgtttcatttcgtttgccaagcgtgcggcttcttcattgaccaaagcaacaggtgctttcagctctacggctttgagcagcgcgttcattacggattctttggtttgttcgtttacgcggcgttccacttcgcggcttacgtttttctgcacttcttcgcgcattttggcaacgtcgccatccgcaatacccaaggcttttgcaaaatctgcatcgacttcaggcagagtcgcttcggaaacgttgttcagcgtaatggtaaacacggcagttttaccggcaacgtctttaccgtggtagtcttcagggaaattgacggtaacgtctttactttcgccagccttcatgccgactacgccggcttcaaattcaggcagcatttgacttgcgcccaatacgaaggcgtagtttttggatgcgccgccggcaaaaggttcgccgtcgattttgccttcaaagtcaatgatgacgcggtcgccgtttcgggcttcgcgttcgacatggttgaagcgggtgcgttgtttgcgcaggatttctacggtttggtccacttcggcatcaccgacggaagcggttactttttcaacttcttgtgcagacaaatcgccgataacgacttcggggaacacttcaaaaatggcggcaactttgaaagactctttatcgtcttgttcttcaacgccttcaaaacgggggaagcctgccactttcaactcttgggcaacggcaacatcgtagaagcggcgttgcaccagctcgttgatcacgtcgttttgtgcgctcgcaccgtacatttgggcaatcatttttaaaggtgctttacccggacggaaaccgtcgatttttgcacggcgttgggtttgtttcagttttttatcggtttctgcgttgatttcggaccaaggcagggacaacactactttgcgttccagattttctaaagtttcaacagttacgctcatcataagcccttaaatttgttgtgttgataaaatgataaactttcttccctacatggggaagcaaacagcgcaacggtacgatatttgaaccgcattgccgcaaaggggaaattttagctggcaagtatatcacaatgtttcgcctgaaacataatatgccgtctgaaacgccaattccgccgttcagacggcattttgcaatacgggctacaaatggtccttgtgcgccaaaattttacggctgccgttgaggtcggtggaagaaacgacacccgcattttccagtgcctccatcaggtttgccgcgcggttatagccgatgcgcagctgccgctgcaaagacgaaatggaggtttttttgctttccaaaacataggcgactgcctgatcgaacaattcgtcgctgtctgcattcggattaacgatattggcagtttccagcgcggcctcgccgctgagcagaccttcaatatagtcggctggggcttgcgatttgacatagttgacgacttgatgtacttcgtcgtctgaaacaaacgcgccttgcaggcgagtcggttcggcactgccgggctggaggaacagcgaatcgccatatttgagcagttcgtccgcgcccatttggtcgaggatggtacggctgtcgattttgctttgcacggtaaacgccatacgcgtcgggatgttggctttaatcaggccggtaacgacatcgacactgggacgttgggtggcgacaatcatatggataccggcggcgcgcgctttttgggcgagacgggcgatttgctgctcgacggctttgcgttcggtcatcatcaggtcggcaagttcgtcgataacgaccacaatcaacggcagtttttccagcggctcgggctcgtcggggttcaggctgaacggattgagcagcggcttgcctgccgcttttgcggcttcgactttttggttgaagccctccaaattacgcacaccggcatgggaaagcaggcggtagcgtttttccatttcggcgacgcaccagttcaacgcctgccctgcttcgcgcatatcggtcacgacgggacagagcaggtgcggaataccgtcgtaaatgctcaactcgagcattttcgggtctatcataatgaagcggacttcgtcgggcgtagctttgaaaagcatagacataatcatgccgttcacgccgacggacttgcccgaaccagtcataccggcgaccaaaaggtgcggcattttcgccaagtcgccgacaacgggggtaccggcaatgtctttgcccagcgcgacggtcagcttggatttggcttcggcaaacacgggcgaggacaagatttcactcaacatcacgtcttggcgtttgtcgttgggcaactcgatgcccatcgtgtttttacctgcgatggtttcgacgatacgcacggactgcagcgacatagagcgtgccaaatctttcgacaaggcaacaatttggctgcctttaacaccttgcgcgggttcgatttcgtagcgcgtgatgacggggccggatgtggcggatacgacttgtacgccgatgccgaattctgccagtttggattcgatcagttcggcagtgcgctccaattcggcgggattgatgctgacgggttcgctgtcaggaatccgcaataggttcaatgtaggcttgtggtattcgcccgcctgccgaggttcgtcatcttcaaacagagaaacctgaattttgggcggcggcgcgacggaaaccgcgacggatttgcggttgctgctgctgccttcgggcaaggcaacgggtttggccgtaatattcttggcttcttttaccatgcgccgtgtattttgggtatcgacaccgtctgttttggtattcggccggcgttttcctaaagccatgaccttgccggataaggcactcaggcggttttgaaccgccctgcccgcaccgttcaaaaattccagccatgaaatctgcaccagcagggacaacgacaacagcagaacaaccaagataatcagcaggctgcccgatttccccagcagccacgcaaacactgcgccgacgcgtatgccgaccataccgcctgctccgacaggcagggagtcggcatattttccgcccagcacaaaatactccaagacggggctgaagaccgtcaggacaaacagcgcggcggcagcgattttgtggttgtatgcctcgttttccgtctgttttgcgtgcaggcggaaatttttatacagcacgacgcaggcagccgctatccaccaccagaacgaccagccgaaaagataatagccgacatcggcaacatacgcgccgaacagtccgccccaattggcgacatcttccacaaccggcgaactgtgcgaccaagacggatcgcccatatcgaaactgatcagggaaatcgccaaatacagggttgccgccaaacccatcagccacagtgcgtcgccgataaggttgacgacatgttcgggacgcgcctttttggtttcggttttctgcaactctttgaccgccttgagccgctcggaaactttattgccccgtgcgccgttgtcggctttcttgttgcgtgcggacgttggggacgggcttcccgccctgccttttgctgtttttttatgggatttttctgtcatgccgtattaccggaaaatgccgtctgaaataaggaagccggacggcttgcggattgaatatggaaagtgtcggattatactccatttctcctgctttcatcctgcaacagacagacattgcctttcagacggcatatctgttgcccgacgtatgtatttttacgcagaccctcggcaaaccagtataatccgtgccgtttgaaccgattgaaagaagatggtatgaaccaactgaaacttgccgtttccggtgcacagattttatttgtggcattcggcgcaatggtgctggttcccctgctgaccggtctgaatccggctcttgcgcttttgggcgcaggcttgggaacgctgctgttccaaatcacaaccaaacgcaaagtgccgatttttcttggttcttcgtttgcctttatcgcaccgattatctactccgtcggcgaatgggggctgccttccaccatgttcggactgtttgccgccggctttatgtattttgtgtttgccgcgctgatccgttggcgcggactggcagcggtacacaaactgctgcctccggtcgtcatcggccccgtcatcatggtcatcggtctgtctgttgccgtggcggcaagcagcatggcaatgggtcaggcggacggcaaacaggtcatcgactataccgattcgctgattctttccggctttacctttgccgttaccgccatcgtatcggttttcggcagcaggatgatgaagctgattcccatcttgatcggtgtcgcttcgggttatgttttggcactgctgatgggactggtggacacggcaagcattgcacacgcgccctggttcgccgttccccattttgaaacgcctcagatcaactggcaggctgcactgtttatgctgcccgttgccgtcgcccccgccatcgaacacatcggcggcatcatggcaatcggcaatgtgacggggaaagactatacgaaagacccgggcttggacaaaacccttgcaggcgacggtttgggcgtatgcgttgcgggtctgatcggcggcccgccggttacgacctacggcgaagtaacgggtgcggtgatgattaccaaaaacagcaaccccgtcatcatgacttgggcggcggtttttgccgtctgcatggcgtttttcggcaaattcaatgcgtttttggcttccattccgatgccagtaatgggcggcattatgctgctgctgttcggcacgattgcttctttgggcgtgaaaacgctgattgatgccaaagtcgatttgatgctgccgaaaaacctggtcatcgtcagctcggtactgaccacgggcatcggcggcatgacgctcaaattgggcagcttcagctttgccggcgtgggcttgtgcgccgtacttgccattatgttgaacagcctgctgcccgatccgaaagaatcctgaccgtcgatatagaaatgccgtctgaacatctttcagacggcattttccgttttatttgagattttgaatcaaagagcgcacagttccgccgtaataagaagaagatgtgcaatacactgtttccaagccgcattgtccctgtacgccgtattttttgatgcactggttgagtgcgacctgatgaacgctcgtaaaacgcggagaagtaatcacgacggcgttgtcgacacgcagcgcgcccaaggctttcgggtatgccagcgcgacacaggtattgttcagcgacacgaccgaccggcatccggtcggctcgtcttcagcaatgcccgcaagcgtgtcctgacctttgcagaaggcttccaactcggaaaacgcttcgcttttcgtcgaatcttcttttgtggttttaacctgcaaaacatcgtccgcattctgcggattctgccaaacggcgagatagccgtaagtatcggcagcccgtgccgccgcagtcatcaggcatagtgccgatacggccagtatctttttcatcatgataaattcccgacggttcgtccaaattctgttgcattataaacaaaaaacaggataagtcccgccttatcggcttatccctccccgcagattgcaccgccgggtatggcaaaccgatttcagcagcgcaaatccgcataccgccgccttagcggcaagccgttgttttcagacggcattgcggccaacctttgcggcgggcgaaaaaccttgtcctataatttatcccgtttcaaaatcagcatacggtcggaaatgcaaaaaatatctttcaatttgttgaagcctgcaaactccccgaaaatagggaaacgccgccccggtttgaacggcgcgccgcatattccgatgccctccccccgataccttccggcaagcccagaaatgcccggcaacaacatccatccggcaaaaatccgaaacaacacacccggcggcaggcagagtcaaaccgccccgcaaagcatccgccatcagaaaaacaaaccgcctccgagggcttcatcctaaagggcgtattgttcgataatggtttgggttataatcccctatcgattctccacgtccgtgagacacttcagctatggaaaccccgaccaacaccccgcaacgctccctgcgtcaaaacagtatctacctgctgcccaattcctttactatcgccgcgctgttttccgcgttttacgcaatcacccaatccatgcacggacgttatgaaaccgccgccatcgcggtattcatctctatgttgctggacggtatggacgggcgcgtggcgcggctgaccaacagccaaagcgcgttcggggagcagctcgacagccttgccgatatggtcagcttcggcgttgctcccgctctgattgcctacaaatggcagctttggcagttcggcaaaatcggttattccgtcgccttcatctactgcgcctgcgccgccctgcgcctcgccctgttcaacacactcatcggcaaggtggacaaacgctggtttatcggcgtgcccagtccgactgccgccgcgctgattgtcgggctgatttgggtcaaccacagcgtcgaaaaattccccgccgtccactggtgggcattgggcatcacactgtttgccggcctgtcgatgattgtccaaatccctttttggagttttaaagaaatcaacatccgcagacaagtcccctttgtcggaatgctgcttgccgtcttactgctgcttctggtcacttgggaaccgtcgctcgtcctcttcctgttctttctcggatacagcctgtccggctacattatggcggcacgccgattttggaaaaagtacagaaaggcggattaaatgtggcattgggacattatcttaatcctgcttgccgtaggcagtgcggcaggttttattgccggcctgttcggcgtaggcggcggcacgctgattgtccctgtcgttttatgggtgcttgatttgcagggtttggcacaacatccttacgcgcaacacctcgccgtcggcacatccttcgccgtcatggtcttcaccgccttttccagtatgctggggcagcacaaaaaacaggcggtcgactggaaaaccgtatttacgatgatgccgggtatgatattcggcgtattcacgggcgcactctccgcaaaatatatccccgcgttcgggcttcaaattttcttcatcctgtttttaaccgccgtcgcattcaaaacactgcataccgaccctcagacggcatcccgcccgctgcccggactgcccggactgactgcggtttccacactgttcggcacaatgtcgagctgggtcggcataggcggcggttcactttccgtccccttcttaatccactgcggcttccccgcccataaagccatcggcacatcatccggccttgcctggccgattgcactctccggcgcaatatcgtatctgctcaacggcctgaatattgcaggattgcccgaagggtcactgggcttcctttacctgcccgccgtcgccgtcctcagcgcggcaaccattgcctttgccccgctcggtgtcaaaaccgcccacaaactttcttctgccaaactcaaaaaatcttcggcattatgttgcttttgattgccggaaaaatgctgtacaacctgctttaaaacacacgaaaaaacctttttaccgtttgcacaagcaattaatcaggacaaagctgcccagtctcctgttccgacaaaaggacagacaacctgaccgagacctttgcagaatatacgaaaaacaaaacaaataccgtctgaaaccacattccgacaatcggcagggtttcagacggcatctgataatttcaattactcggttgcggcaacgacggcaacggtaattttagcaacggcatcagtgtgcaaagccacttccacttcgtactcgccaacggctttcagaggaccgttcggcagacgtacatttgctttcacggcttcgatgccggcagcaacgattgcagcagcaatgtcggcattggtaacggaaccgaacaggcgaccgtccacaccagctttttgagcaacggtaacggtttgaccgtccaatttttcctgacggactcgggcatctgccaaaatttcagcctgtttggcttccagttctgcgcggcgtgcttcaaactctttcatattcgcttcggtcgcacgttttgccttacctgcgggaattagaaagttgcgggcgtagccgtttttaacggttacgatgtcgcccaagttgcccagaccgccgattttttctaacagaataatttgcatgattcaatctccaaaattatttgtgttggtcggtgtaaggcagcagagccaggaagcgtgcgcgttttacggcaacagccaattggcgttggtagaatgccttcgttcctgtgatgcgtgcaggaatgattttaccgttttcggagatgaagtctttcagcaaatcaacttgtttgtaatcgacttcttggattttttcagccgtgaaacggcagaattttctacgtttgaatgattgacgagccattgtcgtttaacctttatattcttgaatattttgtatcctgagcatcggcataagggaacgtctgcttttttgagctaaaaaaccttcgacgtgaacatatacaccttgccgatactgccactcttccgcctgcctgcctaaaatccgtgccggaatttccaattggacaaggcattgctgcccgttttcctcctgccacgattcgtgctttaaaataatatctaaaacagggattccggcaggcgtatatcgaatagggaaaaccttttcaattaacgcggcaagcgaaacaagattattgaatcccaattattgggcgaccgcttcttcagacgcaccgctcaacaggttcttagccttttcaccacccaacataggggatgcttcggtaacggcgtgtttggttttgatggtcagatgacgcaatattgcatcattgaagcggaatgcggtttccagctcttcaaccacttcgggagtggtttcgatgttcatcaaaacgtaatgggctttatggattttgttaatcgggtaagccagctggcggcgaccccagtcttccagacggtgaatcttaccgtttgcttcggcaatcatggttttgtaacgttcaaccatagcgggtacttgctcgctttgatcgggatgaacgataaacacgatctcgtaatgacgcatgttatctccttatggatggtaaaaacagccttctgccatgcgaaagcagaaggcaaggtttaaagaagcggcattatattggggtttgccgacggaatcaaggatttggtgcgaaaaatttgcattccgccgaaaatttcggtttcagacggcattcaaatgttttggctgcccagccagcgttccgcgtccaaagccgcctgacagccggaagccgcgctggtaatcgcctgacggtaggtatggtcttttacgtcgcccgccgcccatacgccttcgatattggttgcgccgacattgtccgccgtgccgcctttggttttcaggtaaccggcttcgtccatttccaactgacctttgaaaatatcggtattcggcttgtgcccgatggcgataaaaatgccgctgacggcaatttgttgctcagaaccgtcgttgttttttaataatgcgccgtttacgccccgatcgtcgcccagtacttcttgcaggttgctttccagcttgaggatgattttgccctcttccacgcgtttcatcagtttgtcgatcatgattttttcggcacggaactcgctgcggcggtggatcagggtaacggttttggcgatattggcaaggtagagtgcctcttcaactgccgtattgccgccgccaactacggcaacatcttggtttttatagaagaaaccgtcgcaggtggcacaagcggaaacgccttttcctgcaaacgcttcctcactcggcaaaccgaggtatttggcggacgcgcctgttgcgacaatcagggcatcgcaagtgtactcgcccatatcgcctttgagtgtaaacgggcgtttttgcagatcgacggcgttgatttggtcaaaaatgatttccgttccgaaacgttcggcgtgggcgagaaaccgcgccatcaattccggcccttgcacgccgtcggcatcggcaggccagttgtccacttcggtggtggtcatcagttgcccgccttgcgcgatacctgtaataatgacggggtttaaattggcgcgcgcggcatagacggcggcggtgtatccggcggggccggaacccaaaataatcagtttgcggtgttgggacattgtttttcctttgctgtgtcaagttttcggattctactcgaattatcggcgcgtttgagaaatttcgaccataccggcgctcagacggcatcccgcagccttaactgccgtctgaatatcaaagcaggaatcacgcttatgcaacaaaaaatccgtttccaaatcgaaggcatgacctgccaggcctgcgcttcgcgcattgaaaaagtgttgaacaaaaaagattttgtcgaatcggcgggggtaaacttcgccagcgaagaggcgcaggtagtgtttgacgacagcaaaacctcagtagccgacattgccaaaatcattgagaaaaccggttacggcgcgaaggaaaaaacggaagatacattgccgcaacccgaagcagaacaccatatcggctggcggctgtggctgctgttcaccatcaacgtcccgttccttatcggcatggcggggatgatgatcggcagacacgattggatgattccgccgttgtggcagttcgcattggcaagcgtggtgcagctttggctggcaatcccgttttacaaaagcgcgtgggcgagcattaagggcggactggcgaatatggacgtgctggttaccatcggcacggtctcgatttacctgtattccgtctatatgctgtttttcagcccgcacgcggcgtacggtatggcgcatgtgtattttgaagtgggcgtgatggtgatcggttttgtgtcactgggtaaatttttggaacaccgtaccaaaaaatccagcctcaacagcttgggcttgctgctcaaacttacaccaacccaagtcaacgtgcaacgcaacggcgaatggaaacagcttcccatcgaccaagtgcaaatcggcgaccttatccgcgccaaccacggcgaacgcattgccgcagacggcatcattgaaagcggcagcggttgggcggacgagagccatcttaccggcgaatccaatcctgaagaaaaaaaggcgggcggcaaagtgttggcgggcgcgttaatgaccgaaggcagtgtggtgtaccgcgccacgcagctcggcagccaaacccagctcggcgacatgatgaacgcgctctctgaagcacaaggcagtaaagcaccgattgcgcgcgtagccgataaagcggctgcggtattcgtgcctgccgtcgtgggcattgcgttgttgacttttattgttacttggctgattaagggcgattggacggttgcgctgatgcacgccgtcgccgttttggtgattgcctgcccgtgcgcgctgggtctggcaacccctgccgcgattatggtcggtatgggcaaagcggttaaacacggtatttggtttaaagacgcggcagcaatggaggaagccgcccacgtcgatgccgtcgtgttggacaaaaccggtacgctgaccgaaggcagcccgcaggttgccgccgtttattgcgttcccgacagcggctttgacgaagacgctttgtaccgcatcgccgccgccgtcgaacaaaacgccgcccatccgctcgcccgtgccatcgtctccgccgcccaagcgcgcggtttggacattcccgccgcacaaaacgcacaaaccgttgtcggcgcaggcattaccgccgaagtggaaggcgtgggtttggtgaaagcaggcaaagccgaatttgccgaactggccttgccgaagtttttagacggcgtttgggatattgcaagcattgttgcggtctcagtcgataacaaacccatcggcgcattcgcacttgccgacgcgttgaaagccgataccgccgaagccataggccgtctgaaaaaacacaatatcgatgtctatattatgagcggcgacaaccaaggcacggtcgaatacgtcgccaaacaactgggcatcgcacacgccttcggcaacatgagtccgcgcgataaagctgccgaagtgcaaaaactcaaagccgccggcaaaaccgtggcgatggtcggcgacggcatcaacgacgcgcccgcgcttgccgccgctaacgtcagcttcgccatgaaaggcggagcggacgttgccgaacataccgcatccgccacgctgatgcagcattcggtcaaccaactcgccgatgctctgctggtgtcgcaagccactttgaaaaacatcaagcaaaacctgtttttcgccttcttctacaatattttgggcattcctctcgccgcgcttggctttttaaatcccgtcatcgctggcgcggcaatggcggcaagctcggtttccgtgttgagcaatgccttgcgcctgaaacgggtaaaaatcgattagcagcatgtaaccgccctgcagccttgtccgaacggataaggctgtctccagcgatatggtaatatgccgtctgaaaccgtttttcaagtaattgatatgaataaagaaacccgttttccggaacacttcgacatcccacttttcctcaaaaacctgcccaacctgccaggcgtataccgttttttcaacgaaagcggcaacgtcttatacgtcggcaaagccgtcaacctcaagcggcgcgtgtccggctatttccagaaaaacgaccattccccgcgcatcgcattgatggtgaaacaggttcaccacatcgaaaccaccatcacccgctccgaatccgaagccctgattctcgaaaacaacttcatcaaagccctgtcgcccaaatacaatattcttttccgcgatgacaaaagctatccttatttgatgctcagcggccatcaatatccgcaaatggcgtattaccgcggcacgctgaaaaagcctaatcaatatttcggcccatatcccaacagcaacgccgtgcgcgacagcattcaagtgttgcaaaaagtctttatgctgcgtacctgcgaagacagtgtattcgagcatcgcgaccgtccttgtctgctttaccaaatcaaacgctgcaccgcgccttgtgtaggccacatcagtgaagaagattatcgtgacagcgtgcgtgaagccgcgactttccttaatggcaaaactgacgaattgacgcgtaccctgcaacacaaaatgcaaaccgccgccgctaatctacaattcgaagaagccgcacgttaccgcgatcaaatccaagcgctcggcatcatgcaaagtaatcagtttatcgacagtaaaaatccgaacaatcccaacgatatcgatttgcttgcactggcggtttcagacggcctggtttgcgtacactgggtcagcatccgcggcggacggcacgtcggcgacaaaagctttttccccgacaccaaaaacgatcccgagccaaacggacaagattacgccgaagccttcgtcgcccaacactatctgggcaaaagcaaacccgacatcatcatcagcaactttcccgttcccgatgcgctaaaagaggctttggaaggcgaacacggcaagcagatgcaatttgtcaccaagaccataggcgaacgcaaagtccggttgaaaatggcggaacaaaacgcgcaaatggcgattgcacaacgccgcctgcaacaaagcagccagcaacaccgcattgatgaactggcaaaaatcctcggcatggattcagacggcctcaaccgccttgaatgtttcgacatcagccacacacaaggcgaagccactattgcgtcctgcgttgtgtacgatgagcaaaacatccagccttcgcaataccgccgctacaacatcacgaccgccaaacccggcgacgactacgccgccatgcgcgaagtgttgacgcgccgttacggcaaaatgcaggaggccgaagccaacggcgagaccgtcaaatggccggatgccgtgttgattgacggcggcaaagggcaaatcggcgtagccgtatcggtatgggaagaactcgggctgcacatccctttggtcggcattgccaaaggcccggagcgcaaagccggtatggaggagctcatactgccttttaccggcgaagtcttccgcctgccgcccaacagcccggccttgcatctattgcaaaccgtacgcgatgaatcgcaccgtttcgccattaccggtcaccgcaaaaaacgcgacaaagcccgcgttacctcctccttaagcgacatccccggcgtaggcagcaaacgccgccaagccctgctcacccgcttcggcggtctgcgcggcgtgattgccgccagccgcgaggacttggaaaaagtggaaggcatcagcaaggcattggcggaaacgatttacaatcatctgcattagcatgctgtcaaagacaaaatccgtctgtaaaaaatatgatacagcaggtcggtataccgatatatagtggattaaatttaaaccagtacggcgttgcctcgccttgccgtactatttgtactgtctgcggcttcgtcgccttgtcctgatttttgttaatccactataaacctaacttcataacgaataacgatgattcgacaaaacggaaaacgatctgacatgaacaatcccgacttaccctatcggcaggccttagaatgcctgtctcaaaaacaatataactttaccgaagtccgccgactgctgacagaagcgttctcggcaggtcatcccgccgccgcattcgagttggcaaaacacctgatggacgcggacagcccctaccaagaccgcgaacaaggtatggaaatgctccgcatcgccgctgaacagggacatccctacgcgcgttacaatctggcatatatccaagaattggaaggcgcacccccggaaaccctgataccgctttacagaccgttggcagaagaaggactgcccgaagcgcaagtccgcctgatgtaccttctgtacgcgtcccgacattttgaagaagccttggaatgggcaaaaacaagcgcaaaaaacaacaacccccacgggcaatacctgcttgcccaatactgccggtacggcacaccgccggattttgaaacggcgcacctgctctaccgaaaatcggcggcacaaggcttgccggaggcacattggcagctcgggctgcaatatcgtttcgggcaagggacgaaagtcgacacggcacaggccgtcaatcatttgcgcgccgccgcacaacaaggatacattcctgcctacaccccacttgccgagctcatcctacctacggctcctgatgaagccgttcactggtttcaacaggccgcacaggaaaatgaccccgatgcccatgccgcacttgccgacatctacctgcaaggcaagcatctggaaagaaaccacaaacttgccctgcatcatgccgaagcagccgccgccgaacgccatcccgaaggtttgcggatactgggcgacatctgccgctacggtttgggcatagcccccgatacggaaaaagcccggcattattatcggcaggcagccgaagccggcagcctttccgcctatcagaaactcatatccgacagcgcgttaaaccatcctgaccaatacggcggcattaaagattccgccatcaggcggcaaagggcagaacggctttatcaaaaagcccaagccctgcattacggattacaatgcgcgcccgaatacgcagccgcgctcaaactctacacagaagccgcagaactcggacacagcaaagcccaaaccaatctgggcagcatgtattacttcggacagggtatgaccgccgactacaatgaagcacgcaaatggtttgaaaaagccgccgcgaaaaaagacagtatggcgttctacaacctcgcctgcatccattacagcggacacggcgtcgagccggacaaagaaaaagcctgccgctacctgcaagaagccataaacaacggatacgggcaaaaaagcgtcctgcaagaactgctgcaacaatggcaaaatgccgtctgaacagcgttacacctaccctgccgaaacgaaacaggtataatcgcccctttcccttcccgccgtccgaacaggcatttcacattcagacggcatcctgattgcacaagcgtacgaaagcattatgacagacaccgccgagaaccaaacacaaaacaactggcaagccggacacccccgcagcatccgcagcttcgtcctccgccaaagccatatgaccgccgcgcagcaacgcgccatcgataccttatgggacagcttcggcatcgactaccaagcaacaccggccgatcttgatgcccgtttcggaagcagccgacccaaaatcctcgaaataggcttcggtatggggacggcaaccgcagaaatcgcccgccgcctgcccgaaaccgacttcctcgccatcgacgtacacggtcccggcgtaggcaacctgctcaaactcatagacgaaaaccatttagaaaacatccgcgtgatgcggcacgatgccgtagaagttgtcgaaaatatgctgcaagacggctcgctcgacggcatccacatattcttccccgacccgtggcacaaaaaacgccaccacaaacgccgtctgatacaagcccccttcatcgccaaactactgcccaaactcaaaaccggcggctatatccacctggcgacagactgggaagaatatgcacagcagatgcttgaagtcctcagtagcttcgacagcctgcaaaatacggcggcagactacgcccccaccccggactaccgccccgaaaccaaattcgaagcgcgcggcaaacgcctcggacacggcgtttgggacttggtattcaaacggatcggataacaaaccactgtttgaaaatgccgtctgaaacatgtttgcttacagacggcattttttcaagataaagcagcaagtgatgtttcgatataaagtttaaaacaatagtttgaacggcaaaacgcgtgtgtaccgcacgcatccttataggttttatgcacatcggttttaaagtttgtgccgcccgcaggtagtatgtgatagctacgcacgcggttggtgtgatgtaggctacggcttgctggttacaaccgtaaaaaagtaagtgccgccattgcggtaaaaacgaagggatttcatagtgttatgctcgtaatgattttgtagattggattctcgaatccgaccttttgggcattgctgcaatggattgcaacgacgggaatgttgaaggttttgtcggatacaagtatccgacctacgcttgttgctatatatcttttgatttaatgactaaatatgacaaagttaaagtgcagattacagcaagcatgatatgcttctttaggcttttatcattccatgatatagatatttcttccttttcattttctttataaaattttaaacctatatcaccatttttccattcctggtggtttactatgattttatttttaaaagaatctcttaaactttcatgtaaagagttaaattttcttgatttacttcccttagtacatggtgagcaattgtatttctaattttatttaatctctcccctatatcatatacttcgctaaataagccaagattacgcgcaatttttagttttgtgcgaaatccaatttgtgtatcattgaaaaaatcttctttattacattttgcatatatccatgcctctaaaattctttcaaaaaataaatgtgttcgtaagattgaacctatttcatcctgtgtttcaatagcttctttcacgatatcaaaaatcttataatcatcaaaatttgaatttttaataaataattctaaattaaaatctaattgagacataataagtgcccatttcaaaaataaatctatattctagttaatataatagttattctaatatctaaattaaataataaactactatttttatatccacgacaaagtctaagtctcactccgccccaaacaacaaattctctttaatatccctaatcctatcccgcaacacagccgcctcttcaaactgcaaatccctagccgcctgctgcatggctttttcgagtttggcgatttctttaatcgcatcttcttcgttgtgaatctcgcccactttaaccttgtttttacctttcagacggcctttactgccgtcttcttcgtggtacacgccgtcgatgatgtctttgacctgttttttaatctgctgcggcacgatgccctgttcttcgttgaatttaatctgtttttcacggcggcgttcggtttcgtcgatagcggctttcatggagtcggtaattttgtcggcgtacaggatggcgacgccgttcacgttgcgcgcggcgcggcctatggtttgaatcaggctgcggtgggagcgcaggaagccttctttatctgcgtcgaggatggcgacgagagagacttcggggatgtcgaggccttcgcgtaagaggttgatgccgacgagtacgtcaaacaggccgagccgtaaatctctaatgatttcaacgcgctcgacggtgtcgatgtcgctgtgcaggtagcgcactttgataccgagttcgctgtaatagtcggtgagttgctccgccatgcgtttggtgagggtagtaacgagtacgcgttcgcctttttcaatgcggtcgttgatttcgctcattaagtcgtcgacttgggtggcaacggggcggatgatgatttggggatcaaccagccctgtggggcggacgacttgttcgaccacttgtccggcgtgttcttcttcgtatttggcgggggtagcggaaacgaagatggtttgcggcatgactttttcaaattcgtggaatttgagcgggcggttgtcgcgggctgaaggcaggcggaagccgtagtcgacgaggttttgcttgcgcgatgcgtcgcctttgtacatgccgccgatttgggttacggtaacgtggctttcgtcgatgaacatgatggcgttgtcgggcaggtagtccatcagcgtaggcggcggttcgccttcttttttgccggaaaagtggcgggagtagttttcgattcctttgcagaagcccatttcgtagagcatttcgaggtcgaaacgggtgcgctgttcgatgcgttgttgttcgacggggcgttgttcgcgggcgaaaaattcgatgcgttcgcgtaattcttctttgatggactcgcaggcgcgcaagacggtgtcgcgcggggtaacgtagtggctggacgggaagacggtgtagcggccgacgcgctggataaggctgcctgaaagcgggtcgaacatatcgaggcggtcgatttcgtcatcaaacaggctgatgcgtaaggcgttttcggagctttcggcggggtacacgtcaatcacgtcgccgcgcacgcggaagctgccgcgtttgaagtccaaatcgccgcgttcgtattgcatggaaacgagcgtggcgatgatgtcgcgctgctcgatggtatcgccttctttgacggacaacaccatttgttgatactcggtcgggtcgccgataccgtaaatggcggacacggtggcgacgataatcacgtcgttgcgcgtcattaggtttttggtggcggaaaggcgcatctgctcgatgtgttcgttgatcgcgctgtctttttcgatgaacaaatcgcggctgggcacataggcttcgggctggtaatagtcgtagtaggagacgaaatattccactgcgttttcggggaaaaattcgcgcatttcggcgtaaagctgggcggcaagggttttgttgtgcgccatgatgatggcggggcggccgctttgggcgatgacgttcgccatggtgtaggttttgcccgaaccggttacgccgagcagggtttgataggcaaggccgtctgaaagcccttcgagcaggcctgcaatggcggtgggctggtcgcctgcgggcgggaagggttggtggagtttgaagggggaatttgggtattggataacttccataatcttgcctgtgatgcgtttgcggacaaagcgtgcagtagggatgggtcggaaacgtctttcagacggcataaggcggtgaaatcctgaatgtatgccgtctgaaacccaatcgctacccaagtatagtggattaacaaaaaccagtacggcgttgcctcgccttgccgtactatttgtactgtctgcggcttcgtcgccttgtcctgatttttgttaatccactataaatgccgcacggttcaaattccggtaaaaaatcgctcataacctgtcctttcaaacataatatgccgtctgaaatcctttcagacggcatcgtcaaaacctacttcttatcttttttatctttcttatctttatttgaaaccggctttttcgccgccagccccaaagacttctgccactgctcgggcgacttgactaaatccaaagctttccgcaactggtcgtctttggcagggttgggaatccgccttgaagacaaatcctcgtcctttttctttttacctttttcttttacagcgggcttatccgcatctttttcaagcggcacggcaagggtttcaccgttcacatcctcgccgcccaagggattgccgatgtgtccgaccaaatccgcctcgcggctttcaaaaatgcgttccttatcttttacttcgacatcgggaacaatcccctgcgcctgaatagaacggtcgttcggcgtataatacagtgccgttgtcagcttgaccgcgctgccgttggacaaaggaatcaaagtctgaaccgaacctttgccgaagctctgcgtaccgacgatgaccgcgcgtttatgatcctgcaatgcacctgcgacaatctccgacgcggaagccgaaccggaattgaccaataccgtcatcggtatggttttcaactcggcaggaatgcccgccaacgaatcgccgcccatcccgtacacataatcttcaggaatggctttcagtaccatgcggtctttgccgtcgcgtcccttggtgctgacgacgactgcttcagacggcagaaatgccgccgacacgccgaccgcgccagtcaaaagcccgccggggtcgtcgcgcaaatccaacaccagccccttgagcggttttcctttattttcctttaccagctcttttgcggcggtattgacgctttcgaccgtccgctcttggaactgcgacacgcggatatagccgtaatcgggttcgatcaggtgatggcggacgcttttcactttaataatggcacgggtcaggttgacgactatcggcttgtcggcatttttgcgcgacagcgtcaaagtaatcttcgtacccggcttgccccgcattttcttcaccgcttcgctgaccgtcatgccgcgtgtcgaaacattatcgattttcacaatgaaatcgccgcttttcacccccgcccgttccgcaggcgtgtcctcaatcggcgaaaccactttgacaaatccgtcttcctgcccgatttccatccccaagccgccaaattcgccgctggtggactcctttatctcggcataaccttttttatccatatattcggaatgcggatccaaaccggccaccatacccttcatcgcaccttcaaacaaatcggcatcgggtttgtcctgatagtagtttgccttgatttgaccgtaaacctccgccattgtgcggatggattgcaccggcaggacttcgttatcccgcctgtccttctcggcggcaaaaccctgcaccgccagactgacggccacgccgctgattgcacccaaagtataaagtgcgattttcttaaaaacaggtttcgacattcttctttaactttctctcttgatttccaaaaaccggaaaatacaggtacggcaaacggcaaacttcacggaacagcgcaccatatcggcacgatttgcataaagcctaccgtttcggcaatccgatcaacgtatccagctcgaagggttcaatacctgaccttgataacgtatttgcaggtaaagcccctcttccccgtccggcagcgacccgctcgagccgattttgcttcctgccgcgaccatataacccttgccgacggaaatttcgctcaaaccggcatagatgctgatgtagttctcgccgtgatcgaccacgaccactttgccgtagccgtccaactcgtccgcatagcttaccgttcccggcgcaatgctttcaaccgttgccggtgcagtggaatagaacacgcctttccaaatatcgccgccgctccggttctgcccgaaaagtccggtcggcacaccgtcaaccggttttttcaaacgtccttgcatgcggctgaaaccgtcggcactgccgatacccataaccgaaggcgcttggatgttcctgtcttcggcggtcaggttggacatttccgcacgtcgtgcttcagccttctgctgcgccgcttcttttctggctttttcggctgccgccagtctggcttcagccaattttctttttgcttccgcatcctgaatgcggtgttcggcctttttcttctccaaattgctcaagagcttgttcagctgctgctcgttccctttctgttccagcagttttcgggcatctttggcgattttggcattctgtctgcggctttccgtctgttccgccgcatcggttacaccctgttttttcagcagagattgcacgtttgcctgaattttcttcaaacgggcaagctcattgttgattttctgctcttgtaccgccaaagccttctgctgtttttccaaatccttgacaacttcccgattggaggcgtttacataacgcgtataacgcaaaaagcggtttttctgacccggttcggcgtttttcaggaacagggcaaccgcattcggctggctgtttttatagttccccgatacgaaacgggaaatctgcgctttcgtagcggcgacttccgttttcaaacggttcagctcggtattgagtttttggaacttgtcccaagcctcgcgctgtttgcggttgacggaagcaaggttgccgcgcgcctgacggatacgctcttggcggatacgctcttcctgaagctgtttgagggaattgctgacatgaagcagcattccttcgctttgtttgagcagggcttttttgttttcgacatcattggtggcagcggcaacggcggctttcaattcgtcggaatcggttttggcatttttctcttccctgtattttttgtcctgtttcactgctttgccgttcttgtcggaacggacttttttatttgcagaaacagtgtctttttccgccttgccgcccttgcgcggattgccctgtccttttgcctcttttttgccttgtttgttttcaggctgtgtttttgcgtttttttctttggatccggacacgggcttgccatgtgcctttttgtgttccgccttcgatttcttatccccttcgcgtcctttgcgcgcagactgcctggatgtcgcctccttctctgcttctttgcggtttttggcggtttttttggactctttgccctcttttgccgcctctttgccgcctgtttttttatctttcactgcgccatttttgcctttttcttttttgccttccgccgcttcgggctgttcttttttgttcttcgtctgttttttcacttcggcggaacggttgtgtgccgcgtcgtgggcggcaacggcgggcgtggaaaaaacgagcatcagggcaagcagaaggggtttgtagcgcatggttcgaccttcggaaaaagttggataatactgaaggctgcacgaaagcagccggacgtttggattatactgtcagttatgccgtctgaaaatgccgtttgcccaatcttgcgccttctttgcgcggatacttgcaatcggctcaaacagccttatattgtgcgtcatattttcaatgccgcaacggatattgtgttccgacacacagggtagcacattaagccgcataccgtatgttgcccgattttgggaacgtgcgcccctccaaacaaagcaagccctgccgctttcacggaaaacggggattcaaccgataaggaaattttgatgaacagactgctactgctgtctgccgccgtcctgctgactgcctgcggcagcggcgaaaccgataaaatcggacgggcaagtaccgttttcaacatactgggcaaaaacgaccgtatcgaagtggaaggattcgacgatcccgacgttcaaggggttgcctgttatatttcgtatgcaaaaaaaggcggcttgaaggaaatggtcaatttggaagaggacgcgtccgacgcatcggtttcgtgcgttcagacggcatcttcgatttcttttgacgaaaccgccgtgcgcaaaccgaaagaagttttcaaacacggtgcgagcttcgcgttcaagagccggcagattgtccgttattacgaccccaaacgcaaaaccttcgcctatttggtgtacagcgataaaatcatccaaggctcgccgaaaaattccttaagcgcggtttcctgtttcggcggcggcataccgcaaaccgatggggtgcaagccgatacttccggcaacctgcttgccggcgcctgcatgatttccaacccgatagaaaatctcgacaaacgctgatatgaacctctccaaccactttctcatcgccatgcccgatatggaagacgcgtttttttcacaatcggtcgtctatatctgcaaacacgatgaagacggcgcactcggcatcgccatcaacaaaccctctccgattacgatggacatgattttttccgccaccggcaaaaacatccccatgcggatgcagcacgacagcgtgatgatgggcggtccggtgcaggtcgagcgcggttatgtcgtgcataccccgatcggcaactggcaaagcagtatcggcgtttcagacaatatcgcgctaacttcttcccgagacgtgattgaaaatatttcacgcgaaggtgcggttgacaaagccttgatcagcataggctattcaagctggagcaaagggcagctcgaacgcgaacttgccgacaatgcgtggctgactgttcccgccgacgaacacatcctgttcgacatcccctacgaacaccgttacgccgccgcattcgccaaactcggcatcgacccgctcgccctgttttcaggagccggccatgcataaaattccaaaaggaacggcactggcattcgacttcggcgaagcgcgtatcggcgtggcacaaggagacgcggaattagggctatcccatcctttgagcaccgttaccggcggcagcaacgatgaaaagttcgcggcaatcgccaagctggttcaagaatggcagccgcgttattttgtcgtcggactgcccgtgcataccgacggcacgaaacatgaaatgacgcacctgtcgcgcaagttcggacgcaggctgaacggcaggttcaatctccccgtctattgggttgacgaacggctgtcgtccgtctatgccgaaagcctgctttcggaagcacaggtcttcggcaaaaaacgcaaatcggtgctcgaccaagtggcggcgcaagccatcttgcacggttttttcgagggcggtccggcggaatgtttcaacgggcgtgagggttaagcggcgcggttaacaccctaccgtgaaagaggcgcgcaccaagccgtccagctccaatgccaaattgtcccccgcaccgattgcgcccacgccggagggcgttccggtaaacaccaaatcccctttccccaaaccgtaatctgccgccagtttgtgtaaaatttcccgaatcgggtaaatcatcaaaccggtatccccgcgctgtttcaatacgccgttttgttttaatgaaaacaacaccttctcgggattgccgattctgcctgccgccgcaaaatccgacacgcacgcggaatgcctgaacccttttgccttcagccagggcagccctttttccttcagacggcattggatatcccgtgccgtaaggtccagccctacaccatatcctgcgacacatcccaaaatatctttaccctcgcccgtgccgtctgaatccttaccgaccagcagcacgagttcgcactcaaactgcacatccctactaaactcgggcagcaagattgtaccgccgctgttcaaaatgctgcctgacggcttcataaacaccacaggttcggaaggtatttcgttttttaactcttcgatatgtgcggcatagttcctgccgatacagaaaatattgccgacctcgactgcctctccttctaaaaatactgaagccacttcactttccccctaagtaaaaatgccgtctgaaattattttcagacggcattcgaccaagcttacgcatttaatgaagctgttacacgtgcaacaatttctccgattgcaactgcctgcgcttcgttgtcgcggcgttcggcgtattcgacattgccttctttcaaggcgcggtcgccgatgacgatgcggtgcggaatacccaacagctcggaatcgttcagcaacacgcctgcgcgttcgtcgcggtcgtcgaggaggacgtctgcgcctgccgccagcaattcggcatagattttgtcggcggcttcgcgtacggtgtctgattttttgtagttcatcggcacgataacgacttcaaacggcgccattgctttggtccagatgatgcctttttcgtcgttattctgctcgatggcggcggcaacgacgcgggtgatgccgatgccgtagcagcccatttccataatttgcgatttgccgttgttgtcaaggaagcttacgttcatggcttgggtgtatttgtcgcgcaattggaaaacgtgtccgacttcaatgccgcgcgccagtttcagacggccttgcccgtcggggctttcgtcgccctcgacgacgttgcgcaaatcgacaaactcaggttcggcagcgtcgcggccgaaattgaagccggtatagtggtagtcgtcttcgtttgcgccgatgacccagtccgcgcctttttcggtagcgaaatcggcatagactttgcctgcaaaaccgacagggccgagagagccgccgtttgcgccgaactgttcgacaatcgcggcagggcttgccatcgtcagcggcgatttcacgcccgcgagtttctcggctttgatgtcgttaaattcatggtcgccgcgtaacagcagcaggataagttcgccttcgttttcgccttcaaccacgatggatttcagtgttttttcaatcggaatactgaggaaatcaaccaatgaatcaatggttttgacgtttggcgtgtgtactttgacgagttctgcctgagcggctgcacgttcgcctttgagcggcaaggtcggcgctaactcgatattggcggcgtaatcggaagtgtcgctgtatgcaatcacatcttcgccgctttccgccaacacttgaaactcgtgcgaaccggtaccgccgatgctgccggtatccgcagcaacgggtcggaacgccaagcctagtcgggtaaagatgcggcaataagcatcatacatatcttgataggtcgtctggagcgaggcatagtcggcgtggaaggaataagcgtctttcatcacaaactcgcgcgcgcgcatcacgccgaagcgcgggcgcacttcgtcgcggaatttggtttggatgtggtaaaagtttttcggcagctgtttgtagctgttgatttctttgcgcacgatgtcggcgatgacttcctcgcaggtcgggcccatgcagaaatcgcggtcgtggcggtctttcaggcgcagcagttctttaccgtaaaactcccagcggccggattcctgccacagctcggcaggctgcaccaccggcatcagcaactccacgctgcccgcgcgcgccatttcctcgcgcacgacgttttcgactttgcgtaacacgcgcagccccatcggcatccaagtataaagacccgatgcgttggccttaatcaggccggcgcgaatcatcagcttgtggctggcaagcgcggcttcggcaggggcttcttttaaagtagagataaagaattggctggctttcataaaagtatttttccaaacaggcaaattcaaaagtaaatcgggtgcagattgtaacgcgaaaaaagcaggttttgcaccaacctccaaaattcaccccctgccccaagcgcgggacaaatcccataacagacggcaaaaacatgaccagaaacatcatattgaacataagcacatgatttttatagatttaaatgtgcctattttttaatcaaaataagcgtacatttgttgcgtaagacttttttaacacaagccgtggcttatcaacacggttatccacaaagcttgtgtatagattttctacaataggaaaattgccgacagagacataatgattcgatataccacaattccgaaaaaatatcgccaaaatcaaacagaatatttcgaaatcaaaaagacttgaccttaccaaacgccaacttcagtataaaacctgcttttacaggcatggttatttgccagcagacccgattgctgataggatttcgtgtggagcagatcgaacatttttttcaagttttcccttgtttccaaaacttttataattttttgaaaacattaaacttaaattatttttttcggtttgatttagaaattttcgtttttgcttattatttttcacaaacgaaaataaaggggttggctacaccctccctgccgattaaacactcaacataaaggatagatactatgtccacccaattacacgatgttgaccctatcgaaacccaagagtggctggacgcgttaagctccgtcctcgaatatgaaggcggcgaacgcgcgcaatacctcttggaaaacctggtcaaatactgccgcgacaagggcgtacgtatgccacacggcacgaccaccccgtatttgaataccgtttcggttgaaaacgaaaaaggcattccgggcgaccaaaacatcgaacaccgcatccgcgcattcgtgcgctggaacgccgccgccatcgtattgcgcgccggcaagaaagatttggaactgggtgggcacatcgcatctttccaatctgccgccaccatgtacgaagtcggtttcaaccacttttggaaagccaaaggcgaaggcgaagaaggcgatttggtcttcttccaaggtcacgtcgccccgggcatctatgcacgcgcattcgtcgagggccgtctgaccgaagaccagctgaacaacttccgccaagaagtggacggacacggtctgccttcctatccgcacccccacctcttgcccgacttttggcagttcccgaccgtatccatgggcttggggcccatcatggcgatttatcaggcgcgtttcctgaaatacttggaatcgcgtggtttggcaaaaaccaaaggccgtaaagtatggtgtttctgcggcgacggcgaaatggacgaacccgaatctcaaggtgcaatcgcactggctgcacgcgaaggcttggacaacctgattttcgtcatcaactgcaatctgcaacgcttggacggtccggtacgcggcaacggcaaaatcatccaagaattggaaggcaactttgccggcgccggctggaatgtcgtcaaagtcatttggggccgccgctgggaccgcctcttggcgaaagacaaagacggtatcctgcgccaacgtatggaagaatgtttggacggcgactaccaaacttacaaatccaaagacggcgcgtatgtgcgcgaacacttcttcaatacgcccgaactgaaagcattggttgccgatatgaccgatgagcaactctgggcattgaaccgcggcggccacgacccgcaaaaagtgtacaacgcctacgaccgcgcagcgaaccatgccgacggcaaacctaccgtcatcttggcgaaaaccattaaaggttacggtatgggcgcatccggcgaaggtcagaacgttgcccaccaagccaaaaaaatggacaaagcgtccctgaaacaattccgcgaccgctttgacattccggttaccgacgaacaaatcgaaagcggcgatctgccttacctgacttttgcccccgatacggaagaatacaaatacctgcacgcacgccgcgatgctttgggcggctacctgccgcaacgcaaaccgacgcaggaagtattggaagtgcccgagctgtcagcattcgacgcacaactcaaatccagcggtgaacgcgagttctcgaccacgatggcattcgtccgcatcctgtccactttactgaaagacaaaaaaatcggcaaacgcgtcgtacctatcgttcccgacgaaagccgtactttcggcatggaaggtatgttccgccaatacggtatttggaatccgaaaggtcagcaatatacccctcaagacaaagaccaactgatgttctataaagaatccgttgacggtcaaatcttgcaagaaggtattaacgaaccgggcgcgatggccgactggattgcggctgcaaccagctacgccaacagcaacttcgccatgattccgttctacatttactattctatgttcggtttccaacgtatcggcgacttggcttgggcggcgggcgatatgcacgcgcgcggcttcctgctgggcggtactgccggccgtacgacgctgaacggcgaaggcctgcaacacgaagacggccacagccacatccaggccgacctgattccgaactgcgtatcttatgacccgactttccaatacgaagtcgccgtcatcgtacaagacggtctgcgccgtatgtatgccaataatgaagacgtgttctactacatcaccctgatgaacgagaactacacccatccggatatgcccgaaggtgcggaacaagacatcttgaaaggtatgtacctgctgaaagccggcggcaaaggcgataagaaagttcaattgatgggctccggtaccatcctgcaagaagtcattgccggtgccgagctgctgaaagccgacttcggcgtagaagcagacatctggtcttgcccgtccttcaacctgctgcaccgcgacgctgtcgaggtagaacgcttcaaccgcctgcatccgctggaagccgaaaaagtacctttcgttacttcccaactgcaaggtcatgacggtccggttattgccgctaccgactatatccgcagctatgctgaccgtatccgcgcctacatcccgaacgactaccacgtcttgggcactgacggtttcggccgttccgacagtcgcgccaacctgcgccgcttctttgaagtggatcgctacaacgttgccgtggccgcattggccgcattggcggaacaaggcaaagtcagcaaagaaaccgttcaacaagccattgagaaatacggcatcaaagccgattcagctcctagctggaaacgctgattgatgtttcagacggcctgtttgccccattccgacatcaggccgtctgaaaaccgaatgcccgaatggtttgagcagacaaaccgtaccgatgccgcctgaagcagctttcagacggcatccaatgaaaaagattaaaggaactcaaatgagtatcgtagaaatcaaagtccccgatatcggcggtcacgaaaacgtcgacatcatcgccgtagaagttaaagcgggcgacaccatcgccgttgacgacaccctgattacactggaaaccgacaaagccacgatggatgtgcctgccgatgcggccggtgtcgtgaaagaagtaaaagtcaaagtcggcgacaaaatctccgaaggcggcgtaattctgaccgttgaaaccggtgccgccgccgccgaagccgccccggctgctgccgaagcacaacctgcacctgctgccgcacccgctgccgcaggcggtgcaaccgttcaagtagccgttcccgatatcggcggccataccgatgtggatgtaatcgccgttgaaatcaaagtgggcgacaccgttgccgaagacgacacgctgattactttggaaaccgataaagcgacaatggacgtaccttgtaccgctgccggtgtcgttaaagccgtattcttaaaagtcggcgacaaagtatccgaaggctctgccattatcgaagtagaaaccgtcggctctgccgcagcagcccctgctcaagccgctcaagctgccgcaccggctgccgctccgcctccgactgctgccgccgcacccgccgccgcgcctgcaccttctgcacctgccgctgccaaaatcgacgaggccgctttcgccaaagcacacgccggtccttccgcacgcaaactggcgcgcgaattgggcgtggatttgggccaagtcaaaggcaccggcttgaaaggccgtatcatgggcgacgacatcaaagcctttgtgaaatccgtgatgcagggcggcgcggcaaaacctgccgcagccagcgcatctttgggcggcggtctggacttactgccgtggcctaaagtggacttctccaaattcggcaatgtcgaagttaaagaattgtcccgcattaagaaaatttccggtcaaaacctgtcccgcaactgggttgtgattccccacgttaccgtacacgaagaagcggacatgaccgagctggaagaattccgcaaacagctgaacaaagaatgggaacgcgaaggcgtgaaactgtccccgttggcgttcatcatcaaagcctctgtttccgcgttgaaagcattccccgaattcaacgcctcactggacggcgacaacctggtgctgaaaaactacttcaacatcggtttcgcagccgatacgccgaacggcttggttgttcccgtcatcaaagacgtggatcaaaaaggcttgaaacaaatcagccaagaattgaccgaattgtccaaaaaagcccgtgaaggcaagctcaaaccgcaagaaatgcaaggcgcgtgctttaccatttccagcttaggcggcatcggcggcacaggcttcacgccaattgtgaacgctcccgaagtcgccatcttgggcgtgtgcaaatcccaaatcaaacctgtttggaacggcaaagagtttgccccgcgcctgatgtgcccgttgagcctgtccttcgaccaccgtgtcatcgacggtgcggccggtatgcgcttcaccgtattcttggcgaagctgttgaaagacttccgccgcattaccttataaaataaaacatccctctcaagcagtctgataatgtttggattgcttgagattgatgagtaatggtgttaaattcaacctttaaattaataacttatgggaaatttcttatatagaggcattagttgccaacaagatgagcaaaataatggacagttaaaacctaaaggtaataaagctgaagttgcaattcgttatgatggtaagtttaaatatgatggtaaagctacacatggtccaagtgtgaagaatgcagtttacgcccatcaaattgaaacaggtctatatgacggatgttatatatctacgacaacagacaaggaaattgccaagaaatttgcaacaagttccggcatcgaaaatggctatatatatgttttaaatagggatttgtttggtcaatattctatttttgaatatgaggttgaacatccagaaaacccaaatgagaaggaagtaacaatcagagctgaagattgtggctgtattcctgaagaagtgattattgctaaagagttgatagaaattaactaagttgaaaggtcaatataatggctttagttgaattgaaagtgcccgacattggcggacacgaaaatgtagatattatcgcggttgaagtaaacgtgggcgacactattgctgtggacgataccctgattactttggaaaccgataaagcgactatggacgtacctgctgaagttgcaggcgtagtcaaagaagttaaagttaaagtcggcgacaaaatctctgaaggtggtttgattgtcgtcgttgaagctgaaggcacggcagccgctcctaaagccgaagcggctgccgccccggcgcaagaagcccctaaagctgccgctcctgctccgcaagccgcgcaattcggcggttctgccgatgccgagtacgacgtggtcgtattgggtggcggtcccggcggttactccgctgcatttgccgctgccgatgaaggcttgaaagtcgccatcgtcgaacgttacaaaactttgggcggcgtttgcctgaacgtcggctgtatcccttccaaagccttgttgcacaatgccgccgttatcgacgaagtgcgccacttggctgccaacggtatcaaataccccgagccggaactcgacatcgatatgcttcgcgcctacaaagacggcgtagtttcccgcctcacgggcggtttggcaggtatggcgaaaagccgtaaagtggacgttatccaaggcgacgggcaattcttagatccgcaccacttggaagtgtcgctgactgccggcgacgcgtacgaacaggcagcccctaccggcgagaaaaaaatcgttgccttcaaaaactgtatcattgcagcaggcagccgcgtaaccaaactgcctttcattcctgaagatccgcgcatcatcgattccagcggcgcattggctctgaaagaagtaccgggcaaactgctgattatcggcggcggcattatcggcctcgagatgggtacggtttacagcacgctgggttcgcgtttggatgtggttgaaatgatggacggcctgatgcaaggcgcagaccgcgatttggtaaaagtatggcaaaaacaaaacgaataccgttttgacaacattatggtcaacaccaaaaccgttgcagttgagccgaaagaagacggcgtttacgttacctttgaaggcgcgaacgcgcctaaagagccgcaacgctacgatgccgtattggttgccgccggccgcgcgcccaacggcaaactcatcagcgcggaaaaagcaggcgttgccgtaaccgatcgcggcttcatcgaagtggacaaacaaatgcgtaccaatgtgccgcacatctacgccatcggcgacatcgtcggtcagccgatgttggcgcacaaagccgttcacgaaggccacgttgccgccgaaaactgcgccggccacaaagcctacttcgacgcgcgcgtgattccgggcgttgcctacacttcccccgaagtggcgtgggtgggcgaaaccgaactgtccgccaaagcctccggccgcaaaatcaccaaagccaacttcccgtgggcggcttccggccgtgcgattgccaacggttgcgacaacggctttaccaagctgatttttgatgccgaaaccggccgcatcatcggcggcggcattgtcggtccgaacggtggcgatatgatcggcgaagtctgccttgccatcgaaatgggctgcgacgcggcagacatcggcaaaaccatccacccgcacccgaccttgggcgaatccatcggtatggcggcggaagtggcattgggtacttgtaccgacctgcctccgcaaaagaaaaaataaatccgactgaataaacagccgataaggtttatttgagcaaatgccgtctgaaatgttcagacggcattttctattttacagcggattaaaatatcttctccgacctatagtggattaacaaaaatcaggacaaggagacgaagccgcagacagtacaaatagtacggaaccgattcacttggtgcttcagcaccttagagaatcgttctctttgagctaaggcgaggcaacgccgtactggtttaaatttaatccactataaaaacgaatccgacacggcttatctaaaggaatggttgaaaacggcagtttccaatacaacaaaatgccgcctgaacatttcagacggcatttgacccattactgctgcggctctgaaaccataccgccttcatcaaaatccggctccggttcgttttgcaacgttttaccgttcaatttcaactgattgtttttcagagaaatggcagtatcaatctggtcgccgttcaaagtcagatatttttcccttgccatactctgaaccgtactgtccaccatcaggcgcaaggtctcgttgatgtcgtcaagacttgccctgccttccgcctcatcttcggcattgacgctgaaaatattgcctgcttgactgaccgccaagtcttccagcattttttggggaatactcattctgatgtcggcttcggttttcttcagcatcaaacccaattgattcaaatcttccttcttcatgtctttaaacatgatttttccgcccacatcgatttttcccgatggcagcgtgaatcggaaagttttaatgtccaatacgggattgttggtgaacagtccggaagcctctcctttgacggcggcaatcaaatcattgcggatttgttcctcggtcatttttttggcggaaatttgtgcaaacttgcgtttcaatacggttaaggcagaagcatcgaggtgttcggcagcgatatggatgtccagcgggccgtatttttcatcgccgtacaccagtgtatcgaaacggaactgcccttcactgttgataaacgcgcctgattccccggtcttggttgaaaaagccagtttgccgacttcgattttggaaggtgcgatgctgccgttgggattgataaacgcgccaatctgcaaatcggtaacaagattgaccagttcgtttaacttgacgttgtaatcgacaccctctttccattctagggagaatttttccaaggtcagattgctgctgcccaaagcaagcggattgatgccgtctgaagtttccgaatcgaaatgcactttttcaaacgcggcatcgcctttgtctgccagcttgattttaaacaagggggcatcatagccgttccggtagcttttgaaacctttttgataaaccgtttctcccgtcaggccttcccagtgcagcctgatgcccgacagctcttcataatcgaaggcgggaacactgacttccattttaccgctgccgttaaaataaacggtattggcaagggaagccgggacttgttttccaaaaaagcgttccagaactttttccgtttcaggcgcgtatttgaactcggtttcaatgtacgcctgcgtgccgaatccgccggcgaaagggccgtgcgtgatatggttaaccagcgtaaccggctgttccaacactgttttcaggttatccggcaggtattttcgggcattattcagcaactcgggtttcagacggatgaccgtcgtttccatagaggtaaaccagccgcgctcatattggtgcgattcgacggtcaagaagcccgtttcctgcaatattttttgctgctgcgtcaagctttcttcggctttgacacccaaataataaggcgtgcccaaagcaacgccgagcaatgctgccgcaaccgaaatcaaaggttttttcatcacttcaaacaagcaggtttcaaagacgctagaatagcattatttaagcgtatcccgccatatctctttaaaagaaatgccgtctgaaacctgttcggacggcattttccggatatagggaaatcagaaatccaattccgccttcagccagtaagtgcgcggcataccgacgacggcgaagctgcggtcgtattggccgcgctgtacctgccaatagtttttgttgaacaggttttccaccgagctgctgacggtcagagtgtttttgccaagcttggttttgtagcgcgcgcctacgtcaatcaaggtataggacgggaaggcgtattgtttttgcgtgtcttggtcagacttgccgaaatacgaaacattaccgtttaaagtcaagcctttggcaaacggtgtatcccattccaaacctgctttggcaattacgcgcggattggcgacttgtacgccgttaaccagcatatcgcgtgaatttggatactctttcacggtcgattgcagatacatcagacccaaagtcggacgcaaagtattgttgagcaagttcgcgtaggtgttgaactcaataccgcgattgcgttccataccttgctcgtcgccggccgcgccgccttgcgccttatagcgggcgaaatcagaattattgccataggtcagcgttgttgttaccccttttgttgtcttggtagttgtatgaccgcgccagtagcccgggcgtttgatttggaacgcgtttaacgtggttacgaaattgccccagtttttacgcacgcccacttcaaactggcggctgacacgcggtttcgccattgtcgtttcgccggaatcatcggttttgatgtcggcaggctccaagtcttccatatagttgccgtacacaaccaaatcaggttgcggcacccacgccgccatcagcatcgggctgaaacgtttggcatcgccgctctgtgattttttgtcggtatattcgactgtttggaaacgtccgcccaaagtcaggcggtatttgttatccacgaagcccaaggtgtcggacaaagccaggctgttgactttgatattggcatccaagttggcagagttctcccaagaattgggatagtcggctgtaaacgatgccaattgatgctcaatatttccgtttgccttcacttctaccttgctagctccggctgccgttccgcgtgattttttcttattggtgtattcaaccgcttggaaacgtccgcccaaagtcaggacaagcgtccgccggcgttttgaatgtcctgcatacgcgcgcgaccgccgttggttttgcgttttgcgtagatggaatcgaacgctacgcgcagtgtttcgccgcgatagtcggcatttaccgcaaattctttgttgtcttcgctgtaaccgtggcgcggggtgtcgccgtggcgcagtttgccgttggcgcgcacgccgaatgctttgttttcgccgaaacgttggcccaagtcgaacgtaccttgggcgcggttgttgccgaaccgggccaaaccgattttgcggttgccttcatcagcggcttttttggtttcgatattgacggaaccggataccgcgccatcagggttcatgccgtttacggcggtggacgcgccttgaatcagttgtgcggagccgacttgcacgctggtcgtgccttgcgtgccgtacatacctgtcaaaccgttgacgctgaattggcgcgcatcaagctgataacctctgaaatacaatccggtcagcgtgttgctttcgccgccgaactgccaaacggaagcgtcttttttcgctacggcatccaccaaagtacgcgcctcggtgttgttgagggcttgttcgtcgtagttgacgacggtaatcggcgcggtaaaggcgttggctttgcccattcacttggtgcttcagcaccttagagaatcgttctctttgagctaaggcgaggcaacaccgtactggtttttgttaatccactataaacaaatcgtacagggttctccgtttaatcagatatgggtttccatcttcggcagtttcgggcatttagccgtttccaccttcctgcccccgctgccagtaaaaatgccgtctgaaatatcggcgcgatacttcagacggcatacccgcccgttttcccgcattcccgggagcgggctgaaatttaaacgtgtgcggaaatgattttcaacatttgcgccagcactttgggattggcagccacaatatcgccgctttccagccagccgtcttcacccgacatatcggttacgataccgcccgcttcctgaacaatcaatgcaccggcggcaatgtcccacggtttgaggttaaactcgaaaaagccgtcaaaacgtcctgttgctacggcgcacaaatccaaagaagccgcaccttcacgacggccgccggcggtttttgccaagaaatctttcaaaatcgccagatacttgtccatcatgctttgatcgacaacagggaagccggtaccaatcaggcagcggttcagttcgatgcggttggaaacgcggatgcggcggtcgttgagcaacgcgcctttgccacgcgaagccatatatacgtcgttgcgttcgggggcgtaaaccaaagcttcttgcaacacgcctttgtgcagcagcgccatagagatggcgtattggggatgaccgtgaaggaaattggtcgtgccgtcgagcggatcgataatccattcgtactcggctgcggctttgccgtgggagccgctttcttcacaagtgattttgtggtgcggataggcttctttcaaagcctcaaccaggatgatttcggaattgcggtcaacatcggaaacaaaatcgttgaaggctttgctgtcggttttgacggcatcgagattgcccgcggcgcgtatcatcatctgaccggcacggcgggcggctttaaaggctgtattcaaaaacggattcatcagatttccttaagggtggcataccgccggttcggacgtacagtccttcggagcggcaaaatcggagtttatttggttggggtaaatcctgccaaatcgggtaaaataccgcctgacgcgtgtctgcttcaggcgcaacgttaaatttccgacgttgttaaagaacatttcagacggcatttgaccgtccgaacgaaaaagacggcgcattataccctattccattccgaccgaaaaccgaacatgactactctcaaacccgccctgcccgcttatctggacaacatccgcatcatcctcacgcgcaccagccatcccgccaacatcggctctgccgcgcgcgcgatgaaaacaatgggtctgcacaaactgaccatcgtcgccccaaatctgatggcaacgccgatgacggaaaacccgcccgtgtttgacccggagcatcctcaatcgtttaaattaccggaagaaagcttcatcctcgcttccggcgcggcagacgttttggaaaatgccaccattgccgcttctttggacgaagcccttgccgacaccaccatcgcctgcgccctgaccagccgccgccgcgaaattactgcgccgctgcaaaccccgcgcgatttggtatccgaattactgcagaccgcaaaccgaggcgagaaagtggcactggttttcggcaacgagactttcggcttgagcatcgaagaagtccaagcctgcaaccgactgatgaccatcaacggcaatcccgactatttctcgctcaacctcgcccaagccgtgcaggtcgtgtgctacgaaatcttcagccaaaccggttcgcccatgacccatcttcaacaagaagaccacgctgcgacccacgagcaaatcaaaggcatggtcgcccacatggaaagcgtgatgaacgacatcggctttttcaaccgccgcaacggcgagcgtctgatgcgccgtatgcagagcctgttcggccgcgccaatacgcaaaccgaagacatcgatatcctgcgcggttttttcaataccgtcagccaccgtatccataaaaaagactgattaaggccgtctgaaaacatttccagcttttcagacggcatgactgatattcggataagcatgaattacgccctagacgcattatggtggaaacttaccagccaacccgtccgcgaccttgcctcgctgctgactgcgccgcctttgtggcaaagcggctgcgaattgagcgtgcgagaactactgggagaacacggtttccgttaccttttggcattggatgccgatcccacgcggctgacggattacctcgcccaacgcgccccgttcggccaccgtctcggcatttatgccgaagagctgctggctttttggtttgccaatgcaccgcacgccgaactgctcgcgcacaacctcacggtttccggttcggacggcaatacgcaaggcgcggcggattttgtggcaaggcttaacggcaaaccctaccatatcgagctgacctgcaaatattacggcggcgacacggacagtcccgaagggatgcgcggattcgaccccaaagacacgctgttgggaaaagccgccaaactgaccgcccaactcggtctgccgcacacttcagacggcatccggaccttgcggcagcacggtttgccgcttaacgtaaaacccgtttccatcgtgcgcggcatcggattttttccacacggtttccatgcttttgagccaccgcttaatccatacggttggcgcggcatctatattcaagattgggcggaatacgggtttaaacgccaagaagtccgctaccatctgctcgaccgtatggcctacctcgcgcctgcgcgtgtcgccgaaaccgaaacattgaacgcaaccgaaatccgccgtatcgaccaaggcttgattgccgttttggaatgtcggccggacggcttttggcacgaaatcgaacgcattatgaaggccgtctgaaaccctttcccaacattaacgcgtatatctattgagaggcttagtgatggaaatctcatttcccatacaatttatgaaagagtcatccgagttaataaggatattggatatgataaatataacaacaacatgccaactaatattatgacgatccaaacaaataagtatggtaatttaataactacgaccccaggtagaatacaatgaagaataatgttaaaaattggacaactaaagaagtcaagcaatcattagataaatttaataatattttaattaaaaatacttttcttcttcagtatctgaaaaaagagttttcagcttcaagtgcttattgtttgtctatgctccctgaagaagaagatatatatgaaatattggttaatgggaatattattattgatttagaatttaataaacatacaaatgaaacagttgttattaatgttactgatgttgatgaatacttgaaaactttaaccaatgagagtggtagagtattttttacattagcaaaagaaatcggcaaacagaaaaacatttaacaagagcgaaatacaaattaaaaactcaatggagtgatggcatatttaggatagatatactgaacgaagaaaataaattttgtttttttcctcatgttttagggagtgattacaaaatgaaatcgctgatgtgattatatcggatgctgttcaagcgacctgaaaatagaacttttttcaggctgcctttgtagttaacggagaaatttagacaaatcccgattgcgcacttttaacacatctttcttattgcggatagaatactaagtaatgataaagatgctattgttattttaaggacgttagattgattatgaataacccacagtaagagaacccattacattatgaacgccgcacaactcgaccataccgccaaagttttggctgaaatgctgactttcaaacagcctgccgatgccgtcctctccgcctatttccgcgaacacaaaaagctcggcagtcaagatcgccacgaaatcgccgaaaccgcctttgccgcgctgcgccactatcaaaaaatcagtaccgccctacgccgtccgcacgcgcagccgcgcaaagccgctctcgccgcactggttctcggcagaagcaccaacatcagccaaatcaaagacctgcttgatgaagaagaaacagcgttcctcggcaatttgaaagcccgtaaaaccgagttttcagacagcctgaataccgccgcagaattgccgcaatggctggtggaacaactgaaacagcattggcgcgaagaagaaatcctcgctttcggccgcagcatcaaccagcctgccccgctcgacatccgcgtcaacactttgaaaggcaaacgcgataaagtgctgccgctgttgcaagccgaaagtgccgatgcagaggcaacgccttattcgccttggggcatccgcctgaaaaacaaaatcgcgcttaacaaacacgaactgtttttagacggcacactggaagtccaagacgaaggcagccagctgcttgccttattggtgggcgcaaaacgaggcgaaatcattgtcgatttctgtgccggtgccggcggtaaaaccttggctgtcggtgcgcaaatggcgaacaaaggcagaatctacgccttcgatatcgccgaaaaacgccttgccaacctcaaaccgcgtatgacccgcgccggactgaccaatatccaccccgaacgcatcggcagcgaacacgatgcccgtatcgcccgactggcaggcaaagccgaccgtgtgttggtggacgcgccctgctccggtttgggcactttacgccgcaatcccgacctcaaataccgccaatccgccgaaaccgtcgccaaccttttggaacagcaacacagcatcctcgatgccgcctccaaactggtaaaaccgcaaggacgtttggtgtacgccacttgcagcatcctgcccgaagaaaacgagctgcaagtcgaacgtttcctgtccgaacatcccgaatttgaacccgtcaactgcgccgaactgcttgccggtttgaaaatcgatttggataccggcaaatacctgcgcctcaactccgcccgacaccaaaccgacggcttcttcgccgccgtattgcaacgcaaataaaccggtttgaacaaaatgccgtctgaacccttttcaaagcgttcagacggcatttcatcaattatagtggattaacaaaaatcagtacggcgttgcctcgccttagctcaaagagaacgattctctaaggtgctgaagcaccaagtgaatcggttccgtactgtttgtactgtctgcggcttcgtcgccttgtcctgatttttgttaatccactatatttttgggaatctgttttaccccaatatataaagcaccatattaaggcggagtgtcttccccactttgacccgaacccggaaaagacaccgcccaagccaatcctgatgctgccccgacagccaaccattaaggaaatcctaatgaactttgctttatccgtcattatgttgaccctcgcctctttcctgcccgtcccgcctgccggagccgccgtctttacttggaaggacggcggcggcaacagctattcggatgtaccgaaacagcttcatcccgaccaaagccaaatcttaaacctgcggacgcgccaaaccaaaccggcggtcaaacccgcccaagccgacgcagggaagcgcacagacggcgcggcacaggaaaacaatcccgacactgccgagaaaaaccggcagcttgaggaagaaaagaaaagaattgccgaaaccgaacggcagaacaaagaagaaaactgccggatttcaaaaatgaacctgaaggcggtgggaaattcaaatgcaaaaaacaaggatgatttgattcggaaatacaataacgccgtaaacaaatactgccgttaatcggctctagcgcaaacccgatgccgtctgaagcggcacggggtttgtcatttctgccagtaggttttgacgttgacgaactcgtacagcccgaattcggacaattcgcgcccgtaaccggaatctttgactccgccgaaaggcaggcgcaaatcgctgctggtatggcggttgataaacaccgatcccgcctgtattttttcggcaaaccgccaagcgcgttcggtatcggcggtataaatgcaggcaccgagcccgaacggggaatcattggcaagggcgatggcatgttcttcgttttcggcgcgcaaaatcagggcggccggcccgaatacttcttctctccagacgcggcaggcaggatttaccctgtctaaaaccgtcgcgggataaaaccagcctcgcccttgtgggatttttccgccggtcaggcataccgcgccgtttgaaacggcatcttcaacctgcccgtgaaccctgtcccgcaaatcttcgcggtgcagcggtgcaagcgtagtatcgggatgtttggggtcgcccattttcaatttagcgcattcggcaagaaacagcgtgataaaacgatcggctgcggcttcggttacgatgatgcgcttggcggcgttacacgattgccccgcatcgcggaaacgggaataacaggcttctgcggcggcacgctccaaatcagcatcgggcatcacgataaaggcgttgctaccgccgagctccaacacggttttcttaaggtttgcgcccgcgtgtgccgcaaggatgcgccccgtatgcgttgaaccggtaaacgccattgcatcggtatcttcaaccgccttgagcgtgcccgcctcatccagccacacgcctgccagaggaatgccgtctgaagccaaatcgaacagtgcctgactgacgcgtgccacgctgggcgcgggtttgacggcgcacgcgttgcccgcgcacatagcgggaacggcgaaacgcaatacctgccagacgggatagttccaaggcatgacggcaaacaccacgcccaaaggctcgaagcgcacctgactcaaactcgcctgcgtcgcgatggttttgtgggcaagcagttcgggggcaaggcgggcgtaatagcgtatcagttcgatagacttgccgatttccgcacggcattcgtgcaagcagcgtccgacttcctcacacaccatttccgcaaaacgctctttctccgcctccaaacggtcggcaaatttttgcaggcgcgcggcacgttcggttacgcccagttgcgcgaacgccccgccgcgcattttcaaatccgccagccgccgttcaaactccgcataatcttgagcggggcggcggtaaagcgtttcgcccgtaaatacattgacactgtgaaacatcgaatcaacctgccagttgcgggaatatcgttttcagtcccgacacaataatctccaccgataccgccgccagcatcatacccataatgcggtttaaaatcgtcagccccgtcgcgcccagcaggcggctgaccttcccggcaacgattaaaatggcataacaaatcgcactgaccaccaaaccggccgcgataatcaacgcgatgtcgccgtatgttttagccgccgaagcgtaaataatcacggtcgaaataccgcccgggccgatggtgatcggtatggcgatgggcacgacggcaatcgctccggcattgcgggcggggcgcgcctgccccgtttccggctgcgcgccgagattctgcttggcgggattgtcgttgccgttcatcatcgaaatggcgatcagcagcaccaaaatcccgccgccgacctgaaacgaaccgacgctgatgcccaaaaccttcagcagcgtaccgccgatcagcgcaaataccgcaatcacggcaaacacggcaacggcggccgtccgcgcgaccttcctgcgctccttcgtgctgtgcccgttggtcaggtcaaggtaaagcgacaacgcgctaaacggattaatcagcaccaaaaaagccacaatcagcttgccgatttccatgcccaatcccattatttccccctccttcaaacccgtgcggcaggcatccgatgctgcaaattgccgccgcaacggatttttccgttataattaaaaattcaagcaatacgccccatcatacccgaacgacggtatctttaccatcagacaaggatgcttttcatggcactgacacttgccgacgtagacaaaatcgcccgactctcccgactgcacctgactgcggaagaaaaagaaaaatcgcttcaagaattaaacgacattttcactatggtcgaacagatgcaaaccattaacacagacggcatcgaaccgatggcgcacccgcacgaggccgccctgcgcctgcgcgaagacgaagtaaccgaaaccgaccgcgccgccgaatatcaggcgggtgctccggaagtacgcaaccgtctgtacatcgtaccgcaagttatcgaagaataatccgaatatgcttcagacggcatcagcaataccgcccgaagccctttaaggatggaagatttatgacccaatacacattgaaacaggcaagcgtcctgttgcagtccaaacagatttccgccgtcgaactggcaagcgcataccttgccgccatcgccgaaaaaaatcccgccctcaacggctatatcaccatcgaccaagataaaacccttgcagaagcccgtgccgccgacgaacgtatcgcgcagggcaacgcctccgcgcttaccggcgtacccgtcgcctacaaggatattttctgccaaaccggctggcgcagcgcgtgcgcttccaaaatgctcgacaacttcatctccccctacaccgccaccgtcgtccaaaacctgctcgacgaaggtatggtaacgctcggccgcaccaatatggatgagttcgctatgggttcgaccaatgaaaactcattctacggtgcagccaaaaacccatggaatcttgagcacgtccccggcggttcgtcaggcggttccgccgccgtcgttgccgcgcgcctcgcccctgccgcgctcggttcggacaccggcggctctatccgccaacccgcatcgcactgcggcattaccggcatcaaacccacatacggcacggtttcccgcttcggtatggtcgcctacgcctccagcttcgatcaaaccggcccgatggcgcaaactgccgaagactgcgcgattctgttaaacgcgatggcaggtttcgaccccaaagactccaccagcctcgagcgcgaaaaagaagactacacccgcgatttgaaccaaccgctcaaaggtttgaaaatcggcctgcccaaagaatatttcggcgaaggcaacagcgccgatgttctgacggcattgcaaaacaccattgatttgctgaaagcccaaggcgcggaattgattgaagtttccctgccgcaaaccaagctgtccatccccgcctactacgtcctcgcctccgcagaagccagcaccaacctttcacgttacgacggcgtacgttacggacaccgtgccgcccaattcgccgatttggaagaaatgtacggcaaaacccgcgccgaaggtttcggcagcgaagtcaaacgccgcatcatgatcggcacttatgtactgtcgcacggctactacgatgcctactatctcaaagcccaaaaactgcgccgcctcgttgccgatgattttcagacggcatttgcacggtgcgacctcatcctcgcgccgaccgcacccactgcagccccaaaaatcggagcggatgcttcgccggttgaaacctacttgagcgatatctacaccatcgccgtcaacctcgccggactgcccgcattgaccctgcccgcaggcttcagcggcggcggactgcccgtcggcgttcagcttgtcggcaactacttcgccgaagccaaaatcctcggtgcggcgcatcaaatccaactcaacagcgattggcacggcaaacgacccgaatgaagcagaaccgcacctttaccttccccgattttcgcaccgtttacagctatgcgcctttatatcggctgcaacatttaaaatacacattgcgaaaatttttcggaaaaaaagaaatttacgccttcgagcagtttgtcaacgcatcccctatccgtcaggggctgttcctccactgcccgcaaaatgcctatccgctgctgcgcgaatttgttgacaggcgttttaactgcaaacgccgtttagatgcgatgacggcagattttctcatggcggaaaaactgttcggcacagacatcctgcaccaaatggaagactaccgcttccatttggtcttggcgcacctttcagacggcatcagcttgtggctcaaccgcaacgacaactgcgtcgaagaaggcgcgtggtctttatctttgcgcgacgaagcaggcaaccggctgtatatggcgactttcgcctttgtcggcacacacctgctgacagcctccgtacaagggccggcgggtgaagaagccaaagacaccgtccgccgcataaccaaacaactccacggcttgcgtccccaacaactgatggtaaccgccctgcaatatttcgccgccgtactcggcttggacggcgcaatgggcattgcacaaaaacatcaggtcaaactgcgctggaaacttaaaaagcgcgtcaaaatgaattacgacgcattctggcaggaatacggcgcaagtttggaacgggacggctactggcatctcccccaaacccccgcccgcaaagaccttgccgacatcgaaagcaaaaagcgttcgatgtaccgcaagcgttatgaaatgctggacaatatggttgcagagatgaaagacagtctgaaaacagaagcacgcggcatttcagacggcatccaaacggaaaaaccgccccgccggacagcctgacgcgaagactatcgaattgatattttagagaaagaagctcttatgacctgggaaaccgtaatcggcttggaaatccacgtccaattgaacaccaaatccaaaatcttcagcggcgcatcgaccgcattcggcgcagaacccaacgcgcacgccagcgtagtggaatgcgcgctgccgggcgttttgcctgtgatgaaccgtgaagtcgttgaaaaagccatcaaattgggtttggctttagatgcgaaaatcaatcagaaaaacgtgttcgaccgcaaaaactacttctatcccgacttaccaaaaggttatcaaatcagccagttggacttaccgattgtcgaacacggcaaattggaaatcgtagtcggcgacgatgtgaaaaccatcaacgtaacccgtgcgcacatggaagaagacgcaggcaagtccgtgcatgaaggcttgaacggcgcaaccggtatcgacctgaaccgcgccggcacgccgctgttggaagtggtatccgaacctgaaatgcgttccgccgccgaagccgttgcctacgccaaggccttgcacagcttggtaacctggctggacatttgcgacggcaatatggcggaaggctcgttccgcgtcgatgccaacgtatccgtgcgcccgaaaggtcaagaagagttcggcacgcgccgcgagattaaaaacctcaattccttccgtttcttggagcaggcgattaattacgaagcggaagcgcaaatcgagattttggaagacggcggcaaagtacagcaggcaaccatgctgtttgatcccgaaaaaggcgaaacccgcgtaatgcgcctgaaagaagatgcgcacgactaccgctacttccccgaccctgatttgctgcccgttatcatttcagacgcccaaatgcaaaaagccaaagcagaaatgcccgagctgccgaaagaaatggcagcgcgtttcgtggcggattacggcgtgtccgaatacgacgcgcgcctgctgaccgcaagccgtgcgcaggctgcctattttgaagaagccgccaaagaaagcggacaaggcaagctgactgccaactggatgaacggcgaacttgccgccgcgctgaacaaagaaggcatggaacttgccgacagcccgattaccgccccgcgcctcgccgcgctggttggcaaaatcgccgacggcacattaagcagcaagttagcgaaaaaagcctttgaagccatgtgggcagaacccgaagccaccattgccgaaatcattgaaaaacacggtttgcaacagatgaccgacaccggcgagattgaagccatggtggacgaagtgctggcaaacaacgccaaagccgtggaacagtttaaatccggcaacgaaaaagccctgaatgcgattgtgggacaagtgatgaaggccagcaaaggcaaagccaaccccgcgcaggttcaagagctgattaaagccaaactggcttaatccgttatcacacaggtcgtctgaaagcaaagttccaacgaaggtaaaacaggaaataagctttcagacggccttttatagtggattaaatttaaaccagtacggcgttgcctcgccttgccgtactatttgtactgtctgcggcttcgtcgccttgtcctgatttaaatttaatccactataacttaatctgctcaaaccataccaagacatgaaccacaccgttaccctgcccgaccaaaccacctttgccgccaacgacggcgaaaccgttttgaccgctgccgcccgtcaaaacctcaacctgccccattcctgcaaaagcggtgtctgcggacaatgcaaagccgaactggtcagcggcgatattcaaatgggcggacactcggaacaggctttatccgaagcagaaaaagcgcaaggcaagattttgatgtgctgcaccactgcgcaaagcgatatcaacatcaacatccccggctacaaagccgatgccctacccgtccgcaccctgcccgcacgcatcgaaagtattattttcaaacacgatgtcgccctcctgaaacttgccctgcccaaagccccgccgtttgccttctacgccgggcaatacattgatttactgctgccgggcaacgtcagccgcagctactccatcgccaatttacccgaccaagaaggcattttggaactgcacatccgcaggcacgaaaacggtgtctgctcggaaatgattttcggcagcgaacccaaagtcaaagaaaaaggcatcgtccgcgttaaaggcccgctcggttcgtttaccttgcaggaagacagcggcaaacccgtcatcctgctggcaaccggcacaggctacgcccccatccgcagcatcctgctcgaccttatccgccaaggcagcaaccgcgccgtccatttctactggggcgcgcgtcatcaggatgatttgtatgccctcgaagaagcacaagggttggcatgccgtctgaaaaacgcctgcttcacccccgtattgtcccgccccggagagggctggcagggaagaaatggtcacgtacaagacatcgcggcacaagaccaccccgacctgtcggaatacgaagtatttgcctgcggttctccggccatgaccgaacaaacaaagaatctgtttgtgcaacagcataagctgccggaaaacttgtttttctccgacgcattcacgccgtccgcatcataattccccggtataaagaggattcgagctttccgttcagaacacaaaaaacttcccgtccgtgttttccccgtgaaaaaatgccgtctgaaacccgattccggttttcagacggcatatgttttttcctgttcaaggcgacagccgctcgcgtatccagccaccatccagcaaacggtattggatgcggtcgtgcagcctgctcggtctgccctgccagaactcaagcaaatcgggaatcacaatatagccgccccaatgcggcggacgcggcacatgcagaggatgtttgagtccaaccgccgccgcctttgccaccaataccgccttgttcggaataacctcgctctgcgcacttgcccacgcacccaaacggctctgatacgggcgactctcaaaatattcgtccgacaacttctccgccagcctttcaacacgcccttccacgcgcacctgacgctccagctccggccaaaaaaacgtcatcgccgcaaatggatgagcatccagcgaacgccccttgcggctgtgataattcgtaaagaaaacaaaaccttcagaattaacttccttcagcagcaccatacggctgttgggcctgccgcgtccgtcaaccgccgccacattgaccgccgtcggctcgttgacctgtgcgcgtaccgcctcgtccaaccaccgctcgaactgctcgatcggattatcggcgcaatcggcttccgacaattcccgtttgctgtaatcttcccgaatattgtgcaaatccatttactgctcctcttatcatttgaaagattctactcccgcacgcaaaccgatttcaaccgtcgcacaaactttgccccgaccccaagccgcagcgacgatttcatccgcaaaaccgccgcatcaggtacaatatcgaaccgtccgaccgaggacggcattttatcaacccgtcctgccgcacacgccgcagaagaaccgccttatcaggcgagttaggaaaaatgatgtccaaacagcccaccagcaaacgccaatggcgcgacggcgcagccccgtctgccaagaaaaccgccaaaccgttcaaaagcaaagcccgtcccaaagatgaaacgggcaaaaccgcttcccaaccttacggacaaaaagcttcagacggcatcaaacctcaaaacgtccccaaacagcgcgccgccaaagccaaaaaactcgtcgtccgcaatcccaaccaaaaaattatggaacacgcgcgcgatttgaaagaacgccgcagcgacctgtcgcgcatggaacccgaacgcctgcaaaaagtgcttgccgcgtccggcgtcggctcgcgccgcgaaatggaagaatggattaccaacggctggataacggtcaacggcaaaaccgcgcaactgggcgacaaagttacccccgacgaccacgttaccgtcaaaggcagcatcatcaagctcaaatgggcggaccgcctgccgcgcatcatcctgtattacaaacaagaaggcgaaatcgtttcccgtgacgacccgcaaggccgcgtcagcatattcgaccgcctgccgcaggccgccagcagccgctgggtcgccatcggacgcttggacatcaacaccagcggacttctgattcttaccacctccggcgaactcgtccaacgtttcgcccaccccagcttcgaagtcgaacgcgaatacgccgtgcgcgtcttgggcgggctgaccggcgaacaaatgcgcgtcctcaccgaagaaggcgtgatgctcgaagacggcttggcaaaagtcgaacgcatccgcgaacaaggcggcgaaggcgcgaacaaatggtacaacgtcgtgattaaagaaggccgcaaccgcgaagtgcgccgcatttttgaaagccaaggactcaccgtcagccgcctcgtgcgcatcggcttcggtcccatcggactgcccaaccgcctcaaacgcgggcagttctacgaactcaaccccgccgaagtcgccaacatcatcaaatgggcggacatgctgctgccgggcgaacgccgccgcaaaaaagcctaaacccgccaaaacacaaaaatgccgtctgaaacatctgctgtttcagacggcattttattcgggcgttttcaggagaaaaggtcgagtgctttgacaaagaccatcaccacgccgtaggcgagcggtatgacggccaatgcccaacgccaccagaccgatatgccgccgccggaaactttttcgcccacaaggtaagcgtcggatatggcggtttcgtcatcggggttgccgctgtgtgcggcggttttgatgtctttttcgtggtgtttttcgtgtacggatttgacggcgaggttgcacaacaaaccgataatcagcaggcacgccatgatgtacatggttacgctgtatgcctgtgccgccggtatgccgctgtcgatttggctttggcgtatgtaattgaccagtaccgggccgatgacggcggcggttgaccaggccagcaggatgcgtccgtgaatcgcgccgacctgataggtgccgaacaggtctttcaggtaggcgggaatggcggcaaatccgccgccgtacatggaaataatcacgcaaaagccgatgatgaacagggctttgctgccgccctcgccgatggagggaacggcgaaatacagcagcgaaccgagtacgaagaagatggtgtaggtgtttttgcgtccgattttgtcggaaacgctcgaccacaaaaagcgtccgcccatgttaaacaggctcaggaggctgacgaagcctgccgccgcacctgcgccgactgctgcctgcctgcctatggaggtttcggaaaagagttcctgaatcatcacggatgcctgacccaatacgccgatgccggcagttacgttcaggcacaatacccagaacaacagccaaaactgcggcgttttcatggcttgggacacgttgacatgattgctgctgaccagcttgttttgcgttttcggcgcggtatagccttcaggtttccagccgtcggcaggtacgcggatggtaaacgcgccgaacatcatcagtgcgaggtaaagcagacccaatacggcgaaggtttcggcaaccccgaccgaagcagcgtttgaaaaggtgttcatcagtgatacggaaagcggcgaggccagcattgcgccgccaccgaaacccataatcgccaaaccggtcgccatacccggcttgtcgggaaaccatttcatcagtgtggaaaccggcccgatgtagcccaaacccaagcctacgccgccgatgacgccgttgcccaaatagagcaggaagaggttgtgcgtacgcacgccgaatgcggatacgaagaagcccaggctgaagcagcaggcggcggcaaatatggctttgcgcggccctacccgttccatccacgtaccgaacagggcggccgacgcgcccagcatcgcgagtgcgatactgaaaatccaacctacggtcgtcagcttccaatctccggccgccgattcggttatgccgataagtttggtcagcggcgcgttgaatacggaataggcgtaaatctgcccgatggcaaggtgtaccgccaatgctgcgggcggtacgagccaacggttgaaacccggcttggcaatgcttgcctcacggtctaaaaacttcataacatcctctttctgtcagttgaaaaataaaatttcatttgcccaatggaaacttattgaaaattataaaaaaatatcgggtcgggtttttatccgccccaagatgcgccgtctgaaacatttcgggtgtacggaaaggtttctgttttttccgacaaattcctgcggcttttcgcttccggattcccgctttttcaggaatgacgaattaaagattatcttaaggtcaagggactggattcccgctttcgcgggaatgacggcggcgggggagcggtttttccgattgggtttaaatgcaatcgaacaaatcctgctgcccttgttctttgcttacgcgcacgtcggtttcgccgtcggcgaagataatgtgcagcttctgcccctgcttcaaaacatcggcgttgcggatgacttgtccgcgtgtgtttttgacgacggaaaagccgcgctccagaatgtgctgcggcgaaacggcttcgagcaatgcggcttgggcagtcaggctttggcggcggtgggtaagcagttggtggaaggcgtgcgacagggccgtctgaaagcggtcgatgttttttttgcaaacggaaacatcaggacggcaatgtttcagggcttgggtttggcgttcgaaacgggcggtgtgggtacggacgttttgcgtcatcgagtaagacagcgtttgcgccagcttgccgattgaagcgcgctgttcgtcgagtttttggcgcggatgacggatttgccgcgccagccagtcgagtttttggctggcatcgaaatagcgttgttccaaaacggttttcagacggcattgggcttgggcgaggcggtgcagcgattcttggcggttggggctgaccagttccgccgcaccggtcggcgtgggcgcgcgcatatcggcgacgaaatcggcgagcgtgaaatcggtttcgtggcctacgccgctgacgaccggaaccgtgcaggattcgatggcgcgcacgaccggttcttcgttaaacgcccacaagtcttcaatgctgccgccgccgcgacagacaatcaacacatcgcattcggcgcgttgcgaggcggttttaatcgcttgggcaatttgcaattcgctgcctgcgccttgaacgggtgtcggataaacgataacggggatttcgggtgcgcggcgtttcaaggtagtaacgacatcgcgcaaagccgccgccgccagactggttacgatgccgatacattgcggacggacgggcaaaggtttcttgcgttccgccgcaaacgcgccttccgcctgcaactgcgccttcaaccgctcataggcttcgtaaagctgccccaaacctttgagccgtacttcgtttacggtaatctgaaattcgccccgcgcttcataaatactgatttttcctgatacctcgatatggtcgccttctttcaaaggcttcgccaaacgcaccgccgcacccttgaacatcgcgcaacgcacctgtgcgcggctgtctttgagcgagaaataataatgcccgctggcggcacgggtcaggttggatacttcgccggcaatccacaaaccggcaaggtggttttccaaaagacttttggcaaatgcgttcaactcggaaacggacaacacgtcagaatgaaaaaaatcagacatcgaatcaatcaaatagtaaaaaatatgaatatgttttgaagcctaaggcggcaccgggccgcctaaattgtcaacaatattataacacgcgccatcttgccgcccgccttttcccgtatgacttttttaagcggggaatgggaaaaatattcatcaacctgcctgcaatctattcaaattgcaccgccggcaggctatgatgcggatattttcgacaggaggaaaaatggatacgcaggcagttatcacacatatcgcccgatggttggacgaatacgccgcccgggcaaatgcaaaagggtttgtcgtgggcgtttccggcggcatcgattccgccgtcgtctccgcactcgccgcccgcaccggccgccccacgctgcttctggatatgccgatacgccaacaccccggccagcttgagcgggcaaggctgcacatccgcaatctgcaacggcaatatgccaatgtaagcgcgcaaacggtcgatctgaccgacaccttccagacctttgaacaaaccgtcggtgctcatcagacggcatttgacagtcagccgctttccctcgccaacgccagaagccgcctacgtatgctgaccctgtactactacgggcagatacacggactgctggttacggggacaggtaataagattgaagatttcggcgtgggcttttttactaaatacggcgacggcggcgtggacatcagcccgattgccgacctgaccaaaacgcaggtttaccggcttgccgaagcattgggcgtggacgaggcgattcaaaaagccccgccgaccgacggcctgtgggatacggaacgcaccgacgaagaacagatgggcgcaagctatcccgaactggagtgggcaatgggcgtgtacggcacgcgcaaacccgaagattttgaagggcggcagcgcgaagttctagaaatctatacgcgacttcaccgcgccatgcagcacaaaatcaacccgattcccgtatgccgcattccgcccgaattgctgggctgaaacacggaaatgccgtctgaaacggaaaaccgtatttcagacggcatggaaatatccgactcctatcccttaagaatcgagtacgcgggcaaacaaaatatcgttttccaaatgaatgtggtcgttcaaatcctccaccatttctttcgccagcgcgtaaagccgcgtccagcttccgcaagccccttctggcggttggaaattgtcggtcagctctttgagccgtgcgatggcgcggtcgtgttcttcgtgttcgtgcatcatcacgccgatgggcatcgccgcaccgcgtccgacaccctgattaatcatcggaaacagcatcctttcctctttcatcatatgcatcagcagttcgttctgcatataggcaagcagctcggcaatttccgccggaaaggtgtcggcatgaacttgggccactttttgcgccagcggcaccaattcttcaaattgtgcacggtggacattgtggtagcgttgcaggatatgatcgacggttgcaccaaagggggcggtctcccaaacggaaaaatcagtcatcgcagtgttccttttacagggtttcgggtttggttttgaacattcatactttaagaatcaattcaaacggagcatacaccgcccgcgcgcttctgtacagcctcaaacgtattccttacattttgataataaaagtaattttcagaaataaaatactgtccgaaccgttttttagaatttgcaaaggcgattggggcggtacagaaaaactattatcccgcccgcccacttgaaatttttatgcccaagccctatcctgcacgctatcgtgccaatcccaaccgaaaaggaaaaataatgagcagcgaattgattgtacacaccagcgatgccgcttttgaaaaagacgttttaaatgcagatatccccgtcctgctggacttttgggctccgtggtgcggcccctgcaaaatgattgccccgattttggacgacattgccgccgaatttgaaggccgtctgaaagtggtcaaaatcaacatcgacgacaacgaagccaccccgtcccgtttcggcgtgcgcggcattccgaccctgatggtgttcaaaaacggcgaagtcgtcgccaccaaagtcggcgcattggcaaaaggtcagctgaccgcctttgtcgaagcctctatcgcctgataaagcgcaatcgaaaaagccgccggaagattccggcggctttttcgcacccttaagatttgtggcggatttcccagcacctatggatttttttgttgcggaaatcttcgggaacggattgtttggaaatgtctttgacggcgtattgttccgataccaagtcgtctaagacgaagctgcgcaggttgttggaaaagtacaaaatgccgtctgaagcgagcagcttcaccgcgccgtcaatcagctttttgtggtcgcgctggatgtcgaggatgtcggacattttcttgctgttggaaaaactgggcgggtccatcacaatgaggtcgaaccgcctgccttccccatatgccgtctgaagatattggaacacgtcggcgcggacgattttgtgtcgttccgtatcgatgccgttcaattcaaaattgcgtttcgcccaatcaagatatgtgttggacaaatcgacggtttcgctggatgccgcgccgccggtggcggcatagacggtgaagctgccggtgtaggaaaacaggtttaaaaaacgtttgcccgccgccgtttcgccgacttttttgcgcgtgtttcgatgatccaaaaaaagccccgtatccaaatacttatcaaggttgacccaaaacttgcggccgttttcggtgatgacgaaatcgtcgcccgccttgccggttttctcgtactgctgcaaacctttttggcgttcgcggcgtttgaggcggatttgttcgggcgcaaaaccggtaacgaaagcgacggcttccaagacttcggcaagccacgcttcgtattcttcgggccgcatcagccagccggtatcgtattcctgaaggtggattcgatcgccgtaaacatcggcggcaaaggggaattgggggatgtcgcggtcgtaaatgcgccaggcttcgatgccgttgcgtttcgcccatttcataaggtgtttgatgtttttgcccaagcggttggcaaacggtgtgatgtcggtcattggtttcaggcggaataaagtggaaaacggcaattttactgtaattaacgcccgattgcttgaccgtttcgggcaaaccctataccatccgtcgcttatcttgtcatacgaagccatcgccttccaacctaaaccgcccttacgggcgcgtttcttctgttgctttgattttgcaaagcatatctgtgcaggttgccgtcgatgtaaaccacaagcaagccgcttgcgacaaccctgtaacttcacattccccgtatcgttacccttccctgcttcaggccgtctgaacctttcggacgcgggcgttgttgtcttccaaggatagccatgtctattaaatttgccgatttgaaccttgataaaaacattttgtccgccgtcagcagcgagggttacgaaagcccgacgccgattcaggcgcaagccattccgtttgctttggaaggccgcgacatcatggcttcggcgcaaaccggctccggcaaaaccgccgcctttctgttaccgactttgcaaaaactgaccaaacgcagcgaaaaaccgggcaaaggcccgcgtgctttggtgttgaccccgacccgcgaactggcggctcaagtcgagaaaaacgcgctggcgtatgccaaaaatatgcgttggttccgcaccgtcagcatcgtcggcggcgcgtctttcggctaccaaacccgtgccctgagcaaaccggtcgatctgattgtcgccacgccgggccgtctgatggacctgatgcaaagcggcaaagttgattttgaacgtttggaagtgctgattttggacgaagccgaccgtatgttggatatgggctttatcgacgacatcgaaaccatcgtggaagcaacgccgagcgaccgtcagactttgttgttctccgccacttgggacggcgcggtcggcaaactggcgcgcaaactgaccaaagaccctgaaatcatcgaagtcgaacgcgtggacgatcaaggcaaaatcgaagaacaactgctgtactgcgacgatatgcgccacaaaaaccgcctgctcgatcatatcttgcgcgatgccaatatcgatcaatgcgtgattttcacgtccaccaaagccatgaccgaagtcattgcggatgaactgtacgaaaaaggtttcgccgcaaactgcctgcacggcgatatgccgcaaggctggcgcaaccgcacgctgatggatttgcgtaaaggccgctgcaaaattttggttgccaccgatgttgccgcacgcggtatcgacgtaccgaccattacccacgttatcaactacgacctgccgaaacaggcggaagactacgtccaccgcatcgggcgcaccggccgcgcaggccgcacgggtattgcgattacgtttgccgaagtgaacgaatacgtcaaagtccacaaaatcgaaaaatacattaaccgaaaactgcccgaactgaccatcgaaggcatggaaccgacccgcaaacgcaaatccgcaggcggcaagccgaaaggcaaaggcggctggggcgatcgtaaatccggcggttggcgcggcgatcataaaccgagcaaagaaggcttcggcggcaaaacgcgcggcgaaggtttcaagaaagaaggctttaagagagacggtttcaaaaaaaccggcgaaggcttcaaaggcaaacgcaaagccggcgattcttttgcaggcaaaggcgaacgccgttacaaagaccgctaagccccaacctgccgcataaaccaatgccgtctgaaaccgatttcgagtttcagacggcatttttgcaatgtttcagcaccgcccggctttgatacccaaaggattaggctgtaataaaaacccttttccgctttggcaacgattgaaaatttccgtaaattcaaatatctagattccttcctgcacgggaatgacacggaagggtttcagatgcagggtgggcattcctgcccacccaatcccgcccttgcaacggtgggcaagaatgctcgccctacggcttgactgttcgatatgatgccgtctgaaaacccaacggcggcatgacaatgccaccctgccaacgcacgtaaatcagaattgccatcccgacatcaaacgcttggaaacaaaatgccgtctgaaaatcaaacggcaacataacaatgtccctaacaaatgcaaaaatgccgtctgaaagctcttcagacggcattggcgcgccgggtttaccgcctcctgccgaaaccgcgcatagcggggcggcggtaattggcgggcgggcgcgttgtcgggcggtaacgctgcgcctgcgccgcctgttgttttgcacggaggctgcgcgtgttcaaatccctgctggtgcgcgcattggggcgtgcggactgatggtaggctgcacgcgcgcgccgggcgacgggactgtcttggttgcctgcccgtgtgaatttgtttgccagcgcgttgccgataaacgcgcctgccgccgcgccgaccaggctttgcagcagccagcttcctgtcgattggtcgtaaatatactgctgcccgtctttaccggtaacgggttgcccgttgttgccgtttgcctgtgcttcggcaggaatggtgtctttgactgcttcgggagtcagttggtaaaccgtatcgtctgcctgctgtgcgagctgctgttgcagggcttcaatctgtttctgctgctgttcgagccgcgcctgcgtgtcgtcttggcaggcggcgagtgcgaatgttgcgataagcgcggaggcgatgatttttttcatgtgtgtcctgtttgggtggaaaatcggttttattgtatcgccgtcgggaattttggcaagcattctgccggcaaatcgtgatgtttacaggggcagggtgtgcaatttgcggacaaatgcgaggctgttggcgactgggttgcctttgttttcgacttcgtgttcggtttctacggtcagcaggcggcggtttttgtgtttgttcaggctcaattcggcttgtgcgggtgtgaaaaacaggcggtgtttttcggcaaagcggcgggcgcggctgttggcggttttcaaaatctgaagcagcgatacgtccagatggaagcgtcgcacgcccaatacgagaatccgtgcggcaaaaaaatcggcggcatcggtaaactcggcggggctgctgcggctgaagtcgtgccgttcggcggctatcagggcggcaacggtgcggatttgcggaatcatcgattcgctgataagtgtgtcgtcccgccctgcatcgagaagcatgggggaaaaatcctgtgcatcatcgacaataatgctacaagtgtgcagggtttcgttttgtgcggcggtttggggcattgcattcatggtcattttcctgattctgtcgtgtgttgccgaatcgggcgacctgtgtgaaggtaacaaaaaagccgccccgttttcgagcggcctgttttgcgtatgggatggatttcaagcaagcgcaaaaaagtaccgcacgtctgtgtggtaccaatagcaataagcggttgtaaattttttgccttgcatgatgaaatgccgtctgaagataaaaatattggggagattctaaatcaaaacgctgccgcgcctcaagcattttatcgaaatttttttgatttttcatctatccgattgaaaatatttcggtttatttttaccgctgcccgatattgtcggcaatttccctttatctgctttgaaaaacggtgcataatcccgagcaaaaccgcaatcaggagcaattatgcaaaactatctgacccccaatttcgcctttgccccgatgattcccgaacgcgcttcaggcagccgcgtttgggatacgaaagggcgtgaatatattgatttttcaggcggtatcgccgtcaatgcgctgggacactgccaccctgcccttgtcgatgctttaaacgcgcagatgcacaagctgtggcacatttccaatatctatacgacgcgtccagcgcaggaattggcgcaaaaattggttgcaaacagttttgccgacaaggtttttttctgcaactcgggctcggaagcgaatgaggcggcgttgaagctggcgaggaaatacgcccgcgaccgtttcggcggaggaaaaagcgaaatcgtcgcctgtatcaacagttttcacggacgcacgctgtttaccgtgtccgtcggcggtcagccgaaatacagcaaggattatgcacccctgccgcaaggcattacgcacgttccgttcaacgatattgccgcgctggaagctgccgtcggcgaacagacctgcgcggtcatcatcgagccgatacagggcgaaagcggcatcctgcccgccactgcggaatatttgcaaaccgcgcgccgtctgtgcgaccggcacaatgcgttgttgattttggacgaagttcaaaccgggatggggcatacgggcaggctgtttgcctatgaacattacggcattgttcccgatattttgagttcggcaaaagccttgggctgcggctttccgatcggcgcgatgctggcgacagaaaagattgccgccgccttccaaccgggcacgcacggctcgactttcggcggcaacccgatggcgtgtgcggtcggcagccgcgcattcgacatcatcaatacgcccgaaactttaaaccatgtccgtgaacaggggcagaaacttcagacggcattgctggatttgtgcaggaaaacgggcttgttctcacaagttcgcgggatggggctgctactcggctgcgtgttggacgaagcctatcgcggacgcgcatccgaaatcaccgccgccgccttgaaacacggcgtgatgattttggttgcgggtgcggacgtattgcgtttcgcgccttcgctactgttgaacgatgaggatatggcggaaggtttgcgacgtttggaacacgcgctgacggaatttgccgcgacatcagacaatccgtaaaactcaaatgccgtctgaaggcgggaaggcttcagacggcatcagaaacaaaaaaccgcttcagaaacgtggttcaacgttccgaagcggttttgtttgccatcaggactcgaacaccaattccggttccctgccctcttcgatgactgccttaccgaccaccacttttttcaagcctttcaaatcaggcaggcggtacatcgtatcgagcaggcagcgttcgacgatggacctcaggccgcgcgcgccggttttgcgttccattgcctgacgcgcgatggaacgcaatgcgccttcttcaaactccagttcgacattttccataccgaacaacgcctgatactgcttgaccaaagcatttttcggctcggtcaaaatattaatcagcgcgtcttcgtccaattcttctaaagttgcaatcacaggcaaacgtccgattaattctggaatcagaccgaatttaatcaagtcttccggttcgacgatgccgaacagcttggtaatgtcggcattttcgtccttgctgtgaacggacgcaccgaaaccgataccgcctttttcagtacgctggcggatgactttttccaagcctgcaaacgcgccgccgcagataaacaggatgttggtggtatcgacgttgataaattcctgattcggatgcttgcggccgccttggggcggaacgctggccactgtaccttcaatcagtttcaacaaggcttgttgcacaccttcgccggatacgtcgcgggtaatcgacgggttgtcgcttttgcgtgaaattttatcgatttcgtcgatatagacaatgccgcgctgggctttttcgacatcgaaatcacatttgcccaaaagcttggtaatgatttgctcgacgtcttcgccgacataacctgcttcagtcaaagttgtggcatccgccatcacgaacggcacatccagtttgcgcgccaaagattgcgccagcagggttttacccgatccggtcgggccgataagcaggatgttggatttcgacaattcgacattagctcctgctttaggatggcgcaggcgtttgtaatggttgtacaccgacaccgccaaggctttcttggcttgttcctgaccgataacgtggtcgttgaggttggcgacgatttcggcgggcgtgggcagcttgccggattcttccggctcccctccggcactttccgaaggcgtgccgtcatttccgtcttcatgcaatatttcaatacagtttgagacgcattcgtcacagataaaggcgttttcgccctcaattaaatgtttgacgtgtgatttggattttccgcaaaaggaacaagtacggttttcgttggacatggctttctttacaatgtatgcgttacagaaaacggcacgtgccgttcgggttgccaagtataataactatatccgttcttatcaatgtattaccttaaaatcccgccgattaggctataatacgccctttcgcaaccgccccggcggcaaaaatgccgtctgaaaccaaatctgaaatctgaggatattcatgagaaaaccccaacgcggctatgcccgccaagaccgtgtcaaagaacaaattatgcgcgagcttgccgaactcgtccgtaccggactgaaagacccgcgcgccggcttcattaccgtcaacgaagtcgaagttacccgcgattacagccacgccaccgtgttctacaccattttaaaccaagacgcgcgcgaaattacggaagaagtgctggaacacgcgcgcggacacctccgcagcgaattggccaaacgcatcaagctgttcaaaacgcccgaactgcatttcaaatacgacgaatctttggaacgcggtttgaacctgtccgcccttatcgaccaagtagcggcggaaaaaccggttgaagactgacggatatgcccatgccgtccgaacatcgaaccatgaatacaggcaaaccccaaaaacgtgccgtcaacggtgttttgctcttggacaaacccgaaggcctttccagcaacaccgcgctgcaaaaagcgcggcgtttgtttcatgccgaaaaagccggacataccggcgtgctcgaccctttggcaaccggacttttgcccgtctgcttcggtgaagcgaccaagttcgcccaatacctgctggatgccgacaaagcctacaccgccacgctgaaactcggcgaagccagcagcacgggtgatgccgaaggcgaaatcattgccaccgcccgcgccgatatttccttagccgaatttcagacggcctgccaagcactgacaggcaacatccgccaagtgccgccaatgttttccgcgctcaagcacgaaggcaaaccgctgtacgaatacgcccgcaaaggcatcgtcatcgaacgcaaagcgcgctacattaccgtttacgccatcgatattgccgaatttgacgcgcccaaagccgtcatcgacgtacgttgcagcaaaggcacctacatccgcaccctcagcgaagacatcgccaaacacatcggcacgttcgcccacctgaccgccctgcgccgcactgaaaccgccggctttaccatcgcccaaagccacacgcttgaggccttggcaaatttgaacgaaacagaacgcgacagcttgctgctaccctgcgacgtattggtttcacactttccccaaaccgttttaaacgattatgccgtccatatgctccactgcggacaacgtccgcgtttcgaagaagacctgccttccgacacgccggtacgcgtttacacggaaaacggccgctttgtcggtctggcggaatatcaaaaagaaatatgccgtctgaaagccttgcgcctgatgaacacggcggcatccgccgcctgaacggcggttaaaaatacaggctgtgcttgaataatgtgttgatatttccgcaaaatcccgacacactcggacacccgccccgcttatcgcaactttgcgaacgcccccggaaacagcaaagacatcaaataattgattttattagaatctatttgcaaagccatttgccgttacacaagaatggcacattaaaataactgatgaggatttataacgatgaagacagacattcaaaccgaattaacccaagccctactaccacacgaaaaagtatgggcgaacgaagaaaaaaccattttagccaaaaacatcctgttggatttggtggaaaaaaccgacccgaccattatcggtttgttattgagtaatgatgagttaaaacgccatttctttgtggaagtgaatggtgtgctggtgtttaaattgcaggatttccgttttttcttggacaaacacagcgtcaataattcctacacaaaatacgccaaccgcattggtttgacggacagcaaccgctttttgaaagacagcagtgatattgtgttggattttccgtttaaagattgtgtgttaaatggcggacaaagcaccgaggaaggcgaagaaatttattttaaacgcaataacagccagccagccagccagccagccagccagccagccagccagccagccagccagccagccagccagccagccagccagccaattatacactaaattaacccgaaaaagacaagaaatcttttttaatcaaacccttgcttttgatgaaattgatcggctttttgacgcaaaagcattctcaaaattctctcgctataccgcagacggcaaacaagccgttggcgaaatcaaacgacattcagacggcacacccgccgaaaatctcattatcaaaggcaataatctgattgccctgcattcgcttgccaagcagtttaaaggcaaagtgaagctgatttatattgacccgccatataacacgggtaatgacggttttaaatacaacgacaaatttaatcattccacttggctgacttttatgaaaaaccgtctagaaatcgccaaagagctgcttatgaaagacggttcgatttttgtgtcaattgacgacaacgaacaggcatatttgaaaattttaatggatgaagttttcggaaatgaaaatttcatctgcaattttatttgggaaaaaaagacaggtgcgtccgatgccaaacagatagcgactattacagagtttgtcttatgttactcaaagaactttaaaacagttaaattaaataaaaacacgttttcttatgatacagagagatacaaattaagtgataagtttgaacaggaaagaggcaaatattatatcgacaatttagatagagggggattgcagtatagtgacagtttgaattttgcaatccaatgtccagatggcacttttacgtatccgaatggcaggactgaatttgtcaatgatggctggatatggaaatggagtaaaaataaaattgattgggcaataacaaacggttttttggagtttagaaaatcaaagtctaaaaaatctggatggagtgtatgttataaaaactatatgttggttgataacgaaaacaagccgatagaacgttctgctccctataagaacttaatacaggatatcttaaatacacatgcgacagatgaattgaaaaaactgttcggcagcaaagtttttactactccaaaacctgagagcttattgcagtatcttattcaaattgccacatccgaatccgacatcgtcttagactaccatcttggtagtggcacaaccgccgccgttgcccacaaaatgaaccgccaatatatcggtattgaacaaatggattatattgaaacgcttgctgttgaacgcttgaaaaaagtgattgatggcgagcaaggcggtatttccaaagccgtgaattggcaaggtggtggcgagtttgtttatgccgaacttgccccatttaacgaaaccgcaaaacaacaaattttggcttgcgaagattcagacggcatcaaaacgctgtttgaaggtttatgcgaacgctatttcttgaaatacaacgtcagcgtaaatgaatttagtcaaatcattcaagagcctgaatttcaatctttgccattagacgaacaaaaacaaatggtgcttgaaatgttggatttaaatcaaatgtatgtttcattatccgaaatggatgacgaacaatttgcagattgcctgaacgatgatgataaagccttaagccgtgcattctatcaatcagtaaaaaatcaagcggagaaaaaagatggcgaataataaaacgttgtttgaagtgattgaaaatgaacgtaaagcggttaaaaaatacaagcctgaattacttgaaatgccagaatttacgtccaaaaacttaaaatatgatttttttgaatggcaaaaatctgcccttgaaaactttttgatttttgaccgcacttcaaagctagacgatttccctgatttaaaaaataagccaacgcatttgctgttcaatatggcaacaggtgctggcaaaacgatgatgatggcggcgttgattttgtattattttgaaaaaggttatcggcattttctgttttttgtgaatcaaaacaatatcgtggataaaacggaaaataattttaccgatccgacgcacgcaaaatttttatttaccgagaagattttgcagggcgatacggtaattcctattcgcaaagtggagacatttagcccacattcagacggcattgaaattaaatttaccagcattcaaaagctgtataacgatattcgcacccggcgggaaaatcaaaccacattggcggatttgcacaaattgaaccttgtgatgctgggtgatgaagcgcaccatttaaacgcgcaaaccaaaggcaaaaaacaaggcgaattagatttagaaaaggaaatgaacgaccgcaccagcaatgccgaaattgaacgtaaaggctgggagcatatggttttggaattgttactcaataaaaatggcaatcatagccaaaatgtgctgttggaatttaccgccacgctgcctgaaaatgccgatgtacaacaaaaatacgctgataaaatcatcacaaaatttggcttaaaagaatttttgcaaaaaggttataccaaagaaatcaatttggtatccagtacgctgggtaagaaagagcgagtgttacacgctttattgtttgcttggtatcgacatcgaattgcgttgaaatatggcattgccaatttcaagcctgtgatgttgtttagaagtaagacgattgatgaatcaaaagcggattatctggcatttttaaattgggcagaaaatgtgcaggcggttgatttttcgtttttaactacattttcaacaagcttgaacgatagcgatagcgataacgccaacgaacaaggcaaaacccgcactgaacaagccctaaaatttatgcaggaaaaaggcgttgagtttgcacatttggcagattgggtaaaacaaaattatcaaaaacacaatgtgattattaccaactccgaaaccaacaaaaccaaaaccgaaaaaaccgacagcgaaacagaaaaattgctgaataatttggaagcggctgataatccgattcgtgccatttttacggtggacagattaaccgaaggttgggacgttctgaatttgtttgatattgtgcgtttgtatgaagggcaaaacggcggcggttcaaataaaaaatcaggcaaaacggctgccgctactgtatcggaaaagcagttgattggtcgcggcgtgcgttattttccatttgcgtttgaaggtaaacagccgaataaacgcaaatttgacaacgatatgcaacacgaattgcgtattttggaagaattgttttattacacgcacgatgagcaatctcgctatattacagaactgaaaaacgagttacgaaaagacggttatttgcctgaaaaagacgatgataaggtattggcaacatttaaactcaaatctgaatttgccgataatcaggattttagagagttgttaatttgggcaaataaaaaaatccccaatcccaatgccagagccaataatgcagacagcctgaaagccaatccgcaaacgcttccattccaagttcacggcaatcaactgttgcaggaaacgcaatttacagccgatgaaaatgatgaaatagcccgacaaatcgacacacaaaataattttactcaaatcataaaaatgagtgaaatggaacggcacattttcaataaatccctgcatatcaaaggaaaaaatggtcaatctttattccattttgaccgcttgcaaagcaaactcaacatttacaatcgcaatgaattgcaaaataacttgttaaaagattgacaaattgaatttttgggattagggcaagacaaacagatcagcccagatgacaaacttgcaggctgcctaaaaatcttggaaatggttgaaaaacatttgaatgaaagtgatatgccatttatcggtacaaaagaatttacgcctaaaaaattgtgggaaatttttggcacaccaaaacaaaaatgggtcaaaaaagatgatataaaaactgccattgccacgcaaaatgattggtatgtgatggataattttgctggaacgagtttggaagaagcgttaattcaatttatttcagagcatttgggcgatttgaagtctaaatatgatgttcatttaatccgtaatgaagaagtgtttaaattgaataacttttccgatggtgaaggatttatgccggactttattttattgctgaaaaataaacaaaaatcttcttccaatggtgtggatgactttttgcattaccaaattttcattgaaccaaaaggtgagcatttggtggaaaatgattcgtggaaagacgcttttttaaaggcaattacagcggaatacgggacggataagattctgcaaaaagatacaccgcattatcgtttgatcggtttgccgttttttactgacaatcaggaaaatgaacaatttacaaagtcattccctttaggggcggcatcgcttgaaaaatagagtggtgcattgcaggcaaccccgtttgacaaaacttcctttacaaaagggcgttttgtcagatatttaatcaacacattattaaaatacagccaaattttaatgccgtccgaaccctgtgttcagacggcatcgtatttttcagtatctaaaccgtttccctgccccaatctttgcctctcaaaatcgaagcatcgacatcttgaatatcgcggtgtcccgtaaacgccatagatatatccatttctttatacaggatttccagcgcacgggttacgccttcttctccatacgcgcccaagccatacaggaacgcccgacctatcattgtacctttcgcgcccaaagcccacgccttcaaaatatcctgaccgctgcggatgccgctgtccatccaaacttcgatgtcgctgcccactgcgctgacgatgtcgggcaaggctttgatggcagacacggtatcgtcgagctgtcgaccgccgtggttggaaacaatcaatgcgtccgcgccgcttttcgctgctttttccgcgtcttcaggttccataatgcctttgataatcagcttgccgccccacaaatctttaatgcgcgccacatcgtcccagctcaggcgcgggtcgaattgttcggaagtccatgaagacagcgaagacaaatcgccgacgttcttcgcgtgtccgacgatattgcggaacgtgcggcgttccgtgttcagcattttcatacaccattcgggcttggtcgccagattgattaaattggcgatggtcggtttcggcggcgcggacaggccgtttttgatgtctttgtggcgttgccccaaaacctgcaaatcagcggtcaataccaatgccgaacatttggcatccttcgcgcgcttaatcaggttttccataaactcgcggtcgcgcatcacataaagctgaaaccaaaatggtgcggaagtgttctcggcaacgtcttcaatcgagcagatagacatcgtggacagcgtaaacggaatgccgaacttctccgccgcccgcgccgccaaaatttcaccgtcggcgtgtgccatacccgtgaaacccgtcggcgcaatcgccaccggcattttcacatcctgcccgatcattttggtttccaggcttcggccttccatattgaccaatactttttgacggaagcggatgtctttgaaatccgaagtgttttcacggtaggtagtttctgtccacgaacccgaatcgatgtaatcgtaaaacatacgcggcattttgcgcttggcaacgcggcgcaagtcttcgatgcaggtcattttgctcaaatcacgtttcatttgtcgccccctgaatacctgaataactttatatgaaatcgataatgtatatcaatattgattataaggcaaatcatttcaacatttgccgcatccgccgcagctccctactttaagcgacataaggtttaaaattcaaaaataacaaattaaaatcaaaatattaaaaatcaatcaatctatcgatttaaacagccaatcacacaatccgccctcatacttgactgaaacactcagatattggacaattccacccactaataaaaaaaccgacatgggcaaccaccaccatgagactgaccaccaaagggcgtttcgccgttaccgctatgctggatttggcgatgaacgcgcaaaccggcgccgtcaaactcagtgccatcagcgaacgccaaaacatatccctctcctatctcgagcaattgttcggcaaactccgccgcgccggacttgttgaaagcctgcgcgggcccggcggcggctacatcctcgccgcaccggcggcacgcatcaacatcgcccaaatcatcgccgccgccgaagaccggctggacgcaacccaatgcggcagcaaagccaactgccaccacggcgcgccctgcctgacgcacgatctttgggagaatttaaacaaaaccatcaacgactacctcggcagcgttaccctgcaaagcatcatcgaacagaaaaacaacggcgacggcagccgcgtcgtccaatttacacacatccattaaataacacccgaaaaagaaagagcaaaccatgaccgtcaaaacccccgtttacctcgactacgccgccaccccccccgttgacaaacgcgttgccgaaaaaatgattccctatctgaccgaaaccttcggcaacccagcctccaacagccacagcttcggctgggaagcagaagaagctgtagaaaaagcacgtgcagacattgccgccctgattaacgccgactctaaagaaatcgttttcaccagcggcgcaaccgagtccaacaacctcgctatcaaaggcgcggcgcacttctacaaatctaaaggtaatcacctcatcactgtaaaaaccgaacacaaagccgtactcgacaccatgcgcgaactcgaacgccaaggttacgaagtaacttatctggacgtacaagaaaacggtttggttgatttagacgtactgaaagccgccatccgcgaagacaccatcctcgtttccgtaatgtgggtaaacaacgaaatcggcgtggttcaagatattcctgccatcggcgaaatctgccgcgaacgcaaaatcattttccacgttgacgcagcacaagcatgcggcaaagtgcctgttgatgttgaagccgcaaaagttgatttgctgtctatgtccggccacaaagtatacggccctaaaggcatcggcgccctgtatgtacgccgtaaaccacgcgtccgcctcgaagcccaaatgcacggcggcggtcacgaacgcggtttccgttccggcacattgccgacccatcaaatcgtcggcatgggtgaagccttccgcattgccaaagaagaattggcacaagacactgcacactacctgaaactgcgcgatattttcctcaaaggtatcgaaggcatcgaagaagtctatatcaacggcgacctcgaacatcgcgtcccgaacaacctaaacgtcagcttcaacttcgtcgaaggcgaaagcctgattatggcagtgaaagaactcgccgtatccagcggctccgcctgcacctccgcctcgctcgaacccagctacgtcctgcgcgcgctcggccgcaacgatgaactggcgcactcatccctgcgcatcaccttcggtcgcatgaccaccgaagaagaagtgcaattcgccgccgaactgattaaatccaaaatcggcaaactgcgcgaactgtcgccgctgtgggaaatgttcaaagacgggattgatttgaactcgattgaatgggcagcgcattaaagcgtaccaacatgccgtccgaacctttagacggcattccaaaaacaaagcaatcaagagaaaatatgaacgaacaagatttagatttggacaatctcgacaacctgcttgaagattttgacggcgttaccgtggaaggcggcgtcgattcggaaaacgacgacggctgcgaaggcggggcgtgcaaaatctaaacttcaggccgtctgaaaatcggcaaacaaaccacttaaaccatcaaaaaacattaaggaaaccacatcatggcatacagcgataaagtaatcgaccactatgaaaatccgcgcaacgtcggcacattcgacaagggagacgattccgtcggcaccggcatggtcggcgcgcccgcctgcggcgacgtcatgcgcctgcaaatcaaagtgaacgacgagggcatcatcgaagatgcgaaatttaaaacttacggctgcggctcggccatcgcttcgtccagcctgattaccgagtgggttaaaggcaaaagcctggatgacgcgctggcaatcaaaaacagcgaaatcgccgaggagttggaattgccgccggtaaaaatccactgctccatcttggctgaagatgcggtaaaagcggccgttgccgactaccgcaaacgtcaggaaaacagataaagcccttcagacggcatcatcccgcaatgccgtccgaaccacccgccgcttcaggtccgtccggggcggtacaacaaggaagaaatatgattacccttaccgagaatgccgcaaaacacatcaatgactatctcgccaaacgcggcaaaggcttgggcgtacgcttgggtgtgaaaaccagcggctgctcggggatggcgtacaaccttgaatttgtcgacgaagccgatggcgacgacctgattttcgaaggacacggcgcgcgcatttatatcgatccgaaaagcctggtttatctggatggcacgcaagtcgattacaccaaagaaggtttgcaggaaggtttcaaatttgaaaaccccaatgtcaaagactcctgcggctgcggcgaaagcttccacgtttaaggcataaaaacggcgggaccgtatcaaaaccgtcccgccattttttcgcttcctgcctgttgtagctgcctttgcctttccttttccgttccaccttgtgccggaacaaatcggatttcactaaggcttttaaagcattgtcgcgtattttgcctttattgtgctgcactttgccgcccatattcagtcctttcgtttaagaagcggcagattataaggcaaaaacagttttctgccaaaatcttacatttatcatcctactatgtcccaatatttcaccctcttccggattgaacccgctttcgatatcgacaccgaaaacttggaacaaacctaccgcgccttggccgcccgtttccatcccgataaattcgcttcagcttccgcctttgagcaaaagcaggcagtgatgatgtcttccaccatcaacgatgcctaccgcaccttgaaaaaccccatcgaccgcgccgcctacctgctgaaaacatcgggcatcgatgccgacgcgccggagcataccgctttcgcccccgaattccttatgcagcaaatggaatggcgcgaaacgctgatggaggcacgggcaggcaacgaccttgaatccttgaaaaatctcgacaacgaaatccgcgacgaacaagaaaaactgttctgcggtctgaaacagtcgtttgcccgacaagattacgacacagccgcacaacaagtccgccaaggcaggtttctcgacaaactccgcaacgaaatttcctcggcattataatccgcaccgtgtttcagacggcgtaaccgccgcaccgttccgcgtcaaaatatgctaaaataagcaacaattttttgccatacgaaacattgaaaccatgaccgacgcaaccatccgccacgaccacaaattcgccctcgaaaccctgccggtaagccttgaagacgaaatgcgcaaaagctatctcgactacgccatgagcgtcattgtcgggcgcgcgctgccggacgttcgcgacggtctcaagccggtacaccgccgcgtactgtacgcgatgcacgagctgaaaaacaactggaatgccgcctacaaaaaatcggcgcgcattgtcggcgacgtcatcggtaaataccacccccacggcgataccgccgtatacgacaccatcgtccgtatggcgcaaaatttcgctatgcgttatgtgctgatagacggacagggcaacttcggatcggtggacgggcttgccgccgcagccatgcgctacaccgaaatccgcatggcgaaaatttcccacgaaatgctggcagacattgaggaagaaaccgtcaatttcggcccgaactacgacggtagcgaacacgagccgcttgtactgccgacccgtttccccacactgctcgtcaacggctcgtccggcatcgccgtcggcatggcgaccaatatcccgccgcacaacctttctgataccgtcaatgcctgcctgcgcctgctcgatgcacccgacaccgaaatcgacgaactgatcgacattatccaagcccccgacttcccgaccggggcaaccatctacggcttgagcggcgtgcgcgaaggctataaaacaggccgcggccgcgtcgttatgcgcggtaagacccatatcgaacccataggcagaaacggcgaacgcgaagccatcgttatcgacgaaatcccctatcaggtcaacaaagccaagctggtcgagaaaatcggcgatttggttcgggaaaaaacactggaaggcatttccgagctccgcgacgaatccgacaaatccggtatgcgcgtcgttatcgagctgaaacgcaacgaaaatgccgaagtcgtcttaaaccaactctacaaactgactccgctgcaagacagtttcggcatcaatatggtggttttggtcgacggacaaccgcgcctgttgaacctgaaacagattctctccgaattcctgcgccaccgccgcgaagtcgttacccgacgtacgcttttccggctgaagaaggcacgccatgaagggcatattgccgaaggcaaagccgtcgcactgtccaatatcgatgaaatcatcaagctcatcaaagaatcgcccaacgcagccgaggccaaagacaaactgcttgcgcgcccttggcgcagcagcctcgttgaagaaatgctgacgcgttccggtctggatttggaaatgatgcgtccggaaggattggctgcaaacatcggcttgaaagagcaaggttattacctgagcgagattcaggcagatgctattttacgcatgagcctgcgaaacctgaccggcctcgatcaagaagaaattgtcgaaagctacaaaaacctgatgggtaaaatcatcgactttgtggatatcctctccaaacccgaacgcattacccaaatcatccgcgacgaactggaagaaatcaaaaccaactatggcgacgaacgccgcagcgaaatcaacccgttcggcggcgacattgccgatgaagacctgattccgcaacgcgaaatggtcgttaccctgacacatggcggctatatcaaaacccagccgaccaccgactatcaggcgcagcgtcgcggcgggcgcggcaaacaggcggctgccaccaaagacgaagactttatcgaaaccctgtttgttgccaacacgcatgattatttgatgtgctttaccaatttgggcaagtgtcattggattaaggtttacaaactgcccgaaggcggacgcaacagccgcggccgtccgattaacaacgtcatccagttggaagaaggcgaaaaagtcagcgcgattctggcagtacgcgagttccccgaagaccaatacgtcttcttcgccaccgcgcagggaatggtgaaaaaagtccaactttccgcctttaaaaacgtccgcgcccaaggcattaaagccatcgcgctcaaagaaggcgactacctcgtcggcgctgcgcaaacaggcggtgcggacgacatcatgctgttctccaacttaggtaaagccatccgcttcaacgaatactgggaaaaatccggcaacgacgaagcggaagatgccgacatcgaaaccgaaatttcagacggcatcgaagatgaaaccgccgacagcgaaaacgcactgccgagcggcaaacacggtgttcgcccgtccggtcgcggcagcggcggtttgcgcggtatgcgcctgcctgccgacggcaaaatcgtcagcctgattaccttcgcccctgaaaccgaagaaagcggtttgcaagttttaaccgccaccgccaacggatacggaaaacgcaccccgattgccgattacagccgcaaaaacaaaggcgggcaaggcaatattgccattaacactggcgagcgaaacggcgatttggtcgccgcaaccttggtcggcgaaaccgacgatttgatgctgattaccagcggcggcgtacttatccgcaccaaagtcgaacaaatccgcgaaaccggccgcgccgcagcaggcgtgaaactgattaacttggacgaaggcgaaaccttggtatcgctggaacgtgttgccgaagacgaatccgaactctccgacgcttctgtaatttccaatgtaaccgaaccggaagtcgagaactgaaaatcatctcccgatgccgtctgaagattcagacggcatttattttatccctcatccgtcatccagcttctcacaatatagcggattatagtcaattaaaaacaaggggctgtcctagataactagggaaattcaaattaagttagagttgcccctatgagaaaaagtcgtctaagccggtataaacaaataaactcattgaactgtttgtcgcaggtgtaactgcaagaacgacagcagagttagtaggcgttaataaaagtaccgcagcctattattttcatcgtttacgattacttatttatcaaaacagtccgcatttggaaatgtttgatggcgaagtagaagcagatgaaagttattttgctgaacgacaaaaccatatcaatggaattgagaacttttggaaccgggcaaaacgtcatttacgcaagtttgacggcattcccaaagcgcattttgagctgtatttaaaggggtacgaacggcgttttaacaacagtgagataaaagttcaaatttccattttaaaacaattagtaaaatcgagtttatcctagttatctaggacagccccaaaaacaaaatagtacaatattcaactttgaaggtctaaccatggcatactctgcggacttaagaaacaaagctttaaactatagtggattaaatttaaatcaggacaaggcgacgaagccgcagacagtacaaatagtacggcaaggcgaggcaacaccgtactggtttaaatttaatccactatattacgaacaatgcaaaaacatcagccaaaccgcagcaacgtttaacttgtcaagaaacacgctttacctgtggattcgccttaaaaaacaaacaggcagcctaaaacatcaagttaccggtctaaatgccgtcaaatcggataggcaaaaaccggctcaatatgttgggcaacacccggatgcctatctgcatgaaatcgccaaacattttgattgtacggcagccaccatttgctatgcactcaaacagatggggataacgcgcaaaaaaagaccaccacttacaaagaacaagacccggccaaagtaacgcattatttgacacagccggccgaattttccgactaccaacgtgtttatttggatgaaacaggatttgaccgctacctgttccgtccctatgcccgcagcctgaaagggcaaatagtgaaagcgcagataagtggaaaaagatatagtggattaacaaaaatcaggacaaggcgacgaagccgcagacagtacaaatagtacggaaccgattcacttggtgcttcagcaccttagagaatcgttctctttgagctaaggcgagccaacgctgtatcggtttaaatttaattcactataaaaacgacaaaaacgcaaaagccgccgacattcccgcatccaagtttcagtcaatcagataaccttggatttctttggttttcgcattgatttctctggtacggcagtcagattgtgccacgccgtattcgtcgccgtcggcgcatttggcattcaaaccgttttgtcagttgcggtactcgggcatgacggtttcggcaatatcggcgggcagtgcctgaaccgcgctgttcagagccgctttgacagttctttcttgtccgcttccctggccatttcgtcgataagggcttttttacggttgtgcagctcttccaagcgtgcttcggttttcgccgttttgcatgccagttcgctgaattttatgccgtttggcgttttaccttcagctttcgcattgttggcacagattttatccatcccgcttttccatgttttctgtgaggcttgcagcttattctgtacggtttgaggcaatcctttccagaactgctcgaactcgctgcgcgacagcttgtagcgttcttcccattcggatacgcgggcggcttcctgctcccgacccaatgcctcctgcgccgccgcttcttctgccgcttcaagttcttcgttcctttgtttcactttgtccaacggctctttaatcagtgccatagctgcggaacatatatgtttaaatttatgcaaaccatcatatcgggattgcacacgctctgcaagtttaccgacggttttcctgttcgataaaaatgccgtttgaaacggtcggcgttcagacggcatttttccgcaggttttatttgcggttggtctgcaggtagaggttgatcaggcgttcggtcgaactgtcgtgcttttgcggcccggtttcgccggtcagttcgcccaaaatggttttagccagttgtttgccgagttccacgccccactggtcgaagctgttgatgccccaaatgatgccttgtacgaaggttttgtgttcgtacatggcaatcaggctgcccatattgcgcgggttgaccttgtccatgagaatgaggttggtcgggcggttgccggagaaggttttgtgcgggaccagctcttcgatgcgcacctcatccataccctgcgctttgagttcggcgcggacttcgtcgggggttttgccgcgcataaaggcttctgcttgggcgaagacgttggcaagcaggatttcgtggtgtccgggcaggttgctgcgtttttcaagcgaggcaatcaggtcgatgggggtaatgtgcgtgccttggtgcagcagttggaaaaaggcgtgctggccgttaatgcccgtttcgccccagataatcggcgaggtttcgtgtccgactgctttgccgtccaacgtaacctgtttgccgttactttccatatcgagctgctggatgaatttgggcaggcggtgcaaatgttggtcgtaaggcgcgatgacgtggctgccgccgccgtagtagttgatataccagatgccgatgagggcgagaatgacgggcaggttgcgctcgagcggtgtgttgatgaagtgttggtccatcaggtgcgcgccgttgagcatttcaatgaagttttcttcgccgagatacagcataatcggcaatccgatggcggaccacaggctgtaccgaccgccgacccaatcccaaaattcaaacatattggcggtgtcgatgccgaattcggcgacggctttttgattggtggaaacggcggcgaagtgtttggcaacggcttcttcgtcgcccgcatgattcaaaaaccattcgcgcgcggtcagcgcgttggtcagcgtttcctgcgtggtaaatgttttggaggcgatgatgaacaacgtggtttcggggtggactttggacaatacgtcgcgcagttgcgagccgtccacgttggagacgaagtgcatattgaggcgcggatgaccgaaaggtttgagcgcggtacacatcatcagcggacccaaatccgatccgccgatgccgatgttgacaacgtcggtaatgacttggttggtatagcccagccagcttccgctgcggacttcgtgtgcaaattcgcccatacgttgcaaaacgcggttgactttgggcatcacatcttcaccgtcaaccacaatcggcgaattggtgcggttgcgaagggcgacatgcaggacggcgcggttttcggtggtattgattttttcgccgtggaacatctgccgcatccgctccggcacgcctgcttctcgggcaagctcgaacaaaagcgacatggtttcgtcgttgatgcggtttttggagtagtccagcgtcagtccgccgacttgcagccagtagcgttccgcacgctgcgggtcttgctcgaacatttcgcgcatatgcaatgttttgctgtcgtcaaagtgattccacaatttcgaccatgcgggtaagtcgtgaaggtgtttcatctatatgctcctgaatgaggttttttgttgtgggatgaaaaggctgccggaaactgccgcaagccgccgacgaccgttgttcggcatttcagacggcatttgtgggatgccgtctgaaggtcaatctttgtcgtaatcgatgtgcttgttgtgtatgctttttttgcttttctgcaattgcaggctggcagcatcgcccaagcgcagggcaagtccgatggcgagaatgtcgatgacggcaagctgcaagaggcgggaaaccatgggcgtgtagagttcggcattttcctgtgtggcaacgctcaacacgcagtcggcaagttgcgccagaggcgaatcgttgcgggtcagtgcgatgacagacgcgccgttttctttggcgatgctgaccgcatccaaaagttcgatagacgaacccgtgttggaaatggcaaccaaaacatcctgatcgctcaaaacagatgccgccatcagctgcgtgtgcgtatcgacataggcgacggtggacatgccgaaacggaaaaatttatgctgcgcgtcctgtgccacaatgccggaattgccgacaccgtaaaactcgacgcgacgggcgtgcatcagcgtggcaatggcgttttccagctccgactctttcaggaagcggcgttcgcccaacagcgaggcggcggcattgcccaacactttctcgaccacgcttgccatatcgtcgtcggcgttgagttcttcgtggacatagggcataccctcatgaccgatgctggcggacaaggcgagcttgaactcgggcagccctttataacccaagctgcggcagaatcggatgacggtcggctggctgacggacgcacgttcggcaatttcggcaacggcggcatggacgaaccatttgggttccgccaatgcacattcggcgactttgcgttccgcaccggaaaggtttgccagtgattcgctgattttgcttaacataatgatatgcccttcgataatgcagccccgctgcaaggagccgctgtggttaaacgtttctcaaatggttgtcaagagccgcagccgcaccggaaattccgggaaactcgctcaagacgacatacacgggaatcgcggcaagatatgcttcaaacctgcccttgttctcgaaacggctgcggaacggggaagttttgaaatattccaacacgcggggaataatgccgccacacaggtacacgccgccgcgcgcgcccagcgtcagggcgaggttggaagcaaccgtgccgagcatggcgcagaagatgtccaaagtctgacggcacaaaggcgacgcgccgctcaaagccttttccgtgatttcagacggcatcagtttggcgggtttggctttctgttttgcagccaaagcctcgtaaaccaagctcaagcccgcgccgctcaaaaagcgttcggcggaaacatggccgtatttgtttttggcgtactgccaaatcagcacttccatatcgtcaaacggcgggaaactggtatgcccgccctcgcccgccaaagccacccagcctgcgtggctgtgcaccaatccgctcacgcccaggccggtaccggggccgataacggctttgggggcaaattcgacaggcttttgcccgcctacctgcatcaggtctttgcttgaagtctgcgttaccgccaatgcctgcgcggtaaagtcgttcaaaaggatgagggtgtccagccccaaagtctgacgggtggtttcgatggaaaacgcccaatggtggttggtcatctgcacccagtcgcccaaaatcgggttggcgatggcaaatgccgcgtgccgtacggctgttgcaccgctttgattcagataggcacgcaccgcatcggtaaccgtatcgtagtctttacacggaagcacggcggctttttcaatgacgcgcggcgcggtttccagcgcaaagcgtgcattcgtcccgccgatatcggcgaccagtcggggatatccggcttgtttattcggcgtagaagacatggcagttcactccttgatggttcaaaacgaggttgatcggatattcgcggttttcgccttgtgcggcttggtcgaacacggcttttttctcttcgccccgtatcgccaaaaacacatgccccgtatgggcaatcgcatccaaggtcatactgacgcgctcgtgcggcgcggtaacgggcgtggtatgcaccaacgcgacacctgccgaaccgtcgattgccgtctgaaactgcggagctttcgggaaaatcgaagccgtatgcccgtcgtttcccatacccaaaaccaaaacatcgggctgtttgtaatgtttcagtgcataatcgacaacagcatcgggatgtaattcggtttcagtttttccgtcttccaccataggaatccacattgccgcttccgctttgttcttcaacaggtattcgcgcaccaaaccggtattgctgtcggcgtggacggtcggcacgatgcgttcatctgccaaggtgatgccgacgtttttccaatccaaatctttttgcgacagggcgttgaaaaatgcaatcggcgaacgtccgccggaaactgccaacaccgcaccgcccttctcgtccagtgcgccctgcaaagcatccgccactgcgtcagccaaagactgcgccgcttctgccgcattttcgtattcgtgccaaacaaacatatttgtgtcctttttttatttcagacggcatattccgttatggaaacgggttgagcaatatgtcggccgaacagttgtttatgcttttgataccaaatatcgggactgctttttatagtggattaaatttaaaccagtacagcgttgcctcgccttgccgtactatttgtactgtctgcggcttcgtcgccttgtcctgatttttgttaatccactatactactttacttatgttcagacggcatttcaaaccccatgccgtctgaacgcattattgtattactgctcttcgtgccacttgtgtccgtcgcgcgccaatagttcgcgcgcggcttcaggcccccacgagtgtgcgccgtagccgtgcggcggcgtggtgttatttgtccagttttccaaaatcggcatcacatattcccacgcggcttcaagttcgtcgcggcggttaaacaaagcgagtttgccgttaatcacatccagcagcaggcgctcgtaagcttccgcgcggcggccttccaatgctttgcccaaatcggttgccagcggcacggtttcgaccttatttcctgcccccggggttttcatctgcgtatagaggcgcacggattcatatggttgcaactcgataacgagccggttgggcgcggtgcggctgccttcaaaaatatggctgttcaaatctttgaagttcaaaacgatttccgccactttgcccgccatgcgtttgccggtacgcaggtagaagggaacgcccttccagcgttcgttttcgatttcggctttaatggcgacgtaggtttcggtaaagctgtcttgcggaacgttgatttcttcaagatagccgttcatgcctctggcggcggtatattgtccgcgcacgacgttttcattgacagactcgacggtcagcggcttcaatgacttgatgactttgactttttcatcgcgcaccgcgtcggcatccaagctggcgggggcttccatcgcagtcatgcacaacatctgcatcaaatggttttgcaccatatcgcgcaacgcgccggtaatgtcgtaaaactcaccgcgctcttccacaccgagctgttcggcgatggtcaactgcacgctttcgatatatttattgttccacagcggctcgaacattacattggcaaaacgcagcgcaagcaggttttgcaggctttctttgccaaggtagtggtcgatgcggtaaatttgcccttctttgaaataacgcgcaacatcggtattgatttgctgggaagaagccaaatccgtacccaacggtttttccaaaactacgcgcacattgtcggcattcaaaccgatcgcagcaaggttttcacaggcttgcgcgaagaatttgggcgcggtggacagatagatgacgacgttgtcggtttctttgcgcgctttgaccaaatcgcccaaagcggcaaaatcgtccggctgcgtaacatcgactttgagatatgcgaaacgttcgacaaacgatgcccaagcctcatcggaaaaattttctttcacatggattttggaactggtttccaccttcgccagaaaaccttcggtatccaactcgctgcggctgacccccaaaatacgcccttcgggatgaagcagaccggcaacatgcgcctggtacagacagggcaacagcttgcgcatcgccaaatcgccggtcgcaccgaacaacaccaaatcaaaatttgtttgtgtactcatcgtattatctcgtcaggaaagaatttttcgatgccgtctgaaacctgtttcccccatcacgctgcatcgcaatatcggaaacaaaggcaggcggcataatgagtagtaatactacacaccgctacactttttgtctattcccatttttacaatttatttgacctagtccaaaaatcgggcaggtttcccctattccgttacaacaatcgaaagattctgcgatttaaatcaaatttcttttcaatgcctgatttttttgtaacaaaattacaaattttgtactataataacacccgcttcccactttcagacggcataccttttaaaatatagtggattaacaaaaatcaggacaaggcgacgaagccgcagacagtacagataatacggaaccgattcacttggtgcttcagcaccttagagaatcgttctctttgagctaaggcgaggcaacgccgtactggtttttgttaatccactatacttaccgtctgaatacccgatacaaaaatcagaaacgcacaaacaaatccccaataccccccccgttccgacaggagaccgaccgtgaacactactcctatccactccaaactcgccgaaatcaccgggcgcattattgaacgcagccgtccgacgcgtgaaaaatatctggcgaagatccgcagtgccaaacaaatgggacgcttagagcgcaaccagctcggctgcagcaacttggcacacggctatgctgccatgcctaaaagtatcaaaatcgaaatgcttcaggaaaccgtccccaacttaggcatcatcaccgcctacaacgacatggtttccgcacaccagccgtttaaagacttccctgaccaaatcaaagacgaagcgcagaaaaacggcgcgaccgcccaagtcgccggcggcacgcccgccatgtgcgacggcatcacgcaaggctacgccggcatggaattgtcgctgttctcccgcgacgtgattgccatgagtaccgccatcgggctgtcgcatcaaatgtttgacggcagcctgtttatgggcgtatgcgacaaaatcgttccaggtttgatgataggcgcgctttcgttcggtcatattccgggtatcttcgtccccgcaggcccgatgtccagcggtatcggcaacaaagaaaaagcccgcacccgccagcttttcgccgaaggcaaggtcggacgcaacgaacttttgaaaagcgaaatgggttcttaccacagcccgggcacctgcactttctacggcacggcaaactccaaccaaatgatgatggaaatgatgggcgtgcacctgcctgccgccgccttcgtccacccttacaccgacctgcgcgaagcgctgacccgctacgccgccggacacctcgcgcgcggcatcaaaaacggcacgattaaacctttgggcgaaatgttgaccgaaaaatcctttatcaacgccttgattggcctgatggcaaccggcggttcgaccaaccacaccatgcacctcgtcgctatggcgcgtgcggccggcgtgattttgaactgggacgacttcgacgaaatttcctccatcatcccgctgctcatccgcgtttatccgaacggcaaggccgacgtgaatcactttaccgcagcgggcggactgcctttcgttatccgcgaattgctgaatgcaggcctgttgcacgacgatgtcgataccgtcgtcggacacggtatgcgccactacaccaaagagcctttccttatcgacggcaaactcgaatggcgcgaagcccccgaaaccagcggcaacgacgacatcctgcgcaaagctgacaacccgttctcccccgacggcggtctgcgcctgatgaaaggcaacatcggacgcggcgtgattaaagtgtccgccgtgcgcgaaggctgccgcattattgaagcgcctgccatcgtgttcaacgaccaacgcgaagtgttggctgcgtttgaacgcggcgagttggaacgcgattttgtgtgcgtcgtccgctaccaaggcccgcgtgccaacggtatgcccgaattgcacaaactgaccccgcctttgggcatcctgcaagaccgcggcttcaaagtggcgctgctgaccgacggccgtatgtccggcgcgtccggcaaagttccagcctccatccacatgacacccgaagccctgatgggcggcaacatcgccaaaatccgtaccggcgacctgatccgcttcgactccgttagcggcgaactcaacgtcctgattaacgaaaccgaatggaatgcccgcgaagtcgaaagcatcgacttgggcgcgaaccaacaaggctgcggccgcgaactcttcgccaacttccgcagcatgaccagcagcgcggaaaccggtgccatgagtttcggcggcgaatttgcctgatgcgcgtttcagacggccttttcagaccgaaggccgtctgaaaaattattcaagcgttttaagatagacgtaggttggattctcgaatccgacacagccgtccaagatgtcggtttcttgaatccgacctacaacctgtcccatcttaataaaataccccattccacccggagaaccgaaatgtccaaactgaccccccgcgaaattttgaccgccggcgcagttgtgccggtaatggcgattgacgacttaagcaccgccatcgatttgtcccacgcccttgtcgaaggcggcatccctaccctcgaaatcaccctgcgcacccctgtcggcctcgatgccatccgcctgattgccaaagaagtgcccaacgccatcgtcggcgcaggtacggtaaccaatcccgaacagctcaaagccgtcgaagacgcaggcgcggttttcgccatcagcccggggctgcatgaatccctcgccaaagccggccacaacagcggcatccccctgattcccggtgttgccaccccgggcgaaatccaactggctttggaacacggcatcgacaccctcaaactcttccccgccgaagtcgtcggcggcaaagccatgctcaaagccctgtacggcccttacgccgatgttcgcttctgcccgacaggcggcatcagcctcgccaccgcgcccgagtacttggcactgcccaacgtcctgtgcgtcggcggctcttggctgacaccgaaagaagccgtgaaaaacaaagactgggacaccatcacccgcctcgccaaagaagcggcggcgttgaaacccaaagcctgattcgcatcgtaaaaatgccgtctgaaaaacctttcccgtttcagacggcattttgccgattgagggcacagtcggcatacacggcagcactgatcagacataccgcccctaaaatgcccatccgccttccgcataataaaaataacgttcagttcattcgacagcagccggacagcccatactacgcggctgaaaaaatgccgtctgaaacgcattcagacggcatccacttaaaaaaaacaactgattcaacgccgattaatccgcttccaaaaccactttcatcacttggttttcggcggcgtgtttgaacacgtcgtaggctttttccaattcactgaatttgaaatgatgggtcagcattttggtgtaatcgacggagctgctggaaatcgccttcatcagcatttcggtggtattggcgtttaccagaccggtagtgatggcaagctttttaatccagagtttttccagtttgaaatcaacggattgaccatgtacaccaaccacagcgatatggccgccgggtttcacaatgtcttggcacatattccatgtagcagggataccgacggcttcgatggcgcaatccacgccgtcttcgccgacgatggcaaagacttgtttggatacttcgccggaagcagggttaatggtatgggtcgcacccaattctttcgccagtttcaaacggttttcgtccatatcgcaaacgatgatggcggcgggactgtacagttgggcggtcaacagggcggacataccgacagggcctgccccagcgatgaatacggtgtcgccgggtttgacatcgccgtattgcacgccgatttcgtgggcggtcggcaaagcgtcgctcaacaacagggcgatttcttcgttgacattatcgggcagcggaacgaggctgttgtcggcataaggcgtacggacgtattcggcctgagtaccgtcaatcatgtaacccaaaatccaaccgccgttacggcagtgtgaatagagttgggttttgcagttgtcgcaagtgcaacatttgctgacgcatgaaataatgactttatcgccgactttgatgttttttacagcctcgccgacttcttctacaataccgatgccctcatgaccgagaatacggccgtcggcaacttcggggtttttgcctttccaaatacccaaatcggtaccgcaaatcgtggttttgacgattttcaccaccgcatcggtcggatcgataatctgcggacggggtttttcttcaaaacggatgtcgtttgcgccgtgataaaccattgctttcatgctgatactccttgcttgttgataaataatttcaataccgcaataaagtttctttatatgagttatatgcccctacaaaaaataagtcaataagaattattttcacaatgttatacaataacataccgttttaaatataaataaaaccaccgattgatattaatgaacacacccatccccttctccgarcggctcatccgctggcaaaaacaacacggtcgccaccacctcccttggcaggtcaaaaacccttattgcgtctggctttccgaaatcatgctccagcaaacgcaagtcgccaccgtgttggactactatccgcgcttcttagaaaaattcccgaccgttcagacgcttgccgccgcgccgcaagacgaagtgttgtcgttgtgggcgggcttgggctattacagccgcgcgcgcaacctgcacaaagccgcgcaacaagtcgtcaggcaattcggcggcacgtttccgtcggagcgcaaagacttggaaaccctctgcggcgtaggcagaagcaccgccgccgccatttgcgccttctccttcaaccgccgcgaaaccattttggacggcaacgtcaaacgcgtactctgccgcgtgttcgcccgcgacggcaatccgcaggacaaaaaatttgaaaactcgctctggacacttgccgaaagcctgctgccgtctgaaaacgccgatatgcctgcctatacacaaggtttgatggatttgggcgcgaccgtgtgcaaacggacgaaacccttgtgccaccaatgcccgatggcggacatctgcgaagcgaaaaagcaaaaccgcaccgccgagctgccgcgcaaaaaaaccgccgccgaagtaccgaccctgccgctttactggctgattgtccgcaaccgggacggcgcgattttgctggaaaaacgccccgccaaaggcatttggggcgggctgtattgcgtgccgtgttttgaaagtttgaacgggctttccgactttgccgccaaattctccctgaccatggcagatatggacgaacaaaccgccctgacccaccgcctgacgcaccggctgctattgattacgccctttgaagcacaaatgccgtctgaaagcccttcagacggcatttggataaagccggcgcatttgaaagattacggtttgcccaagcctttggaaatttatttaaacggtaataggttagaataaacaaaataaacccattgaactgttgtttgcaggtatcgcagcaagaacaaccgatgaatttgggtcgtattttaggcggcgggataatgttcaaatgggacatttggaacggaagaagtcggcaatttaaaaaggatttaaaaagcaaagaaggtcaaaaacatgaacacaaacttaaatgacaaagacaaagccatggataccgcaatcaggtttcagaaaaggatgaggattccgaaatttttctttttaattctcggaatcacaatggttttggcatttatccaagacgtgataacgggttctaattttctgcaaataacaattaatgtaaaattttcgtaaaaatttatcggcttttaaaacaaaattgactaaaatagtcgcgagtttttactgcaataaaggagattgcaatgaatatgaaaaccttattagcactagcggttagtgcagtatgttcagttggtgttgcgcaagcacacgagcataatacgatacctaaaggtgcttctattgaagtgaaagtgcaacaacttgatccagtaaacggtaacaaagatgtgggtacagtgactattactgaatctaactatggtcttgtgtttacccctgatttacaaggattaagcgaaggcttacatggtttccacatccatgaaaacccaagctgtgagccaaaagaaaaagaaggtaaattgacagctggtttaggcgcaggcggtcactgggatcctaaaggtgcaaaacaacatggttacccatggcaagatgatgcacacttaggtgatttacctgcattaactgtattgcatgatggcacagcaacaaatcctgttttagcaccacgtcttaaacatttagatgatgttcgcggtcactctattatgatccacacgggtggtgataatcactccgatcatccagctccacttggcggtggcggcccacgtatggcatgtggcgtgattaaataattcgattgttcgaaacgaaaagtgcggtgaattttgaccgcacttttttgctagatatttagcattgagacctttgcaataacataggttactaaaattttatgctcaatctcattttcaaaatgcaaaacttttctgatttttcctactttttgctcaatattaggaaggttttaggcaattgaaaattttttggcgcatttttatgcgtcaaatttcgttaacagactatttttgcaaaggtttcaattcataagtttcccgaaattccaacataaccgaaacctgacaataaccgtagcaactgaaccgtcattcccgcgaaagcgggaatctagaccttagaacaacagcaatattcaaagattatctgaaagtccgagattctagattcccgctttcgcgggaatgacgaaaagagacctttgcaaaattccttttccccgacagccgaaaccccaacacaggttttcggctgttttcgccccaaataccgcctaattctacccaaatatccccttaatcctccccggatacccgataatcaggcatccgtgctgccttttaggcggcagcgggcgcacttagcctgttggcggctttcaacaggttcaaacacatcgccttcaggtggctttgcgcactcactttaaccagtccgaaataggctgcccgggcgtagcggaatttacggtgcagcgtaccgaagctctgttcaaccacataacgggtcttcgacaaatatcggttgcgtttggtttgcacttccgtcagcggacggttgcggtgggctttgcgcataatgccgtccagcaactgatgttcttccagatgttgccggttttccgcactgtcgtagcctttgtcggcatagacggtcgtacctttgggcagtccttccaacaacggcgacaggtgtttgcactcatgggcattggcgggggtaatgtgcagtttctcgatatagccttctgcatcggtacgggtatgttgtttgtaaccgagtttgtagaggccgtttttctttatccaacgggcatcgctgtccttactcggtgtggtttgaccgctgatttgtccttcttcgtcaacttctatggcctgacgctgtttgctgccggcggtctgaataatggtggcgtcaacgacggcagcggatgctttctctatttttaaacctttttcggtcagttggcggttaatcagttccaacagttcagacagggtattgtcttgcgccagccggttgcggtagcggcataaggtgctgtaatcggggatgctcagttcgtcaaaacggcaaaacaggttgaaatcgatgcgggtaatgaggctgtgttcgagttcgggatcggagaggctgtgccattgtccgagcaggacggctttgaacatggacagcaggggataggcaggacggccgcggtggtctctaaggtaacgggttttttgacggttcaggtattgttcgatcagctgccaatcaatcacccggtccaacttcaatagcgggaagcggtcgatgtgtttggcaatcatggcttgggcggtttgctggaagaaggtgctcttgagaaatcccctaaatgtcttggtgggaatttaggggattttggggaattttgcaaaggtctctagatgagtgaaaaagaagtgcaggctgcctaaaaagacagaaaaagtctttccggcagcctgcactttggtttcatttcagtcagtaaacccagtaaacgacggtctgaaaacgcagaacgttacgaaaaaagcagcctacacgcccatcccccgccttctacccgttctgtaaatcatacagatagcggtaatatccgttcggcttcgccagcaattcctgctgtgttcccgcttccacaatcctgcctttatccatggcaatgatccggtgtgccgttttaacagtggacagacggtgggcgataatcagcaccgtccggttggcgcaaatggcctgcatgttctgcataatcgctcgttcactttcataatccagcgcgctggtggcttcatcaaaaatcagaatgcgcggattggtgattaacgcgcgggcaatcgcaatacgctgccgctgtccgcccgacaagccggccccttgttcgcccaccacggtgccgtagccttccggcagctccataataaactcgtgtgcgcccgccagtttggctgcttcgataatgcgttccagcggcatacccgtatccgtcagcgcgatattgtcgcgtatgctgcggttgagcagcacattctcctgcaagaccacgccgacctgccgccgcagccaggcaggagcggccaaagccaaatcgttgccgtccaccaacacccgtccctgctccggtacatacagacgctgcaccaatttggtgagtgtggatttgcccgaccccgaacgtcccacaatccccagcacttcccccgcccgaatccgcaggttcaaatcctgcaaaatcagcctgccgtccgccttatagcggaaatcgacatgttcgaacgtaatctccccccggatatcgggcaaagccaaatgcgaagacgcattctcggtcggcgcattcagaatatcccccaaacgcgccaccgaaatccccacctgctggaaatcctgccacaactgcgccaaacggataacaggcgccgccacctgtcccgagagcatattaaacgcaatcagctgccccaccgtcagcttgctctcaattaccagccgtgcgccaatccacaacgtcgccaccgtcaccagcttctgaatcagctgcaccccctgctggccgaccaccgccaacttcgttacccgaaatcccgaagccacataagccgccaactgattgtcccaacgctgcgtcatctgcggctccaccgccatcgcctttaccgtacccaccgcagtgatgctttctactaaaaacgactggttgtctgcattgcgcgcgaacttatcgttcagacgcgtccgcagtatcggactgataaatgccgaccaaaacgcataggcaggcaacgaagccaataccacccaagtcagagtggagctgtaataccacatcaccgccagaaagataaacgaaaacgccaaatccaacaccgaagtcagcgcctgaccggtcaagaaattgcgaatctgctccaattcccgcacccgagccaccgtatcacccactcgtctgtgctcgaaataggataaaggcagggaaagcagatgccggaacaaacgcgcgcccaattccacatcaatacgtgaagtcgtatgtgcaaacagatacgtccgcaaaccgcccaacacaatctcaaacagcgacaccaccaacaaagccaccgacaccacatccaaagtagagaatccccgatgtaccagcaccttgtccatcaccacttggaaaaacagaggcgtaatcagcgcaaacagctgcaacaccaccgacaccaccaatacttcaaaaaacaaccggcggtatttgattaccgccggaataaaccaggtaaagtcaaactttgccaaactgcccaataccgaagcgcgggaagcaaccaatatcagtttgcccgaatatctgttagaaaattcggcaaaagacaataccgcagacttattcgtaaccaaatcctgtatcaaaaattgggcatgctcaccctcaccgtctgttttggccaaaatgaaatggttgccgtcatcacaccataccaatgcgggtaaagtcgccatagccaaacgtttaataggctggcggactacctttgccttcaatcccaaagatttggcggctaacagccattgcgtttcatttaaatcgctctgtgcggaagtacaaaattcatgctgtatatcggcaggattggcggcaatgccgtggtaatgggcgaggatgatgagggcggaaagggcggggagcggtgcggatacgatagacataaataaaatatagttagattggatgtggataacggctggctggaaaaggaatatattaagtagaaagaaatatataaataaaacagcagaacgcattgtaaggatatatatgggaattgtaaagagaaagtatggaaaagttctcgtttcaggaaggtaaaacggcttaggaatcgagttagatgaggatgcctcgcacctctcgtgcctcctgcataccgttaaggcacagggttaaggtgcaggctgctccgaactctgttgcggtcgggtaatgttattttttgtgtttcaggcagcctgaaatatctgtatatttttgttttaaatagattttaaagattgataactgttcttgacgatttttcaagaaaggagtaaatttcaagaaaggagtaaagtgacttattatcaatgacaagcaacgcgcgaagtgacaaggaaaactatctacttaaattctaaggaggcttcgaatatcataaaccaatcagaaacatagagataaaaattatgtacaaatataatcctcttatacaatttattgcacagttgattatgtcttatggagcaagcgtagggtgggcacttgctgccccacgcgtttcatatttcaaggcagcctgaaaccgtgtgggcataaatgcctaccctacatcccaaaaaacaagcgcagcctgcgtgtgtagggtgcgaactttcggcaggtagacacgcagttttatattttcaagctgagggatgcttaagaaaagtacaaaacattaaaaaataaggggctgtactagattagccctaaatccacaccaatcccgcaagatttttagctgtcgggacggtgtgccgaagttaaatcgaaattcgcattctttcaagaacagcgggaaagatttgcgatcaattccgttctatttgcgcaagacgcgttttgcctgattccaaaagttctcaatgccgtttatgtggttctgacggtcagcaaattccttggaatggttgatgcggtaatggataaaaccgcttacgtccaacttgtcgtaactgctcaggctgtcggtataaacaatgctgtccggcatgattttctgtttgataacaggcattaaagtatcggacttggcattatctacgacaacggtatagacccgtccgttacgtttcagaatgccgaagacaaccacttttcctgccgcaccgcgaccacgtttgcctttacgccgtccgccgaaatagctttcgtccaactcgacagagccctcgaaaacctcattggcagccaaggccagataatggctgatgaccatacggattttgcggtagaacaggactgccgaattgggatggatacccaaaatatcggcagcagaacgggcggtaacttcgagtacaaaaaaacggagcagctctttctgtacttttttctttaatttgcagtgtgttatcttcatatttcgggggtaacatatctgctaatctagtacagcctcaaacaaaaaagagaaattttaatttcgctaaatcgcataaagattaatcaagagtatcattaaatgatatgagtgagcatctataatgccaagaagagttgttaagacataacgattattgaaatagattgtaaaatagatacttagatagtctgaaaaacggatttgtgaaactttttattacgcgccatcatttgaaaatgaaacttaaaaaacacttatcataataaatattttctttacgttgtttgctaataaactcagtgcaatatcagcgcaatattttatggaaattttatggataacaaaaaagaatttattaataatttaacaaataggtatatgtggatctatccattggtcttaaatattctatttctacctttttaccagtcctaccaatctttttttattgcgcttggttgtttgtttgcactggttagaaaaatgcaaagcttagattttaaattacaaaatcatattgtattgttaaatataaaaagtgcttgggcagataaaaaagtatttttgattaggatagtagtgtcatggttggcagtaatggaaatatggatgtgttttatttcggaatcatcaacgtgggtatgcggtgctttttgtttaaatagtgaaatattggaaaaaatttttcgtggctttggttattctggtagtttatattttttatttatattgatgattgatctcaataagttaagagagagtatttgaatttcattttttgtttgacttaaactcaaggagagtaacaatgattggtagtggtgatactaaacaatgcaaaaaattttctgcgtgtgatggaaaataccacgtctacgatcccctcgccctagacttggacggcgacggcatagaaacagtcaccgccaaaggcttttcaggcagcctgaagactgagagagtgaatacgatgagtatacactctatgccactaaattgatattcactaaatcataccagctatattttatttaatgagacatatgaaaaataaaaattatttactagtatttatagttttacatatagccttgatagtaattaatatagtgtttggttattttgtttttctatttgatttttttgcgtttttgttttttgcaaacgtctttcttgctgtaaatttattatttttagaaaaaaacataaaaaacaaattattgtttttattgccgatttctattattatatggatggtaattcatattagtatgataaatataaaattttataaatttgagcatcaaataaaggaacaaaatatatcctcgattactggggtgataaaaccacatgatagttataattatgtttatgactcaaatggatatgctaaattaaaagataatcatagatatggtagggtaattagagaaacaccttatattgatgtagttgcatctgatgttaaaaataaatccataagattaagcttggtttgtggtattcattcatatgctccatgtgccaattttataaaatttgcaaaaaaacctgttaaaatttatttttataatcaacctcaaggagattttatagataatgtaatatttgaaattaatgatggaaacaaaagtttgtacttgttagataagtataaaacattttttcttattgaaaacagtgtttgtatcgtattaattattttatatttaaaatttaatttgcttttatataggacttacttcaatgagttggaatagttttggtaattttatgagcgcacgctcatccgcgttagcagaatttggaaatatggttgctaatttagtttctgcaaaaaatgagaaagatatctcgaaacgtaatgaatattacaaacaagctggttatagtgcattattagcatttggtaatttggctagtaatattgcaccaggtagtacgtcatcgcatattgtaaacggaacaaatgcctctgtgattgcaagccgtctctctggaaatatatcttcagctattcaggagcataaagatggtaaagttaatatcaaccgttttcaaaatattttagcggatttatattcattgggagggttaggaagtacattaatagagaagaatggaaatatgcagagttgggggattccattagcaattgctggagatataattgcagcaacggctattgccacaggagatactggtacgatatctacagaggaattttataattttgacaactggaaaggttttgggtatgagctatttgaagactggtctcgttgggtatacgactggctgcccgacggctggaatctgtggaaagaattggacagaaaccgttcaggccaataccacatctacgaccccctcgccctagacctagacggcgacggcatagaaacagtcgccgccaaaggcttttcaggcagcctcttcgaccataacggcaacggcatccgcaccgccactggctgggtttctgccgatgacggtttactcgtccgcgatttgaacggcaacggcatcatcgacaacggcgcggaactcttcggcgacaacaccaaactggcagacggttcttttgccaaacacggctatgcagctttggccgaattggattcaaacggcgacaacatcatcaacgcggcagacgccgcattccaatccctgcgtgtatggcaggatctcaaccaggacggcatttcccaagctaatgaattgcgtacccttgaagaattgggtatccaatctttggatctcgcctataaagatgtaaataaaaatctcggtaacggtaacactttggctcagcaaggcagctataccaaaacagacggtacaaccgcaaaaatgggggatttacttttagcagccgacaatctgcacagccgcttcacgaacaaaatgctatccattagccatgttcgggaaaacacgatttccccgtttgttttaggctgtctaaacaaataaccataaatgtatatcattatttaaaataaataaaagtatttaactattattgacgaaattttagagaaagagtagactgtcgattaaatgacaaacaatagtgagaaaggaaatatttactatccgagcacagagcatattttaggtagcctgtaactgttcctgctggcggaagaggatgaaggttgacttacccgagaataaatgtcctgttgtgtgatatggatgccatgccgcgaagcaattgatgcaatcacggcagtcctacttgaatgaaacctgtcgttgcagaatttgaaaacgctatttttaagaaaggataaagggagaaagaatttttggtttttaagctgcatgaaaccgtgttggaataaatgcacacctacgataattaataattttcgttttttattctacaagctatttatatatgattgctaaaagtttattttttagatgccaaaaaatatattttatatacttcatattgtttatatgtctttatttgaatatatcttacgatggggaaatatttatatattttataataaattttactcatttgctaatatgtcatggaatattacttgtattttgtagaatttttccatatgaaaatattccatttactatttttctgaactttattagtttatttttaatatttttacctcttatatttaccataagagagctaattgattcatattatattgagtcgataattaatttattcttaattttaattcctcacgttatttttttaatttacttgaaaggaaagcagatatgacatctgcaaattttaatattaacggttttggagatgtgaaattaacaccctattcaccactcttgggatataaagcttgggattcatttattggttctattcaatccttatctgatttaatctataatgtggataacaatagaaataaaatggaaattactgttaataatgctattcaagctgcagatagctttttaagcagtaattggaagagataacaaaataacaaaataacaaaataacaaatactgcttctttacttgcatccttcgataacattttttaaatttaagaaatgtatctcgagatatacgagaaacaggaaaatttaaacctaatgatattcaacaagcaattggtgatatattcattgctgctggtgatggattacaatatataaaacaacaaacagaggcgatggctcaaagcaaattcttaccaactaaattaaaaactggtttaaatgatgtccttaattctagaatgctaaaatcctctactgttttacagcatgaattgaattaaataaggattatggaaacgagaggcttggcgaatctataatgaatatagatgattttacaccaagtaagatagcaaacttttttgcggatcctgatacatacagcaatgtattagaagaagtatctaggtttatatattccttagttcctgatgatgcaaacccttggaaagggggcgaagattatattggacgagggataagtgaatggggagagttactggaaaaatggtataaacaagattttctcccttatcttgaaaagaatgggaccaatttccgaaatttgaagattggctgcctgaattccctgaatgggcaagagagtggttgaaattagctctcaaacgttcaggcaaatataacgtttacgatcccctcgccctagatttggacggcgacggtatagaaaccgttgccaccaaaggcttttcaggcagcttatttgatcacaccaacaacggcatccgcaccgccacgggctggattgctgcatatgacggttttcctgtgcgcaaattaaacagtaacgggggcattattagcacgacagataccatattccaatctttgcatacatggcttgatcatcaaccaagatgatatttcccaagcacagcatgatgcatgccattgaaaaatatagaaaattaattgaaagcttaaatggatattgaaatgaatgatcacatagtacaaattataagaaggttcgggctaggtaggatatttttttattcgtatagcaaatcatctataataattttttcttcgtatgttgtttattatataatttacaattatcaatttaattacctttcgcttttaatttatttattaccaatattgtgcagtatatatatgtttatattttttttagggaaaactaaggatacattaacgacagagcgaagaaaaaaattttttaattctatttttccacttagaattctaatgataataggttctgagaaaaagaggttaggcatcggtagtttttatttgctaaacctactatggattatttggtgtcttatgattcatagagaacaagtcccattaaataacttaaccctcctattatccttcatattttcattattttttttattatgtgattttgttttattattgaatgtttatgtttatttttttaaattaagagaggcttaatatggttaatcaaatcaaatctgataataattcagtttctattgaatttatataagattttataactgcaagtacggatgtaattaatctgagttacgaaaattttcgtaaaaatttttatacacaaatgtcaactgattctaccaattatgcagccaaacatgaaagtttaggaaaatcggtacaacgtgaattacaaaaaacacaaagtcagttgagacaagttgtaagaaaaatgcagagtaaatataatataaataataaagcacgagtagcagaaatatctttgttaaggcaaatgcaaagccaattttctcgaaaatatgtaaacaaaaatcttggtaacagcaacactttggctcaacaaggcagctacaccaaaaaagacggcacaaccgcgcaagcaggcgatttgctgttggctgctgacaacctgcacagccgcctcacggacaaaatgctatccattagccatgttcgggaaaacacgatttccccgtttgttttaggctgtctaaaacaaataaccataaatgcatatcattatttaaaataaataaaagtatttaactatttttgacaaaattttagaaatagagctagagttttagttaagtagaaattgatagtgcttcaagggaagtattctctatgtttgcattaaagggggtctgataaagctattattcattactatggacttttatttcattattttcaggcggaaatctcatagccgttttgaatttttctcttccttattaattatacaaataattagtatattctgatatggattttttggaaatttttattatgtctgcatttagaaaaatattattaataatatcttgcctattgattgctagctgcagttttgttgaaactattttttatatggctattagcccagaacctgttgtggtagactttcctcttggtaaaaaaacaaaaagatctattgaactcaaacagaaaattggtaaaccttatgcaatatcgttaggaactaattttatacattatgatccaaaacagggggagaggtggattgatgataagttaaactatccatataatatatcggttaaaatatttaaagtggaagaagatggtaaaaaacttattatagatgagttgcttacagagagaagtagaaaattaggaggcggagtatttggagctgggggaaaatacagtatgcatatttatgatttttatttgccggaaggggaatatttatttgagatttctgataatagtgaatatattccactttacgatgaaataaataattctataagaatagtagttaatgcacgaattcagtaaatttttctagaaatgtggggttacttatggctgattattatgcgataactgtaaaatttgcgaagcagggtacgccactgaaacaagagggggtgtatccaagacgggtacgtttgggttgaactgtattcggctagagataaaaaaatcggggctgtactagattagccctaaattccacaccaatcccgcaggattttaagctgttgagacggtgtgccgaagttaaatcgaaattcgcattctttcaagaacagcgggaaagatttacgatcgattccgttgtattttcgcaagacgcgttttgcctgattccaaaaattctcaatgccgttaatgtggttctgacggtctgcaaattccttggaatggttgatgcggtaatggataaaaccgctcacgtccaacttgtcgcagctgctcagactatcggtataaacaatactgtccggcatgattttctttttgatgacagggagtaacgtttcagacttggcattatctacgacaacggtatagccccgtccgttgcgtttcagaatgccgaagacaaccacttttcctgccgcaccgcgaccacgtctgcctttacgccgtccgccgaaatcgctttcgtccggctcgacagggccctcaaaaacctcatcggcagccaaggccaaatgatggttgataaccgtgcggattttacggtagaacagtactgccgaattgggatggatacccaaaatatcggcggcagaacgggcggtaacttccagcacaaaaaaacggagcagttctttctgtacttttttctttaatttgcagtgcgttatcttcatatttcgagggtaacatatctgctaatctagtacagccccaaaaatataccaaaaacagcaaaacaaattgtaaggataggtataggctttgtaaaggtaaattgtgaaaaaagcagttttttaaacgaatgaaacggcttcgggctgaaatatatgctgatgccctgtccttcccgtatatcttgtgtgttgtcaaagtgcaggctgctttgaaatcggtattgccatctatgaaccaccactttgttttatttcagcgggcttgagatgtgtataagaatattgttttgaataaatttaaaaaaatgataatcgttattgacgatttttaaaggaaagcgtagagtgccaattctatgaagcaatacggtaagtaacaatgaaaatatctactgcttgggtatagagcatatttcacaacccgtaactattcttgcggaaacagagaaaaaagtttctcttctatcttggataaatatatttaccctcagtttagttaagtattggaatttatacctaagtagtaaaagttagtaaattatttttaactaaagagttagtatctaccataatatattctttaactaatttctaggcttgaaattatgagaccatatgctactactatttatcaactttttattttgtttattgggagtgtttttactatgacctcatgtgaacctgtgaatgaaaagacagatcaaaaagcagtaagtgcgcaacaggctaaagaacaaaccagtttcaacaatcccgagccaatgacaggatttgaacatacggttacatttgattttcagggcaccaaaatggttatcccctatggctatcttgcacggtatacgcaagacaatgccacaaaatggctttccgacacgccagggcaggatgcttactccattaatttgatagagattagcgtctattacaaaaaaaccgaccaaggctgggtgctcgaaccatacaaccagcaaaacaaagcgcactttatccaatttctacgcgacggtttggatagcgtggacgatattgttatccgaaaagatgcgtgtagtttaagcacgactatgggagaaagattgcttacttacggggttaaaaaaatgccatctgcctatcctgaatacgaggcttatgaagataaaagacatattcctgaaaatccatattttcatgaattttactatattaaaaaaggagaaaatccggcgattattactcatcggaactatcataggtatggagagaacgattacagcactagcgtaggttcctgtattaacggtttcacggtacggtattacccgtttattcgggaaaagcagcagctcacacagcaggagttggtaggttatcaccaacaagtagagcaattggtacagagttttgtaaacaatccaagtaaaaaataatggggctgtcctagataactaggataaactcgattttactaattgttttaaaatggaacaagaacttttatctcactgttgttaaaacgccattcgcactcctttaaatacagctcaaaatgcgctttgggaatgccgttaaacttgcgtaaatgacgttttgcctggttccaaaagttctcaattccattaatatggttttgtcgttcagcaaaatgtgtgctgtgattgatacgaaaacgaagtttcagcgaagctaaaatggctaaattcgcgcacatctaatacatcatagctacgataacaatccgtataaataatgctgtcaggtttcacttgttcacggataataggaaataaagtagcggtttgagtattcggtactgtaaccgtataaaccttaccatttcgcttcaaaagaccgaatacggcgactttaccggcagcaccgcgaccgcgtttgcctttgcgttgtccgccaaaataactttcatctgcttctacttcgccatcaaacatttccaaatgcggactgttttgataaataagtaatcgtaaacgatgaaaataataggctgcggtatttttattaacgcctactaactctgctgccgttcttgcagttacacctgtgacaaatagctcaatgagtttattttgtttatactggcttagacgactttttctcatagggataattctaacttaatttgaatttccctagttatctaggacagcccctattctttaactaatttctaagcttgaaattatgagaccatatgctactaccatttatcaactttttattttgtttattgggagtgtttttactatgacctcatgtgaacctgttaatgaacaaaccagtttcaacaatcccgagccaatgacaggatttgaacatacggttacatttgattttcagggcaccaaaatggttatcccctatggctatcttgcacggtatacgcaagacaatgccacaaaatggctttccgacacgccagggcaggatgcttactccattaatttgatagagattagcgtctattacaaaaaaaccgaccaaggctgggtgctcgaaccatacaaccagcagaacaaagcacactttattcaatttctacgcgatggtttggatagcgtggacgatattgttatccgaaaagatgcgtgtagtttaagcacgactatgggagaaagattgcttacttacggggttaaaaaaatgccatctgcctatcctgaatacgaggcttatgaagataaaagacatattcctgaaaatccatattttcatgaattttactatattaaaaaaggagaaaatccggcgattattactcattggaataatcgagtaaaccaggctgaagaagataattatagcactagcgtaggttcctgtattaacggtttcacggtacagtattacccgtttattcgggaaaagcagcagctcacacagcaggagttggtaggttatcaccaacaagtagagcaattggtacagagttttgtaaacaattcaagtaaaaaataatttaaaggatcttattatgaatgagggtgaagttgttttaacaccagaacaaatccaaaccttgcgtggttatgcttcccgtggcgatacctatggcggttggcgttatttggctaatttgggtgaccgttatgcggatgatgctgctgcaattgtcggtaaggatgcaaacttaaatggtttgaatttatggatgaaaaaaggtgtggaaaacctatgggatgatacggtcggtaaaaagacccgtttagagaaatttgatcgggttgcactgcaacatttcaggcaatatgcgcgtctaattaatcaaaataatggtagattacccaatactagtgaaattgagagaagttactataaagccgttaccgataatggcgtttcttccagtgcagctattgatttagttattaatcgttcacttccggatatggcggatggttattgggcattaggtttggggatagaagccgaacgtatccacaatgagcaagcagtaaataatccgaacggtagcgaaagggataatagaaagcagttaatatctgctttagataaaggatttgatggatcttttaaagagaagcattttacttttttacaatctgtgatgatggatgtaacaaagttaggtgttgaatatacaatagatggttggcaaaaaattggaggttggggtaatgggataatcaatgatttatataaaagtgttgtaaaaagagagtggactggaatatttgagatcgttaataataacatcaagcaaggaaatgaagcttttaaaaatgaaatcaatagcttggttcatgatatgaaagctgctggcaaggaatttggagatgacttaaatacacagtggaataatctcactcaggctgccgaaataatctataatgacatagtagacaatactagtcaaggaatagaaaaaggtgtcaaagccattaaagaattgtctgaaaaaatgaaaaatgctgcttccgatttggctgacggttcagcagagaaagctaaacaagtagtggaagatttggctcaagccgccaaagaagcatacgaaaatgccaaatccacagccgagaaggctgctcaagcagctcgagaattttttaagggcttgcccagttttaaagatctggccgaaaaatttagagatctgttcccaaatccggaaggctggatcgatgatggtcaccaatgtttagctccttgggttaaagaaactaaaaaacgcaatggcaaatatcatgtctacgacccccttgccctagacctagatggcgacggtatagaaaccgttgccaccaaaggctttgcaggcagcttatttgatcacaccaacaacggtatccgcaccgccaccggttgggtttctgccgatgacggtttactcgtccgcgatttgaacggcaacggcatcatcgacaacggtgcggaactcttcggcgacaacaccaaactggcagacggttcttttgccaaacacggctacgcggctttggccgaattggattcaaacggcgacaacatcatcaacgcggcagacgccgcattccaaaccctgcgtgtatggcaggatctcaatcaggacggcatttcccaagctaatgaattgcgtacccttgaagaattgggtatccaatctttggatctcgcctataaagatgtaaataaaaatctcggtaacggtaacactttggctcagcaaggcagctataccaaaacagacggtacaaccgcaaaaatgggggatttacttttagcagccgacaatctgcacagccgcttcaaagacaaagtggaactcactgccgaacaggcaaaagccgccaatcttgcgggcattggccgtctgcgcgatttgcgcgaagctgccgcattgtccggcgatttggccaatatgctgaaagcttattctgccgccgaaactaaagaagcacagttggcattgttagataatttgattcacaaatgggcggaaaccgattcgaactggggcaaaaaatcgccaatgcgactttcaaccgattggacgcaaacggctaatgaaggtattgcactgacaccatcccaagtagcacaactaaaaaagaacgctttagtttccctttctgataaagctaaagcagctattgacgccgcccgcgaccgcattgccgtgcttgatgcctacacggggcaggattccaacacactctattacatgagcgaggaagatgcgcttaatatcgtcaaagtaaccaacgatacatacgaccatctcgccaaaaacatctaccaaaacctgttgttccaaacccgtttgcagccatatttgaatcaaatcagtttcaaaatggaaaatgatacgttcactttggattttagtggtcttgttcaagcatttaaccatgtcaaagaaactaatccgcaaaaagcttttgtggatttggccgagatgcttgcatatggcgaacttcgttcttggtatgaaggccgaagactaatgaccgattatgtggaggaggcaaaaaaagcaggtaaatttgaagattaccagaaagtgttgggtcaggagaccgttgcattattagctaaaacatcgggtacgcaagcagatgatatcctgcaaaatgtaggctttggtcataataaaaatgtttctttatatggtaatgacggcaacgacactctaatcggcggcgccggtaatgactatttggagggcggcagcggttcggatacttatgtcttcggcgaaggcttcggtcaggatacggtctataattacgactacgctaccggacgcaaagacatcatccgctttaccgacggtattacagccgatatgctgacttttacccgagagggcaaccatcttcttatcaaggcaaaagacggcagtggacaagtgactgttcagtcctatttccagaacgatggctcaggtgcttaccgtatcgatgagattcatttcgataacggcaaagtactggatgttgccactgtcaaagaactggtacagcaatccaccgacggttcggacagattgtatgcctaccaatccggaaataccttaaatggcggattgggcgatgactatctgtacggtgccgacggggatgacctgctgaatggtgatgcaggcaacgacagtatctacagtggcaatggcaatgatacgctcgatggaggagaaggcaacgacgccctgtacggctataatggtaacgatgcactgaatggtggcgaaggcaatgatcatttgaacggcgaagacggtaacgacactctgatcggcggtgccggtaatgattacttggagggcggcagcggttcggatacttatgtcttcggcaaaggcttcggtcaggatacggtctataattacgactacgctaccggacgcaaagacatcatccgctttaccgacggtattacagccgatatgctgacttttacccgagagggcaaccatcttcttatcaaggcaaaagacggcagtggacaagtgactgttcagtactatttccagaacgatggctcaggagcttaccgtatcgacgagattcatttcgataacggcaaagtactggatgttgccactgtcaaagaactggtacagcaatccaccgacggttcggacagattgtatgcctaccaatccggaaataccttaaatggcggattgggcgatgactatctgtacggtgccgacggggatgacctgctgaatggtgatgcaggcaacgacagtatctacagtggcaatggcaatgatacgctcgatggaggagaaggcaacgacgccctgtacggctataatggtaacgatgcactgaatggtggcgaaggcaatgatcatttgaacggcgaagacggtaacgacactctaatcggcggtgcaggcaatgattacttggagggcggcagcggttcggatacttatgtcttcggcaaaggcttcggtcaggatgcggtctataattacgactacgctaccggacgcaaagacatcatccgctttaccgacggtattacagccgatatgctgacttttacccgagagggcaaccatcttcttatcaaggcaaaagacggcagtggacaagtgactgttcagtcctatttccagaacgatggctcaggtgcttaccgtatcgatgagattcatttcgataacggcaaagtactggatgttgccactgtcaaagaactggtacagcaatccaccgacggttcggacagattgtatgcctaccaatccggaaataccttaaatggcggattgggcgatgactatctgtacggtgccgacggggatgacctgctgaatggtgatgcaggcaacgacagtatctacagtggcaatggcaatgatacgctcaatggaggagaaggcaacgacgccctgtacggctataatggtaacgatgcactgaatggtggcgaaggcaatgatcatttgaacggcgaagatggcaacgacactctaatcggcggtgcaggcaatgattacttggagggcggcagcggttcggatacttatgtcttcggcaaaggcttcggtcaggatgcggtctataattacgactacgctaccggacgcaaagacatcatccgctttaccgacggtattacagccgatatgctgacttttacccgagagggcaaccatcttcttatcaaggcaaaagacggcagtggacaagtgactgttcagtcctatttccagaacgatggctcaggtgcttaccgtatcgatgagattcatttcgataacggcaaagtactggatgttgccactgtcaaagaactggtacagcaatccaccgacggttcggacagattgtatgcctaccaatccggaagtaccttaaatggcggattgggcgatgactatctgtacggtgccgacggggatgacctgctgaatggtgatgcaggcaacgacagtatctacagtggcaatggcaatgatacgctcgatggaggagaaggcaacgacgccctgtacggctataatggtaacgatgcactgaatggtggcgaaggcaatgatcatttgaacggcgaagacggtaacgacactctgatcggcggtgcaggcaatgattacttggagggcggcagcggttcggatacttatgtcttcggcgaaggcttcggtcaggatacggtctataattaccatgtggataaaaactctgacactatgcactttaaaggatttaaagcagcagatgttcattttatccgttccggaagtgatttggtgcttagcgcttctgaacaagacaacgtacgtatttccggatttttctatggtgaaaaccatcgtgtagatacatttgtctttgatgatgcagctatcagtaatccagattttgccaagtatattaatgctggcaataatttggtacagtctatgtctgtgttcggttctaatactgctgcgacaggaggaaatgtggatgccaatatacaatccgtacagcagccgttattggtaacgccatctgcataaggagcctaatcacattcatggcttaaactgaaaaacagcaatcaagtttattttgattgctgtttttcttaatattgggataagggtcgtattttaattaaccttaatcggtgcacttctagcaatatagtggattcacaaaaaccagtacagcgttgcctcgccttaccgtactatctgtactgtctgcggctttgtcgccttgtcctgatttttgttaatccactataattaatatgactttgcggccgttttgccattgcgtaataaaacgatggggaagtgatgataaaacgtgtgtgtaactatatcagacggcattgtttttctgtttgacggcctcaatccaaaattttgccgacgatttcgcccacgtctttcgacaatccttcctgcgcccgaatgcgctgcaatgcttgtttcaccaagtttttgcggtgcggctcgagcttgttgcagaggttgaacgcctgcactaagcgggcggcgacctgcgggttgaagcggtcgatttcgatgactttgtcggcgatgaagcggtagccgctgccgtcttctgcgtggaaatgcgggacgttgcggctgaagctgccgatgagcgaacgggctttgttggggttttcgaggctgaatttcggatgctgcaaggcggttcgaacctgttgcagggtgtcgctgcggcggcttgagccgacgagggcaaaatatttgtccatcaccagcgcgtcgtctgaaaacttgtcggcaaactgcgccagcaggcggttgcgcgtatcgctttcgttgccgttgacggcggacaggatgccccattcgtgggtcatgttttgcgccatttcgccgtatttttcggcaacggtttcgatgtgcgcggggtcggcgcgcaggacaaaggcgcggcagacgttgcgcagcgtgcgccagccggcggcttcggggctgtattcgtagctttggttttcctgcttcgccgcctgacggttcaattcgtgccatttcggcaggaagtggacggcaagcgtatccaacaaggcttcgcgcgcctgatggtagcgcagcgggtcgatgttttctgcgccgtcccacagctcggcttcggatggcacgcccaaaagcagggctttgaaggcgttgtctaagaggtcgtctgaaatgactttttcgacggcggcaagcagtttttcgtgtttcggcagctcaacgccgtctgaaagcgtggcaaggttggcggcgacggcgcggcggtagagcgtttgggcggcttcccagcgcgtgaaggcgtcgctgtcatgggcgagcaggagcagcaggtcgtcgtcgctgtacggatagttcagatgcaccggcgcgctgaacccgcgcagcagcgagggaacgacggcttcggttacgccttcgagcaggaaggtctgttcggcttcggtcagcagcaacacggcttcggtcgcgcgtttgccctgatagtcgaatgccaccgcttcgccgttgcggttcagcagcccgaccttgacgggaatcatcatcggctgtttatccgtcatatcgggcgtgggcggcacggtttgtttgacggtcaactcgaaaatattgtttttcagacgaccttccgcttccaaaacgggcgtgcccgcctggctgtaccacaaggcgaactggtcgagattgatgccgttcgcgtccgccatcgccgcgcggaaatcgtcgcaggtaacggcctgtccgtcgtggcgttggaaatagagcttcatgcctttctggaagccctcttcgccgagcagggtgtgatacatccgcactacttccgcgcctttttcataaacggtcatggtgtagaaattgttcatctcctcatagctggcggggcgcaccggatgggcggtcgggcctgcgtcttcggggaactggtgctggcgcagcaggcggatgttttcgatgcggcgcacggcgcggctggcgcggtcgccggaaaattcttggtcgcggaacacggtcagcccttccttcagcgaaagctggaaccagtcgcggcaggttacgcggttgcccgtccagttgtggaaatactcgtgtccgaccacggattcgatgccttcgaaatcggtatcggtggcggtgcggctgtcggcaaggacgaacttggtgttaaagatgttcaaacccttgttttccatcgcgcccatattgaaatcgcccacggcgacgaccatgaaaatatccaagtcgtattccaaaccgaagcgcgtttcgtcccatttcatcgcgtttttcaacgattccacggcaaagccgaccttgggcttgtccgcttcggtggtgtaaaactcgattttgacgtttctgccgctcatggtggtgaaatagtcttccgttaccgccaaatcgcccgcgaccaaagcaaacagatagctcggtttggaaaacgggtcttcccatttcacccaatggcggccgtctgaaaactcgccgccgtcgattttgttgccgttggaaagcaaaacgggatagcgttttttgtcggcgacgatggtggtggtgaacttggacatcacatccggacggtcgatgtaaaatgtgattttgcggaagccctccggctcgcactgggtaaacaaattgccgccggaagcatacagccccatcagcgatttgttttccgccggcaggatttcggtttccacttcgacggtgaagcgttcggacggcacgcccgcaatcgtcagcgtctctccttccaacacataatccgccgccgccccgttgattttgacggacaagagtttcgccgaaccgtccaacaccagcggctcccctaccctctgcggctcaaccgtcaaacgcgacttcacgacggtttgcggttcattaatatcaaaatgtaaatcggttttgagaatatggtaggcgggcgtttgatagtctttgagataatgcacggttttgctcatttttttctttcaatgttattttgtttgactggaaaaggcttcagacggcacgggcgcatcccgcgtatgccgtctgaagccgcagcggcggcacgggcgcgccgccggacaaccggtttgaattcaatctttattcccacgcgcggacaaactcttcccaatgcggcttttccccggcttgtgcggacaggtaattccgcatccgtttgatttccatttcgtattcgtccgcatccagcctgccgctgaccagacagaaacgcaggtacatcagataagtgtttgccgcgtcggtttcgcaataattgcggatttccttcagcctgcccgtatggaatgcctcccaaaccttgctgccgtccatacccagcttgcccggaaaaccgcacagtttcgccatatcgtccagcggcacgtttgccctcggctggtaaagcgcgagcaaatccatcaaatcgcagtggcgttggtgataacggctgatgtagttgttccacttgaaatcgcggctgtcgccgaaatcgccgtcgcccatatcccaatagcgcgcggcgttgatgccgtatatcagggagcggtaatgcagtacgggcagatcgaaaccgccgccgttccaactgaccagttgcggcgtatgtttttcaatcaattcgaaaaatttagcaatgaccacttcctcgccgtcatccatctcgccgatggtgccgacatgtactttatcctgcccccaacgcatgcagcacgaaatcgccacaacctgatgaagatgatgctgcataaaatcgccgcccgtctgagcacggcgtttttgctgggcaaacagcaccacttcatcgtcgggcagcgaggacggcagctcgtacaatgttcggataccctgcacatcgggtacggtttcaatatcgaaagccaaaatcgtggtcatgacagcaccttgtatttaaaacggatgcacctattgtgtcattaaaaggcggataaaaaaagaggcaaccccccacaggattgccccaatacctcaaatcagagatttacgcttcacaaacaatacaggctttcgcctgcggctttacccgcgtagctcaactctacgccggcaaactttcgtttcaccgtttccgatgaaaccccgaccaatcgcaagactgaccggaaaatcctttcagacggcatttcctgcctgtcgtgtaattccatgtagcgaaatgtacgccattttctacgctttgccaagcattttttacaatataaatgtcaaaacattaattttataaaattgctgaaaatattaaatatatggatttttattttttatatttcaataaatataaatttaattttgatttatatttaaatttaagcataaaatgtcaaatattaaagtaaacatgaaaggcatatattaaatatttatttataacgctatgtttttaaagaaaattaattttaatatattaactagattgtctgcatatattcataggtttgcggtatttcttccaaaacctgcttcgaatttcccgaccaagtcttaaaaatattgtttttgagatacttaaatagcagcgattatcaaatgaaatctgttcatataatctgccattttgcatttaaaaaaacaatcaggagtttcgactcgaaacgcctgatatgttttgtaattttacgtagtcagtaaaaatcggggctgccttccggacgggttttaaaacgcttgtgcagccaaaaatattgttccggatgttcgcgcaccctgtcttcgataaaacggttcatgcgctgcgcgtcggctttcgcgtcttcacccggaaaggatttccaagcagggtagaaatgcaatgtaaccgtattgtctgcctcgcggacgggaatggcgggtatcacttttgcatttgcaagcgcggcaatgcggctcaatccggtaatcgttgccgtctgaataccgaaaaaatccacaaaaaccgaatcgttgcgtccgaaatcctgatcgggcagatacagaaacggcgcgctgcttttgcggaactgtttgacgagggcgcgcagcccttcggtgcgcccgataaggaagacgttgtgatagcggttgcggcctttcaaaatctgttcgtccaatatcttgtttttttgatgggaatacatactgatcagcgggatatcctgattaagcgcgtacaccgccatctcgaacgcggtgaagtgcggatacaggatgatgactttttcccccgccgccagcgcgtcgtccaaataatgcttattgcggtagcgcaccagcgatttcaaacgtccggcaggcgcgtaccaatataaaccgtattccaacatcagtttcgccatgtgtttgaaatgctgtttcaacacggttttacgcttttcctcactccattcggaaaaacattttgccaaattgatttcgccgatacggcggcgcggtttgaccagaaggtaggcaagcaaacccgtcaggtcggcaatcttgtgcagcagcgcaaacggcagaaactgcaaaacatacagtacaaaaaatataaatttcatctcgatacacattttcttttcagacggcaaaatacaaatgccgtctgaaactattgaaacctgccgcgcttgacctgcatccccgaaggattgagtttggcggcaagcccgtggttgcgtaaggcgtgggtcagcgcgacggcaagaccgtccgccgcatccggctggggcgttcccgaaagtcccaacatctgcaccaccatatgctgcacctgttcttttgccgccttgcccttgccgactaccgcctgtttgacctgcaaggccgtgtattccgaaacgggcagcttatggctgaccaatgccgccaatgccgcgcccctagcctgaccgagcatcagcgtcgatgccggattgacgttgacgaacacctgttccactgccgcctgttgaggcttgtaaacggtaacgacttcgccgatgtgccggacgatgacggcaatcctgtctgccagaggcgcatcggcaggcgttttgatgcagccggaggcgacgtaaaaatgatcccgccccctgacatcgatgacaccgaaacccgttacgcgactgcccgggtcgatgcctaagatacggacgcttgcagccatattcacaacaaaccgtgttgaatcagcttcttacgcagggtattgcggttcagccccagcatcacggatgctttggactggttgccgccgcattgctccatcacgcacaccagcagcggtttttccacctgatgcaataccatatcgtacacgccgcaaggttcggtaccgttcaggtctttgaaatattgttctaaattttgtctgatgcattgggaaatatcgggaagggtatggggcatgattgcactttcaaaggataatcaagtgttcagaaggcatttgggcggtaggcgcacgcccaactgtcggttttttcggcaagtctttcaagataacctgcaagcatgtcgtattgcgccgccgcactgtccaagcggttgatttcacgacgtgtctgttcgccgtcgggcatttcgtcgatgtaccagcctatgtgtttgcgtgcgatgcgcacaccggcggtgtcgccgtaaaacgcgtgtatggcgcggatgtggttcaaaatagcggcggcgcattctgccaaactcaaggcaggcggcaaaacaccgtgttcggcataatgtttcaaatcgcggaagaaccacggcctgccttgcgcgccgcgccctatcataatgccgtcggcggcggtttgtttgaggacggcttgggctttttgcggcgaagtaatgtcgccgttgacccagaccgggatgttcagacggcatttggtttcggcgatgagttcgtaacgcgcttcgcctttgtacatttgcgtacgcgtgcgtccgtggacggcaagggcggcgatgccgcaatcttcggcgattttggcgatgacgggcaggttttgatggtcgtcgtgccaacccaaacgggttttgagggtaacgggtacgcctgccgcacggacgacggcttccaaaatggcggcaaccagcggctcgttctgcatcagcgcgctaccggcttggacattgcagacttttttagcgggacagcccatgttgatgtcgataagctgcgccccaaggctgacgttgtaacgcgcggcatccgccatctgctgcggatcgcttccggcaatctgcacggcaacaatgccgccttcatcggcaaaatcgctgcggtgcaaggtttttctagtatttctgagcgtcgggtcgctggtcagcatttcgcacaccgcccaacctgcgccaaaatctcggcaaagtcggcggaacggtttgtcggtaatgcccgccatcggcgcaagtgcgatggggttgtcgataaaatagccgccgatgtgcataatggatccgcgtttcaaaaaagtacgccattgtacattttttaagcaggatttccaatctccggacgcgcccgcgattgggtcggacaccgttttatggcataatccgcacacagattccctgccccgccactcacaggcgggcagtttatagtggattaacaaaaaccagtacggcgttgcctcgccttagctcaaagagaacgattctctaaggtgctgaagcaccaagtgaatcggttccgtactatctgtactgtctgcggctcgccgccttgtcctgatttttgttaatccactatatttccccgtcctatcggtttcccgtttcagacgacataaggtctgaaagaaagactacaattatgagtaatccattttcctctttaggtttgggtacggaactcgtttccgcactgaccgcgcaaggttacgaaaacccgacgcccatccaagccgccgccattcccaaagcactcgccggtcatgatttgctagccgccgcgcaaaccggcacaggcaaaaccgccgcctttatgctgcccagtctggaacgcctcaaacgttacgccaccgccagcacctcgcccgcgatgcaccccgtgcgtatgctcgtcctcacccccacgcgcgaacttgccgaccaaatcgaccaaaacgtgcagggctacatcaaaaacctgccgctgcgccacaccgtcttgttcggcggtatgaatatggacaaacagaccgccgacctgcgtgccggctgcgaaatcgtcgtcgccaccgtcggacggctgctcgaccacgtgaaacagaaaaacatccatttgaacaaagtcgaaatcgtcgttttggacgaagccgaccgtatgctggatatgggttttatcgacgacatccgcaaaatcatgcagatgctgccccgccaacgccaaaccctgctcttttccgccaccttctccgccccgatacgcaaactggcgcaagacttcatgaacgcgcccgaaaccgtcgaagtcgccgcgcaaaacaccaccaacgccaacgtcgagcagcacatcatcgccgtcgataccattcagaagcgcaacctgctcgaacggctgattgtcgatttgcatatgaaccaggtcatcgtgttctgcaaaaccaaacaaagcgtcgaccgcgtaacgcgcgaactggtgcgccgcaacctgtccgcacaggcgatacacggcgaccgttcccaacaaagccggctcgaaacactcaacgccttcaaagacggcaacctgcgcgtcctcgtcgccaccgacatcgccgcgcgcgggctggacattgccgaactgcccttcgtcatcaattacgaaatgcccgcccagcccgaagactacgtccaccgcatcgggcgcacggggcgcgcgggcgcggacggcgtggcgatttccctgatggacgaatccgaacagaaaatgtttgaatccattaaagagctgaccggcaacaagctgctcatcgagcgcatcgagggcttcgagccgcaatggtgggaacagggcggcgcaaaaccggaaaaacccgaaatgcgcgaaccgagacaacgcaaccgctacgaatccgccaaagcgcaacgcgaaaaaaacacccggccggaaaatgcggcaaacgatgcgggcgcggcttgcggaaaaattgccggacgcagccgccgaagccgccgggaacaccggacgtgcgccctgctccaaccgcgttacggcgtaaaatagccctgaaaatcaaatgccgtctgaacatttcccgtttcagacggcatttttcaaaccggactgacgcatcgggagcaaccgcccgcaccggataaatttctgccgcaaacagtttcagacggcatttgccgcctgtacaatatagtggattaacaaaaattaggacaaggcggcgagccgcagacagtacaaatagtacggaaccgattcacttggtgcttcagcaccttagagaatcgttctctttgagctaaggcgaggcaacgccgtactggtttaaatttaatccattaatagtgtatattaagtacgtctgatatacacgataccctacgagggtgtaagctttagttcacatttaaaatgacctctttaaacctgtctttcggcaggtttctttttaggttgtttggaaatcgtgtgcagacaaggtgtaaaataggtaacagcataaaataatgcggttttaccgcccatatatttacaaaagccaaatttttaaacatatatccttgatatatacacggcgtaaacatatactggaaacatctttaaattttccgaaattttaaatatgagcaactggaaacccaatattccctataacgatttaccacccctgccgccaaaacaggatattgaaagcaaaaccatcctgaaacgttgtatagccgcccgtgcatcccttgcccgtttaaagcaggcggcagaattgataccgaatcaagccatgctgattaacacccttcctgttatggaagcccgtgcaagttcggaaattgaaaacatcgtaaccaccacggacaagctgtttcaatccctgcaaatggatacggaacggcaagaccctgccacgaaagaagccctgcaataccgcaccgccctgtttgcaggctatgaatcactgacgagccgccctttatgcacacaaaccgccatcatggtctgcaacgccatcaagcacccctacgaaatggccatccgcaaaacaggcggcacagccctaaaaggaggcaacagcggaaatgttgtctataccccgcccgaaggagaagaaaccatacgcggcaagctggcaaattgggagcggtttattcacgaaagcggcgatttagacccgcttatcatcatggcggcggcacattaccaatttgaagccatccatccgtttacggacggcaacgggcggacggggcgcatattgaacagcctgctattgattgaaaaagggcttttggatttgcctattttgtatttgagccgctacatcatcgaaaacagggcggactattaccgcctgcttttaggcgtaaccgaacggcaggactgggaaagctggataatctacatcttagacggcgtagctgacaccgccgattggacggtatcgaaaatagatgcgatacgccgcctgttcgagcagacacggcaacacatacggacacacgcacaaggaatctacacgcacgaactggtaaatcttctgtttgagcagccatatacacgcattgccaacctagaagcggcagggatagccaaacggcagacggcctctaagtacctgaaagagctttcagacataggtgtgctgcaagaaatcgtcatcggcagggacaaactattcattcatccgcgcctaatggaactattgcggggagagggcaacagctttacctcattccaatccctcgttaaagcatagccaaaataatcaataatccggaggtcaatatggcaagaaggtcaaaaacatttgaagaagctgctgctgaggttgaggaacgtttcggtcatcgtggcattaagttggtcgagtttgagggtacagccaagccgtgtgtaatcaactgccctaaacatggaaaccaaacctgttcgaggtactccaatatgttcataggaagtagctggggttgcccctcttgtggtaatgagcaagctgcaaaagccggtatagcgacccttaggaagaatcacatagcgttagaaatgctgaaacaggctgtaacaggtatgaccaagcaagagcgcatcacgacgcaagcctacaatgagatgaccaaatccgtggcaggttcaaacagcatagtccttaacgatgtccaaggcgatacgaccatcaacaaccatcatacgcatacgcacaaccacagcgatgccgatggcaaagcactgtcgatgaggctcacaccccgtcctttgttgtcagaccgtcaggcggcggctttcgcccgtacaggcaaactcacgggcagtttcgacctgtttgcttcggtggtcgccccctcgcagtacacgtttgccgttgccatgcccgacacgtccatgtcgccggttatcgaaaagggagacttgctggtggtcgagccgcgtatgtgccctgcggacgaagacatcgcgctgattgaactgtccgacaagcggctggtcgtcgcgcaccttgttatcgatattgcgggcaggatgctgatttatcagacgggcaggccgtctgaagcctttgacctgcccgaaggcagcacgattttaggtgtggtgctggagtcaaaaaacggtttatgtccgccgcacaggcaagaaggcgtgttgattcggattaccgcccctgatgtgtggacggttggtatgatttccgcttccaaaacgtcgtgtacgcgcccgaccgcagcccggaaatcagccgtatgctttcttcgattttggcaggctacgcgtgggataccgaaaacccgttcgtggcgaaatccgaacaacgcctgactgccttgtccgaatgggtcggtcagttggaaaccgaataaatccgtaccgccatacaaaatgccgtctgaatccaatcgggttcagacggcattgccatttcaactgtttttatgattactcggggcgcatctgcggaaacagaatcacatcgcggatggtttgcgaatcggtcagcagcattaccaagcggtcgataccgatgccgcaaccgccggtcggcggcaaaccgaattccatcgcgcggatgtagtcggcatcgtagtgcatggcttcgtcgtcgcccgcgtctttttgcaccacttgcgctttgaagcgttcggcttggtcttcggggtcgttcaactcggaatagccgtttgccagttcgcggccgacaacgaacaattcgaaacgttcggtcagaccttgtttggtatccgaagcgcgcgccaacggtgaaacttcgaccgggtaatcgacgatgaaggtcggattccacagcttgccctcggcgcaaccttcaaacagcgcgagttgcaggctgccgatgcccggggacggcggcaggctttcgccgtgtttgacgatttcttttttcagccattccgcatcgttcaactgctcgtcggtgtagtgcggattgtattttttgatggcttcgagaatggtcaggcgttcaaacgggctttccaaatcgacttctttgccgttgtaagtgatgtttgccgtgccgtttaccgtgcgcgatgcgttgcggatgatgtcttccgccatctgcatcatgcgttcgtagtcggagaaggcttcgtagaattcgatcatggtgaattcggggttgtggcgcacggacatgccttcgttgcggaagctgcggttgatttcaaacacgcgttccaaaccaccgacaaccaggcgtttcaaatacagctcaggcgcgatacgcaggtaaagcggaatatctaaggcattgtgatgggtaacgaagggttttgccgtcgcgccgccgggaatcgggtgcatcatcggggtttcgacttcgagataatgctcgcccaccataaaattacgcacggattggatgatttggctgcgtttgataaaggtattgcgcgattcttcattggcaatcaaatcaacatagcgttggcggtatttggtttcctgatcgctcaaacctttgtgtttgtcgggcagcgggcgtagggatttggacagcaggcggatgccggacacgcgtacggtcagttcgccgtggttggttttgaacaaagtgccttccgcgccgacgatgtcgcccaaatcccaatggttgaagtcgtccaaaacttcttggctcacgcctttgttgttcagataaagctggatttgcccggacacgtcttgaatggtggcaaaactcgccttgcccatttgacgcttcagcatcatgcggccggccactttgacgggaatgccttgcggatcgagttcttctttgccgatttcgccgtattgggcgtgcaaatcggcggcgaagctgtcgcgtttgaagtcgttgggataggcgttgcgctgttggcggatgttgtgcagtttttcgcggcgcagggcgatgatttggttttcgtccaactgcggctcggtttgcggatggttttgttcgctcataaggttttccgaaaaaataaatcaggcgcaatctgtttcagacgacctgaccgaatcacaaaatttgcgcatattttacgcgatgtcggcatttttttccataaacgcgacaatgccgtctgaaagcggtttgcggtttcagacggcatcgttatcatttgaacattcccgccaaattcaataagaacaaaacggtaaaaccggtcagataaatcaagcctgccaatgcaagggcattcatacctgatgtgagtttgtgtttttcatcacctttaaccaaacggtaattcagccaggcaaacacaggggcggacacaaaagcggcaatcatcgcaaatttgagcagattcgccattacgccgtcaaaccagaaaatcaccgccaaaccgctgcccgccacccaaatattccaggcaaagaattcggcgttgcccgttttgtcttttccgcgcagcaggcgcacgggttcggcaatggcacgggcatagccgtccacgacggtaatcgtcgtgccgtacatacaggcaaacgcgataaacgccaccagcgggcgcgaccagccgccgatggtaacggcgtacatattgatcaattgcccgatatatttgccgcccgccatctgcactgcttcgccgttgccgtattgcacaaacgcgcccagtgcaaggaaaaccaaagccaaaaccgcactggcgatataaccgacgttgaaatcaaaaatcccgtcgcggtattcggaaggattgatgcgttgtttttcggttacccacaaagaattgatggcggaaatttcaatcggcgcgggcatccagcccatcagcgcgatcaggaagcccaaaccggcaagcgtccacggtgtcggctcgataaaatcggactgcatctgcataccgcgcgacatagcgatgccggcggcggcaagcgtggcgatactcaaagtaacgatgatgattttggaaacgcgatccaaagcgcggtaacgtccgctcaccaaaataatcaggcaggatgccataatcaaggcggcaaccgtgccggcatcaaacatcagcgagggaatcgccattttgacgatggcggcggttacaatggcgaccgcgcccgcgttaatcgtggcggagaggatgcacaaaatcaggaatacccacaaataaacgcggcttttctcggcataaccttcaatcaggctcttgcccgtgtccagcgtgtaatgcgcgctgaagcggaaaaacgggtatttgaagaggttggtcaggatgatgatgagcgcgatctgccagccgtaaagcgcgcccgcctgcgtcgaggcaatcaggtgcgaaccgccgaccgccgccgaagccatcatgatccccggacccaatgcgttgattttacttttccaagtcgaaatatgttgttcggacataaagtcttccgtatttttaactgtgtttcaacacacagagccgcatattcggacacagccctatctattgctccaatttgggcgggattgcccccaaacaaacccaaatcctaccgtcttcaaaaacaggataccgcccggtagggaaattttgatgaaaacacgtattgtaacgtaatccaaatacctgccaacacacactattagaacttcatgctcaaacttgactatattttccatattacttccaaaaaaaggcataaaacgacattttatgcctaaaattttacaacaaacaaccttacatcgcttttttcgcgcaaacacgcaccatccgatcagcccgtccgttttgcagcaggctggcgatttgataagatggttatgtttttcagacggcatttcagatttccgtccatgccatctgaagccgcaaaacccgattggaggaactgttatgaataccgtatcgaattatctgtccgcattacgcgaagccatgaaggcgcaaggcttggatgcactcgtcatcccttccgccgacccccacctgtccgaatacctgcccgagcattggcaggcgcgccgcgaattatcgggctttaccggctcggtcggcacgtttgtcctgaccaccgatgaagcgggcgtgtgggtggacagccgctattgggaacaagccgccaaacagcttgcgggcagcggcattgtgctgcaaaaaagcgggcaagtgccgccgtacaacgaatggctcgcggcaagcctgcccgaaaacgccgccgtcggcatcccttccgatatggtctcgctcaccggcaaacgcactttggcgcaatcactcgccgccaaaaacatccgcatcgaacacccggataatttactgaatcaagtgtggacaaaccgccccgccctccccgccgaaacggtgttcatccacgaccccgactatgtttctgaaaccgccgccgaaaaactcgcccgcgtgcgcgccgtgatggcggaaaaaggcgcggattaccacttggtttcctcgcttgacgacatcgcctggctgaccaacctgcgcggcagcgacgtgcctttcaatcccgttttcgtgtccttcctgctgattggcaaagacaacgccgtcctgtttaccgaccgatgccgtctgaacgccgaagccgccgccgcgctgcaaaccgccggcatcgcggtcgaaccttacgcccaagttgccgacaaactcgcgcaaatcggcggcgtgctgctcatcgagccgaacaaaaccgccgtcagcacgcttgtgcgcctgcccgaaagcgtgcgccttatcgagggaatcaacccatccacgctgttcaaatcctgcaaatccgaagccgacatcgcccgcatccgcgaagcgatggaacacgacggcgcggcgttgtgcggtttcttcgccgagtttgaagacatcatcggcaacggcggcagcctgaccgaaatcgacgtggacaccatgctttatcgccaccgcagcgtgcgcccaggcttcatttcattgagtttcgacaccatcgcaggcttcaacgccaacggcgcactgccgcattacagcgcgacacccgaaagccacagcaccatcagcggcaacgggcttttgctcatcgactccggcgcgcaatacaaaggcggcacgaccgacatcacccgcgtcgtccccgtcggcacgccgagtgccgaacaaaaaagcgacaacaccctcgttctcaaagcccatatcgcgcttgccgaagccgtgttccccgaaaacatcccctcgccgctgattgatgcgatttgccgcaaacccctgtggcaggcgcaatgcgactacggccacggcaccggacacggcgtaggctatttcctcaacgtccacgaaggcccgcagcgcatcgccttcgccgcccccgccacgcccgaaaccgccatgaaaaaaggcatggttacctccatcgaacccggactctaccgcccgggaaaatggggcatccgcattgaaaaccttgccgccaaccaagccgtcgccgcccctcaagaaaccgaattcggcagcttcctctgttttgaaaccctgaccctctgccccatcgacacccgcctgatggacaccgccctcatgaccgacggcgaaatcgactgggtcaaccgctaccacgccgaagtccgccgccgcctcgagccgctgaccgaaggcgcggcaaaagcgtggctgatcaaacgcaccgaaccgctggcgcgttaaacagcacggcgcaaaaaatgccgtctgaaagcccttcagacggcattggtttcccaaaacatcccgcaccgttttcatcttgccgcaagcaaatatagtggattaacaaaaatcaggacaaggcgacgaagccgcagacagtacaaatagtacggaaccgattcacttggtgcttcagcaccttagagaatcgttctctttgagctaaggcgaggcaacgccgtactggtttttgttaatccgctatattccgccatctctaagatttacagcgatacacgggtgatttaaggaatgcccgaaccgtcattcccgccacttttcgtcattcccacgaaagtgggaatctagaaataaaaagcagcaggaatttatcggaaataactgaaaccgaacagactagattcccgcctgcgtgggaatgacaattcgagacctttgcaataacataggttactaaaattttatgctcaatctcattttcaaaatgcaaaacttttctgatttttcctactttttgctcaatattaggaaggttttaggcaattgaaaattttttggcgcatttttatgcgtcaaatttcgttaacagactatttttgcaaaggtctcactatatgtgcaaaccaagccaaaaatgcgaaataccgtctgaaaatctttcagacggtatttgctgtctttattgccgtttttcttccgtatccggatttttgtttggggctgaagcagattggcagtcagattgcaatcaaagaatgaaggcgagccgtcaaaaacaaagctatccgcttcaccgccccgatatttagaatttgtggcgcaaaccgacggaggcggcattaatttgagtgtagttgccgatgccggtattgcgtttcagccaagcgccagacacgatggcggaagtgcgtttggaaaaatcataatcaacgccggcgatgatttgatcgtagctggtattttcgccttttttaccgcgttcgataaagtcgaaaccatgggcatagctgatgcgtggaactgcattaccgaagcggtaggaagcagtggcggcaatttcggtcgtactgtttttggttttgtcgccattttcagacaaatccaactgagccgccaaggcgagattcaagccgccttcctcatagccgcccgtcagacggtgtacctgatggtttttcaagggatcggtacctttggcttgatcactcccgctgccgatcaagaacaactcaaaagcattacgtccgacattggcgtgtctcgcatatttaaaggcatagttcccggcaaaaccgccatttttgtaattcagaccggcataatacacatccgatccgggcttgccgacaacagccggaacgagagtaagattattgtttgtattcttagtataataagccggcgtataggcggacttgctgttttggatcggaacgaattgaacgctgccgctgaaaccggaaaattcgggggaatcgtagcgtacggaaaccggcatgtcgtcgtggcgtttgaaaatacccaattgcgaagccacatcattattgctgtcccaaggatcaatggcttggctggcatcgtcaaactgattcgcaacgcgaccggcgcgcagcgtaccgaattcgcctgccaagccgataaaggattccctgttgccccactgggtcgcgccgccgccggcaacggatacgtcttgctcaagctgccaaacagccttcagcccgtcgcccaaatcctcactccccttaaagccgataaacgagccgaaatcactgattttcgtcctgatgcggcttttggccttagtaactttagtaacttttacctgaccgctcgctccaccgttagcggcttgtgcttcagtcaattgcagctggtagttcctgccttccacgccggctttgatttcgccgtataggctgacatcggcaacggccgcaagcggcagtgcggacaatacgagggcggtaagtttttttcgcatatcggcttccttttgtaaatttgataaaaacctaaaaacatcgggcaaacacccgatacgtcttcaattatacccccccccccgcaaaaaaccatttttcagaacaaatatctgataaatgccgcaacctttattttaaaaatgattatattttgatataaaacaatagcttattttttcaaaaacgttgtgtttctacaacacaattcaagcgcagacctcgtgcgagccgatgcgctgctgcccggatgcagtctcggctttttaaaacgccataaaaaaacacacgcggcactttatagtggattaacaaaaacaagtacggcgttgcctcgccttagctcaaagagaacgattctctaaggtgctgaagcaccaagtgaatcggttccgtactatctgtactgtctgcggcttcgtcgccttgtcctgatttttgttaatccgctataaagaccatcgggcatctacagccgtcattcccgcgcaggcgggaatctagaatttcaatgcctcaagaatttatcggaaaaaaccaaaacccttccgccgtcattcccacgaaagtgggaatctagaaatgaaaagcagcaggaatttatcggaaatgaccgaaactgaacggactggattcccgcctgcgcgggaatgacgggattttaggtttctgattttggttttctgtttttgagggaatgacgggatgtaggttcttaggaatgacgtggtgcaggtttccgtacggatggattcgtcattcccgcgcaggcgggaatctagaatttcaatgcctcaagaatttatcggaaaaaaccaaaacccttccgccgtcattcccacgaaagtgggaatctagaaatgaaaagcagcaggaatttatcggaaacgaccgaaactgaacggactggattcccgcctgcgcgggaatgacgggattttaggtttctgattttggttttctgtttttgaggaatgacgggatgtaggttttcttaaccctgcgtcctagattcccactttcgtggtaatgacgggatgtgggttcgtgggaatgacgtggtgcaggtttccgtgcggatggattcgtcattcccgcgcaggcgggaatctagaccttagaacaacagcaatattcaaagattatctgaaagtccgagattctagattcccgctttcgcgggaatgacgaaaagtggtgggaatgacggttcagttgctacggttactgtcaggtttcggttatgttggaatttcgggaaacttatgaatcgtcattcccgcgcaggcgggaatctggaatttcaatgcctcaagaatttatcggaaaaaaccaaaacccttccgccgtcattcccacgaaagtgggaatctagaaatgaaaagcaacaggaatttatcggaaatgaccgaaactgaacggactggattcccgcttttgcgggaatgacgggattttaggtttctgattttggttttctgtttttgagggaatgacgggatgtaggttttcttaaccctgcgtcctagattcccgcttttgcgggaatgacgggatgtgggttcgtgggaatgacgtggtgcaggtttccgtgcggatggattcgtcattcccgcgcaggcgggaatccagaccttagaacaacagcaatattcaaagattatctgaaagtccgagattctggattcccgctttcgcgggaatgacgaaaagtggtgggaatgacggttcagttgctacggttactgtcaggtttcggttatgttggaatttcgggaaacttatgaatcgtcattcccgcgcagacgggaatctggaatttcaatgcctcaagaatttatcggaaaaaaccaaaacccttccgccgtcattcccacgaaagtgggaatctagaaatgaaaagcagcaggaatttatcggaaatgaccgaaattgaacggactggattcccgcctgcgcgggaatgacgaattttaggtttctgattttggttttctgtttttgagggaatgacgggatgcaggttttcttaaccctgcgtcctagattcccgcttttgcgggaatgacggcgacagggttgctgttatagcggatgaacaaaaaccagtacggggttgtctcgccttagctcaaagagaacgattctctaaggtgctgaagcaccaagtgaatcggtttcgtactatctgtactgtcttcggcttcgtcgccttgtcctgatttttattaatccactataatttcctgcgtgtgtcgggtgtatcgaaatcaagccgaatcaaatatatcggacttcgataatgtcgtattcgcgcacgccgcccggggcttggacttccgccgtatccccctcttccttgccgattaaggcgcgggcgatgggtgagccgacatagattttgccctgtttgatgtcggcttcgtcttcgccgacaatttgatagataacgtgttcttccgtttccaaatcttccagcgtaaccgtcgtaccgaacacgattttgccttcggcgtggatttcggtcggattgatgatgtgggcaacggaaagtttgtgttccagctcggaaatgcggccctcgataaagccttggcgttctttggcggcttcgtattcggcgttttcggacaaatcgccgtgcgaacgggcttcggcaatcgcttcgatcacttcgggacgcgccacgcttttgagctgctgcaattcctgtttcagcaattccgcaccgcgtacggtcagggggattttttgcatcggtcttttttctccatattccggcacaccggtttgcggcagcaagcataccgcgtaccgtcttgttttgtgcgtccggatattaaaataaaaatacaagccgcccggaaaatcggcggcttgtctgtcgttgaacagcggctattctaccaaattctatgaaattggcaatcgtgccgcgccgccggcaaacgcgccatgtccgcaacaaaagctgaaaatatgccgacaaagaaattttagaaacaaaaaatttaaaaataatcaattttcggcataaaaaaccacatttacggactttaaaaccgaaaatgccaagcctgagatttttcatacagcatttgcaccagtataatgcaggctgtttttatctttaataatattgacgttttgccatgaccgaatccgtccgcctccccgtcgcccgtctcaaaccttccaccgtcgccctgcccggctccaaaagcatcagcaaccgcaccctgctgcttgccgccttgtccgacaatgcttgcgaaatccattccctgctcaaatccgacgataccgaccgtatgctcgaagcactcgataaactcggcgttcaaatcgaatatcttgccgaagaccgtctgaaagtgcacggcacaggcggacgcttccccaaccgcactgccgatttgtttttgggcaacgcgggcacggcgttccgcccgttaaccgccgctctggccgttttgggcggcgattatcatctgcacggcgtgcctcgtatgcacgaacgtcctatcggcgatttggtcgatgcgttgcggattgccggggccgatgtcgaatatctcggcaaggaacactatccgccgcttcatatcggcgaacgccaagacaacggcgagcgcgtgattccgattaaaggcaatgtgtccagccagtttctgaccgcccttttaatggcgttgccgctgaccgggcaggcgtttgaaatccgtatggtcggcgaattgatttccaagccctatatcgacattactttaaaactgatggcgcaattcggcgtacaggttatcaatgaaggctaccgcgtcttcaaaattcccgccgatgcgcactaccacgcgcccgaacacttgcacgtcgaaggcgatgcctccagcgcgtcctacttcctcgcagccggtttgattgccgccacgcccgtccgcgttaccggtatcggcgcaaacagcatacagggcgatgtcgcctttgcccgcgagctggaaaaaatcggggcggacgtggtttggggcgaaaacttcgtcgaagtttcacgcccgaaggaacgtgccgtccaatcctttgatttggatgcgaaccatatccccgatgccgccatgaccctcgccatcgtcgcgcttgctacagggcaaacctgcacgctgcgcaacatcggttcgtggcgcgtcaaagaaaccgaccgcatcgccgcaatggcaaacgagttgcgcaaactcggggcaaaagtcgtcgaagaagccgaagcaattcacatcaccccgcccgaaacgctgacacccgacgccgtcatcgacacgtacgacgaccaccgcatggcgatgtgtttctcgctggtttcgctgttgggcgtacccgtcgtcatcaacgatccgaaatgcacccacaaaaccttcccgacttatttcgacgtgttctcatcgctgaccgaaacagcggaataaggcggcattttgccgcgattccggcgcggcgcggcgggcggctcattctgtaaaaaaagtatgtgcgccgaggtagtttttggcgtaaaacggtgtggagagtttttcggttttgatggttttgccgctgctgggggcatggatgaattcgccgttgccgatgtagagtccgacgtgtgagtagcggtgtgcgccgccggtgttgaagaatacgaggtcgccggccttgaggcggctgtcggggattttgcggcttgccgccgccatgtcgcgggcggtgcgcggcagcttgacgttgagggcgtttttgtaaacgaattgaatcatgccgctgcaatcgaagccggttgcggtgctgctgccgccccatttgtagggcgtgccgatgagtccgaggctgtggagcatgagttcctgcgagccttgtgtgcggtcgatgtggctgatgcggacggcttggatttgccggactgtctgtttgggtttcggttggcggtgtttgccggaggtcgtgccgcatgaggcgaggagcagtgcgctgagacagaggaaaagggttttgtcggggggaaacatggtttttcctttgcgggttcggatatccgtctgaaggtgtttcagacggtatagtggattaacaaaaatcaggacaaggcgacgaagccgcagacagtacaaacagtacgaaaccgattcacttggtgcttcagcaccttagagaatcgttctctttgagctaaggcgaggcaacgtcgtactggtttttgttaatccgctatatttctataataaaccttctatgggcagcagggataggatttttgcggcgatgcgtttccaaagtttggcttcgggttcgttcgggtaggtttttcgggtggcgggatcgtgccattgcaggcggttgtgcctgtcgagggtaacgcggtaggcgtaggcgggtgtggtatcggcaagggtgcgctccatctgttctgcgattttggggctttcgataacaacgcccatttcggtgttgagacgcgcggaacgggggtcgaggttgaacgaaccgatgaagatgcgtttgccgtccacaatgaaggttttggcgtgcaggctggttacggagctgccggtcaggcctttgtcttttgtggcggggacggcatggttgggttgcagctcgtagagtttgatgccggctttgagcagcggttttcggtatttgacatagccggaatggacggcggcaacgtcggtcgcctgcagcgagttggtcagaacggtaacgtctatgccgtcctgcaccagttttgccagtgcgtctgtgccggattttgtgggaacgaaatagggtgaaaccagatagacgcttttttcgggctgtttgagcgcgtcttgcagccgcccggcaatcggcggtttgcggcggtcgcggtcgagtccttttgcagggtcgtcgctgatgaggcgggttcggacgctctgccagtcgatgcatcctgtctgtattttttggtagaggggcgactgttcgacggtttcgcggtagcgcaggagcgcgtgtctggacgtttcgtcgttgtatccgagtgcttgaagacccttgccgatgtcgccgctgcggatgatgcgcgtggcgttgtgggcggaatggcttgcccagtagcggtcgaagtcgtgcgatacttcgccgacgacgctgccggtggcgaggatgtccaaatcggcgaaaacggtgtcctcaccgactttgaagtattcgtcgccgatattgcgtccgccgagtatggtggcgcggttgtcggcggtaaaggatttgttgtgcatgcggcggttgaggcgggggaagtcggtcaggtagccgagtgcgcgccattttcgtaagacgaaggggttgaacaggcgcacttcgatattgggatggctgtcgagggcaagcaggaggtcgtccaatccgcgcgtgttgttgtcgtccaacagcaggcgtacgcgcacaccgcgttctgcggcaaggtacacgaggttgaacagcagcctgccggaaatgtcgttgcgccagatgtagtattgcaaatcgaggctgtgttcggcagattcgataagggcggcgcgggcggcaaaggcttcgtgggggtcgttcaacagatagatatcggatagcccgttggtatgaggggtgtgccggatttgcaggatgttgtccaggcggacgggtttggaagtattgaaatgacggctttccgtccgttcttccagtgggggcaaccatgaagaacatgaacagagaaggaggcataaaagggaaattaggctgcgtgttttcatcagggatatggtttcagacggcattgcctgtgttttggggttggcgcgcatggaagtgcggtatcataatccaaacgttgaaacgggtaaaagttttgcgtgtggaccgcttcaggacggtgtgttccgtgtcaggttggtgccgtctgaaacgtgcagccgtttgaaaaccagcgatgatgcaagggtgatgccgccgatgctgagcagggtcatacggaaggcggaatgcagacctgaagaagccggtatcagaaatgtccagtttttaaggattaatgcgccggcaacaatgcccatgctgatggcaagctgttggttgaccgccatcaggctgttgccgctgcctgtttgttgcgggcgcaaatcggcgagggtcagtgtgttcatggcagaaaactgtagggagttgcacgcgccgatcgccagcgagaggaaaacccaaatccacagcggcgagtttccgtcaggcagggcgagcagcatgatgaaggcggcaagcagcttggtgttccaaagcagtaccgtgcggtagccgaaacgtttcatgagcggtgcaatcagcggtttgaccagcagcgaagacagggcgacgggtgcgaccagccaacccgacaggcttgcgccgaagccgaaagcgatttgaaacatcaggggcatcagaaaaggaatcgagctgatgccgagacggctgaacagattgcccgccagtcccagacggaaagtgcgtatcagaaacaggtcggcggaataaatcggtttggacgcggttttcatatgtcggaaataacggcgtgcaaacagcagtccgccgcacagcggcaacagtgcaaaatacggaggcagcgcgtgcgacaggctttctgccgaaagtaacaagaggcacgcggcggcagaaaaaatcagataacctttgaagtctaaagagatattactgcctttaatatcgggcatgatgttgcgtcccaatatgaaacccagcagaccgatgggcaggttgagcaggaaaatccagtgccacgaagcgtattcgaccaaataaccgcccgccaaaggccctaaaaccggcccgattaatgcgggcataaccgcataattgatggcattgagcagcttggacttgtcgtacacacgcaagatggtcagacgcggtatcggaaccagcatcgaaccgccgatgccctgaacgacacgggaaagcgtcaattcaaacagcgaacccgatgcggcgcacaatgccgatccgagcataaaaacggcaatcgaaccgaaaaagacttttttcgttccgaacctgtccgccaaataaccgctcaaaggaatcagcagggcaaccgtcagcgtgtaggaaataactgccagttgcatatccagaggcgactcattcaggtcggcggcaatttcaggcagtgcggtatttaaaatggtcgcatccaacatctgcataaaaatggcaattgccagcagaagcggcagccaaggggatggtgcgcgggcggatagggtgtttttttccatagggcgattgtaccccatccttgtgccgttattgttttcagatgctgtctgaatgccgtcagagtcggcatcttgaatgttcacaagcaaacgaaccggcattgcattgtaatgataattattatcgaaaaccatcagattaaggtacagtaagcgttatgggggcagtttgtaagaaaaaccggattattttttaaaattagacttgacccgcaacagtcaattacttaaagtaaacgcttacctttctacagagaaaaacgggtttcccgttatcaaaaaacatgagcgcaaccattcccccaaaaatcatccgatacgacagcaatccgaccgatgtctattttttcggcacttgcgtccttgatctttttatgcccgaagcaggcatggatgccattaccctaatcgagcagcagggcatacgcgtccatttcccgatggcgcaaagctgctgcggccagcctgcctattcatccggccatccgaccgaagccttcgatgtcgccaaagcacaactcgaccttttccctgaaaactggccgatcgtcgtgccgtccggctcgtgcggcggcatgatgaaacaccactggccgacgctgtttaaaggcagcgagtacgaggaaagggctgtggattgcgccggccgcatcatcgagtttacccatttcctgcttgccatcggtttcaaacccgaagacaagggcgaaccgctcaaagtcgccgttcacacttcctgcgccgcccgccgcgaaatgaatgtccatctttcaggctggcaactgattgacggtatggaaaacgtcgaacgcatcgtccacgaccacgaaagcgaatgttgcggcttcggcggcacattctccgtcaaacaagccgatatttccggcgcaatggtaacagacaaagtcgccgcgctgaaagaaaccggcgcaaccgaaatcatcagcgcggactgcggctgtatgatgaacatcggcggcaaaatcgccaaggacgagccggatatgccgcgtccgaaacatatcgcatccttcttgttggaacgcaccggaggcaaagcatgagcgcgcgtgaaaatattttggcaaaactgaaaaaagccgacgcattgccgatggaagaacctgcggtttttgattattaccgtgaaatgggtgtttcttggggcagcgaagttgagcgtctgaaacattgggctgccgctatgcgtgcggtcaaaaccgaaatttattgggtgacgaaaagcaattggatgcaggttttccgcgaagcggcagaaggcaagggtttgaaaaacatcctgctgcccttggcgaccgaacacggacaaattgcccgtgccgcattggcggacagcaatatcgaaccgattgccttcgagcgcgaaatcgatacttggaaaaccgagtttttcacgaacatcgatgcgggcttcagcggcgcgcaatgcggcatcgcccgcaccggcacgctgatgctgttttccagccccgaagaaccgcgtactttaagcctcgttccgcccgtgcatttctgcctgttcgatacgtccaagatgtacaacgagtttcataatgccgtcgaaggcgaaaaactggtggaaaacggtatgccgaccaatgtattcctgatttccggcccgtccaaaaccgcagacatccaactgacgcttgcttacggcgcgcacggcccgcgcgatttggtcatcctcgccatcctgcccgaccacatttcccctgccgatttggaggaaaacgcatgactacgcaaaccatcaaatttcacatgaagccggaaactttcaagcaaaacgccgcaatttcccttcaagacaagcctttgcgcaaaagcctgcgtaccgcgatggatatgctgatgaccaaacgcaaagccgttttgaccgacgaagaagagctgcaaagcctgcgcgatttgtgcgaacacgtccgtcagcgctcattgtctaaattgccagccctgctggagcagctggaagaaaacctgactaagttgggcgtgaaagtgcactgggcagaaaccccgaccgaagcctgccaaattatccacgacatcatcacagccaaaaacggcaagctgatggtcaaaggcaaatcgatggtcagcgaggaaatcgagctgaaccattatcttgaagcaaaaggcattaaagcggtagaaagcgacttgggcgagttcatcgtccaaatggcaggcgaaaaaccgacccatatcgtgatgcctgctatccacaaaaccaaagaacaggttagcgaactgttccaccaaaacctcggtacgccgctgacagacgatgtagaccaactgaccggcttcgcccgtaaagcactgcgcgatatttacagcactgccgatgtcggtttgagtggcgtaaactttgccgttgctgaaacaggtacgctgtgtctggtggaaaacgaaggcaacggtcgcttgagtaccaccgtaccgcccgtgcatatcgctattaccggcattgaaaaagtggtggcgaaattgtccgacatcccacccttgtacagcctgctgccgcgttctgccattggtcagaacattaccacttatttcaatatgattaccggcccgcgccgcagtgaagaattagacggtccgcaagaaatgcacttggttctgctcgacaacggccgcagccaggcttatgccgaagaccaaatgcgccgcaccctgcaatgtatccgttgcggcgcgtgtatgaaccattgcccggtttatacccgcatcggcggcgcggcatacggcacaacctatcccggtccgattggcgagattatttccccgcacctgttaggcttggatgccactcgcgacctgccgaccgcctgcacgatgtgcggcgcgtgcgtggaagtttgtccggtacgcatcccgattaccgaacaaatgcagcgtttgcgcgttgaagcgcaacgttcgccgaccgaaaccgtgccgcaccccatccgggggcaaggcgcatcgcataccttcggcgaacaaatggcgtggcgcacattcaacggtattttcagcggcagcaaaacctaccgcgccttcggttgggcagccaccaagttccgcaacctgaccccgcgcaaacagttgggttggacgcaaaaccgcgtgccgatgaaaccggcgaagaaaaccctgcacgaactaatggcagaaaaaatgcgccaaaaagaacaggcataaaaagttgttcgcaaaaatgccgtctgaaacccgaaacagggcttcagacggcatttgtatagtggattaacaaaaatcaggacaaggcgacgaagccgcagacagtacaaatagtacggcaaggcgaggtaacgccgtactggtttaaatttaatccactatatattcgcagacggtgggttttaaatttgttccaattccatattcaaaacagcctgttcctgtttggctcggaagtctgccagtttttgcgccagttcgggggtttcgttggcgagcatggaaacggcgaacaatgcggcatttgccgcgcctgcctcgccgatggcgaatgtggcgacgggtacgcctttgggcatttgtacaatcgataaaagcgaatcttcgccgcgcaggtatttgctggggacgggtacgcccaaaacggggacggtggtcttggcggcaaccataccgggtaaatgcgccgcgccgcccgcacccgcgatgatggctttgatgccgcgcgcccgtgcggtttcggcgtattggaacatcaaatccggggtgcggtgtgcggaaacaacgcgcgcctcatattctacgccgaactcttcaagaaactgcgctgcctgccgcataacgggccaatcgctgttgctgcccatgatgatgccgatttgtatcataaatcctccttggtgcggatggggtaaaaagcggaaaaatggaaaaactatcgtttgcgcacggctgcggcggcgcgttttgccgccgggctgccgggataggtctgtatcaggctgcgccaagtcgcccttgcaatgtctttttgctgaagcctgtattggcattcgccgattttgaacatggcttcaggcgcggttgggctgtctttgaaacggttggcgtaacgccctccgatttcgatgacggattcgcagttgcccatacgcgccctgctttgcagcaacaggtacatactgcgttgcgcgatgctgccgccgtcgcctccgtccgcgcctttcaacagggaggcagcggcagaaaacttgccgcttttatagtgtttgagtgcctgattgtagaggttttgtgcggtttcgacagtatgtgcggatgcgctgccgccttcggtattgaggtaatgctctttcaacttgcggtcgtcgagtttttggacgtatgccctgccggaagaatgtgtttttgcgtgttccagtgctttgactttgccgtttaaggtttccacttcgttcgacagccggacgattttgccttccagatagtccaaacggtcttgcaaggtcggaacgggatagggaatgccgtctgaagcattttcccgtgtcgacatttcggtttggctgcctgccggaacgggtgaaacggaagcacaggaggcggacacagacagccaaatgataaaaagcggtaatttgatcttcattattttttcagaagcagggtcaagccgtcgccgacgggcagggtgatggggacgatgcgcgggtcgttcggcaggttttgattgaaatctttgaggatgccgacgctgggcggcgcatcggaagccgcttcgcgcatcacccttccgttcagcaaaatattgtcgatggcgatgatgccgccttgacggacgagtttgaggcaacgctcgaaatattgcggcgtgggcggtttgtctgcgtctatcagtgccaaatcgtagcttccggcttcaccctgtgcaatcaaatcatccaatgtcagcaatgcgggttgcaggtgcaggctgattttatgtgccacaccggcctcgttccaaacctgacgcgccgtatcggtaaaggttacattgatgtcgcaggcggtaatccgcccgtgttcgggcagtgccaatgcaagcgcggtgctgctgtatccggtaaatacgccgatttccagatatttttccgcacggatcagctttgccagccaaaccaaaactgccgcctgttcgcgcgcaatcgccattttgcccatacggtgatgcccggtcttctcgcgcagccgcgtcaaaacgggatgttcgggttcgccgatggcgttcaaatagttttgcaggtccggtgcgacattggacagatgggtcgtcatttcggcggattcagtcttggtaataggtataaggttttttcgccacttttgccgcctcgaagttttcctgttcttcgggattgagttcgacatcccacaaaagccccctgttttccaaacgctgctgttccaactcaggtttttcttcaatcaggcggttgaggaattgtgtggcatcggattggtagtgatacatctttgtgctccaattttacggaatatggcgtgattatactggtattttccaaacgggataaacggcttttatcaagaatacgggcagaaagataaggggttttattatagaataagacgttttttgcaacggaagcccgccttatgtcccgaatcgccgccctgcccgaccatcttgtcaaccaaatcgccgccggcgaagtggtcgaacgccctgccaacgccttgaaagaaatcgttgaaaacagtatcgatgcaggcgcaacggcgattgaagtcgagctggcgggcggcggcatccgcctgattcgcgtcagcgacaacggcggcggcatccaccccgacgacatcgaacttgcgctccaccgccacgccaccagcaaaatcaaaaccttaaacgatttggaacacgtcgccagtatgggctttcgcggcgaaggtttggcaagcatcgcctccgtcagccgcctgaccctgaccagccgtcagaacgacagttcgcacgcgacccaagtcaaagccgaagacggcaaactcagcagccccaccgccgccgcccaccccgtcggcaccaccatcgaagccgccgaactcttcttcaacacccccgcacggcgcaagttcctcaaatccgaaaacaccgaatacgcccactgcgccaccatgctcgaacgcctcgcgctggcgcatccgcacattgccttctcgctcaaacgcgacggcaaacaagtgttcaaactccctgcacaaagcctgcatgaacggattgccgccattgtcggcgaagactttcagacggcatcattgggaatcgacagcggcaacggcgcgctgcggctctatggtgcgattgccaaaccgactttcgccaaaggtaaaaccgacaaacaatactgcttcgtcaaccatcgcttcgtgcgcgacaaagtgatgctccacgccgtcaagcaggcataccgcgacgtattgcacaacgcactcactcccgccttcgtcctctttctcgacctgccgcccgaagccgtggatgtcaacgtccacccgaccaaaaccgaaatccgcttccgcgacagtcagcaggtgcaccaacttgtgttccacacgctcaacaaagcccttgccgacacacgcgccaacctgaccgaaagcgtcggcaacgcaggcgaagtgttgcatgacattaccggcgttgtctccaccccaatgccgtctgaaaacgacagcgaaaatctgtttgatagcgtatccaactacccgacaggcaacaaatcagatacacacaatgcctttggttcatcaggcaaaaccgcgcccatgccctatcagtccgcatatgcgccgcaacaacgcagcctgtccctgcgcgaaagccgcgcggcaatgaatacttacgccgaactttacaaaaaaaccgacgacatcgaccttgagttaagccgattcgagcaggcacgtttcggcaatatgccgtctgaaacgcctgctccccaaacagatacgccgctttcagacggcatcccgtcccaatccgaactgccgccgctcggttttgccattgcccaattacttggcatctacattcttgcccaagccgaagacagcctgttgctcatcgatatgcacgccgccgccgaacgcgtcaactacgaaaaaatgaaacgccaacgtcaggaaaacggcaacctgcaaagccaacgcctgcttattcccgtaacctttgccgcgtcccacgaagaatgcgccgcccttgccgattatgccgaaacgctggcaggcttcgggctggaattatccgatatgggcggcaacaccctcgccgtccgtgcagttcccgccatgctcggcaaagccgatgtcgtctcgctcgccaaagacgtattaaacgaactcgcccaagtcggcagcagccaaaccatcgaggaacacgaaaaccgcatcctcgccaccatgtcctgccacggctcgatccgcgccggccgccggctcaccctgcccgaaatgaacgcccttctgcgcgatatggaaaatacgccgcgcagcaaccagtgcaaccacggcaggccgacttgggtcaaactgactttgaaagaattggacgcactgttcttgcgcggacagtaagccgaaagtgctagaatacgccgcccgagaccgccgttcagacggcattccgacgcaccgacagaaacatcacgaccgaaaccaagagaaaaacatggcctatcaagttctcgcccgaaaatggcggcccaaaacctttgccgacttagtcggtcaggaacacgtcgtcaaagccctgcaaaacgccctggacgaaggcaggctgcaccacgcctacctgctgaccggcacgcgcggcgtaggtaaaaccaccatcgcccgcatccttgccaaaagcctcaactgcgaaaacgcgcaacacggcgaaccttgcggcgtatgtgaaagctgtacgcagatcgatgccggacgctacgtcgacctgctggaaatcgacgccgcctccaacacaggcatcgacaacatccgcgaagtcttggaaaacgcccaatatgcaccgaccgccggaaaatacaaagtctatatcatcgacgaagtgcatatgctttccaaaagcgcgttcaacgctatgctcaaaacgctggaagagccgcccgaacacgtcaaattcatcctcgccaccaccgatccgcacaaagttcccgttaccgtcttgagccgctgcctgcaattcgtcttacgcaatatgaccgcgcaacaggttgccgaccacctcgcccacgtcctcgacagcgaaaaaatcgcctacgaacccgccgccctgcaacttttgggacgtgccgccgccggatcgatgcgcgatgccttgagcctgctcgaccaagccatcgccctaggttcgggcaaagttgccgaaaacgatgtccgccaaatgatcggcgcggttgacaaacaatacctttacgaactgctgacaggcatcatcaaccaagacggcgcagccctgaccgccaaagcgcaggaaatggcggcgtgtgccgtcggctttgacaacgccttgggcgaacttgccatactgctgcaacacctcgccctgatacaggcagtgccgaatgccttggcgcacgacgaccccgattccgatattttgcaccgcctcgcccaaaccataagcggcgaacaaatccagctttactaccaaatcgccgtccacggcaaacgcgacctcagcctcgcccccgacgaatacgccggctttatgatgaccctgctgcgtatgctggcgtttgcgcccttggcggcagcatcgtgtgatgcaaatgccgtgattgaaaataccgaactaaaatccccatcggcacaaaccgccgaaaaggaaaccgccgcaaaaaagccccaaccgcgccctgaagcggaaaccgcccaaacacccgttcagacggcatccgcagcagcaatgccgtctgaaggcaaaactgccgaacccgttaccaatcaagaaaacaacgatattccgccttgggaagacgcgccggacgaaaccgcagccggcacggcgcaagcatcggcaaaaagcattcagacggcatccgaagccggaacgccgcccaaaaaccaagtttccaagaacgaagcagccgacaacgaaaccgatgcccccttgtccgaagtgccgtctgaaaaccccattcaggcaacaccgaataatgaagcccttgaaacagaagcatttgcacacgaagctcctgcaaaacctttcaacggttacagctttccgaatgatgactacctcgtagaagacggcgcagaaatcccaccgcccgattgggaacacgccgcccctgccgatgcggaagaagaaaacaacgccgacgaaagcagcaacaacgaagaccacacgccatacgccccgccgcccgaattttccaccgaaaactgggcagccatcgtccggcacttcgcccgcaaactcggcgcggcgcaaatgccggcgcaacactccgcgtggacggaataccatcccgacaccggtctgatggttttggcaatgaccgccgaagcacgcgccaccgccgacaaaaaacgcctcgacaaaatccgcgacacccttgcccaagcctacgggctgcaactcaccctgcaaacccaagactggcgtgacgaagccggccgggaaacccccgcgatgcaggacaagcgcgtccaagccgaagacaggcaaaaagcacaagcattgctcgaagccgaccccgccgcacaaaaaatcctccaagcattcggcgcgcaatggcagcccgaatcactggaattggcggcaaaccggccataaacagatataatgccgcccgaacccttcggacggcattgccgtttcccttattcaatcaaaacagacaggagtattcagtatgttcggaaaagccggattaggcggcctgatgaaacaggcgcagcaaatgcaggaaaatatgaaaaaagcgcaagccaaactcgccgaaaccgaaatcgaaggcgaagcaggcaacggcctggtcaaaatcacaatgacctgcgcgcacgaagtacgcaaaatcgacatcagccccgatttgattcaagaagccgccgacgacaaagaaatgcttgaagacctcatcctcgccgccctcaaatccgcccgaggcaaagccgaagaaaccgcaaacaaaacaatgggcgcattcacgcaaggtctaccccccggagtgggcgacttcttccgctgatccccgaccgtcattcccacgcaggcgggaatctagaacgtagaatctaagaaaccgttttactcgataaatttccgtgccgaggggtctggattcccgccttcgcgggaatgacggcatcagtttgcaggattcggcgtgaacggtaaaaacagtgagaatgataagaacgcaaaaacggcaagaatagcgggaatcggcaggctgaagcccaccctaccattatttacacatccgtaccgcttaaatgccgtctgaaacttcgtcattcccgtgaaagcgggaatccaaccccgtcggagcagaaacttacaccccgtcattcccgcgaacgcgggaatccagtaaccgaaaaaccacaggaatctatcggaaaaacagaaaccctcgaccgtcattcccgcgaacgcgggaatccagtaaccgaaaaaccacaggaatctatcggaaaaaacagaaccccccgaccgtcattcccgcgaacgcgggaatctagaacgtagaatctgagaaaccgttttactcgataaatttccgtgccgacgggtctggattcccgccttcgcgggaatgacggcatcaatttgcaggattcggcgtgaacggtaaaaacagtgagaatgataagaacgcaaaaacggcaagaatagcgggaatcggcaggctgaagcccaccctaccattatttacacatccgtaccgcttaaatgccgtctgaaatttcgtcattcccatgaaaacgggaatccagccccgtgggagcagaaacttacaccccgtcattcccgcgaacgcgggaatccagtaaccgaaaaaccacaggaatctatcggaaaaaacagaaccccccgccgccgtcattcccgcgaacgcgggaatctagtaaccgaaaaaccacgggaatctatcggaaaaaacggaaacccccgaccgtcattcccgcgaacgcgggaatctagaacgtagaatctgagaaaccgttttactcgataaatttccgtgccgacaggtctggattcccgccttcgcgggaatgacggcatcagtttgcaggattcggcggaaacggtaaaaacggcagaatcgatgggatgcggcaggctgaagcccaccaaaacacaaaaattccgatgccgtctgaaatttcgtcattcccgtgaaaacgggaatccagccccgtgggagcagaaacttacaccccgtcattcccgcaaaagcgggaatccagtaaccgaaaaaccacgggaatctatcggaaaaaacagaaccccccgccgccgtcattcccgcgaacgcgggaatctagaacgtagaatctgagaaaccgttttactcgataaatttccatgccgaggggtctggattcccgcgttcgcgggaatgacggcatattttttgcatttgatataaagggtcgtttgaattttgttcagcaagtgcaaagtgttgcacataaaagggcgcaggatagaggcaaagcgggcgtaggtcgggctgtagcaactgtatttttcaccccgtcgggcaaaaatatagtggattaacaaaaaccagtacggcgttgcctcgccttagctcaaagagaacgattctctaaggtactcaagcaccaagtgaatcggttccgtactatttgtactgtctgcggcttcgtcgccttgtcctgatttttgttaatccactataccaaaactcaaatcaagccgttcggaggcggctcaaaaaaacggtacttcgcagcagaagtaccgtttatcgggatttcaggttttattcttcggggcgttcgccgtcggtttcgtcctgcgtcccttcggtgatgtgcatttctacgccgttgagggcgcggatttttgcgtcgatttcattggcgacttcgggattttccttcagccagacgcggacgttgtctttgccctgaccgattttcgcgccgttgtagctgtaccacgcgccggatttgttgatgatgtcgtttttcacgccgatgtcgatcaattcgccttcccaactgatgccttctccgtagaggatgtcaaactctgcctgacggaacgggggggcgactttgtttttgatgactttgacgcgggtttcgttgcccaatacctcttcgccttttttgatggatccggtgcggcggatgtcgaggcggacggaagaatagaatttcagcgcgttgccgccggtggtggtttcggggctgccgaacattacgccgatcttcatccggatttggttgatgaacacaaccagcgtgttggtttttttgatgtgtccggtcagtttgcgcaaagcctggctcatcaggcgcgcctgcagtccgacatggctgtcccccatatcgccttcgatttcggctttggggacgagtgcggctacggaatcgacgactaccatatctatgccgcccgaacggacgagtgtgtcgcagatttccaaagcctgttcgccggtatcgggctgggacaggtaaagctcttcgacttttacgccgagtttgcgggcgtaaacgggatcaaaggcgtgttcggcatcgacaaaggcgcacacgccgccgtttttctggcattgggcgacggcttcgaggcagagggtggttttgccggaggattcggggccgaagatttcgacgatgcgcccgcgcggcagaccgccgactccgagggcgaggtctaatccgagcgatccggtggaaatgacttcgaggttttcttcctgctggctgccgtccattttcatgatggcgcctttgccgaaacttttttcgatttgcgccagtgcggcggcaagtgctttgcttttgtcgtctgacattggggttactccggaacaaatgcggtatgtgggatgcggcgcaacacgggctgcggcgcgggatgtgtatcgttttcccgatgtgcgggctatcggtaatgctgcttcacgaggttgccattatcgcatatttccttgcttgccgatatgcgccaggacgcggcggcttgtgccggaatggaatctggatgccgtctaaaaggcggccggctttgttataatggcggctgttttttctgtgtgtgcctgttttatgtgttcctgccttgttgtcaaaaataccgttatcggaagcggacgcaccaaaatcgccgtgccgcttgtcgcccgcgatgccgccgaactttccgccgtacttgagcaaatcaaaaatatgcccttcgatattgcggagttccgcgccgactttttggaatgcgcgggcagtatcggcgaaatattgcaccacacgcagaccgtccgcgacgcgctgcccgacaagccgctgctgtttacgttcagacggcatggcgaaggcggctcgttcccgtgttcggacgattattattttgaactgctcgacgcgctgatcgaaagccgcctgcccgacatcatcgacatcgagctgttttccggcgaaaccgccgtccggtgcgccgtggcaaatgctcaaaaaaacggcatcgccgccctgctctgcaatcatgagtttcaccgcacgccgccgcaagaagaaatcgtatgccgtctgaaacagatggaggactgcggcgcggacatctgcaaaattgcggtgatgccgcaaagcgcggaagatgtgctgactttgctttccgccacgctcaaagcgaaagagcttgccgccaaaccgattgttacgatgtcgatggggcagacgggggcggtcagccggcttgccggacaggtgttcggctcaagcatcacgttcggttcgggaacgcaaaactccgcgccggggcaaatcggcgtatccgccctccgtgcgacactcgactgcctcgaaaacggcgcagactgatttcagacagcatcaaaacatgatgaaactcaatccccaacagctcgaagccgtccgctacctcggcggcccactgctcgtccttgccggtgcaggcagcggcaaaaccggcgtgattactcaaaaaattaagcatttgattgtcaatgtcggctacctgccgcataccgttgccgcaattacctttaccaacaaagccgctgcggaaatgcaggagcgcgttgccaaaatgctgcccaaaccgcaaacgcgcgggctgacgatttgcacgttccactctttgggcatgaagattctgcgcgaagaggcgaaccatattggttacaaaaaaaacttctccattctcgattctaccgacagcgcgaaaatcatcggcgaactcttaggcggtacgggcaaagaagccgtattcaaggcgcagcaccagatttccttgtggaaaaacgatttaaaaacgcctgaagatgtcgttcagacggcatcgaacatttgggaacaacaaaccgcacgcgtgtatgcgagctatcaggaaaccttacaaagctatcaggcagtggacttcgacgacttaatccgcctgcctgccgtgctgttgcagcaaaacagcgaagtgcgcaacaaatggcagcggcggctgcgttatctgttggttgacgaatgccaagatacgaatacctgccaatttacgttgatgaagctgctgaccggcgcggaaggtatgtttaccgccgtcggcgacgacgaccagtccatctacgcatggcgcggtgcgaacatggaaaacctgcgtaaaatgcaggaaaactatccgcagatgaaggtcatcaaactggagcaaaactaccgctccaccgcgcggattctcaaaatcgccaacaaagtcatcgaaaacaaccccaagctgtttaccaaaaaactttggtcgcaattgggcgaaggcgagccggtcaaagtcgttgcctgccaaaacgagcaacacgaagccgactgggtcgtcagccaaatcgtcaaacaaaaactcatcggcggcgacaaaacccaatatgccgatttcgccgtgttataccggggaaagcatcaggcgaggattttcgaggaagcattgcgcggcgcgcgcatcccctaccagctctccggcggacaaagctttttcgacaaagccgaaatcaaagacgtgttgtcttatgtgcggctgcttgccaaccccaacgacgatcccgcctttctgcgtgccgttaccacgcccaaacgcggcatcggcgatgtcacgctgggcaagctcaacacttacgcgcacgaacacgaatgcagcctgtatgaagccgcgcaaaacgaagaagcccttgccacgctgaacaataccaaccgccaacacctgcaaacctttatggatatgttcgtcagctacctcgccaaagccgaaaccagcgaagcgggcgagttcatcaacagcctgctcgaagaaatcgactatgaaaaccatttgatgcaaaacgaagaaggcaaagccggcgaaatcaaatggcgcaacgtcggcgatttggtatcatggtttgcgcgaaaaggcggggaagacggcaaaaacatcatcgaactcgcccaaaccgtcgccttgatgacgcttttggaaggaaaagacgaagaagaaaccgatgccgtctcgctatccacgctacacgccgccaaaggtttggagtatccgtatgttttccttgtcggttgcgaagaaggcgttttgccgcacaacgacagtatcgaagagggcaacgtcgaagaagaacgccgcctgatgtacgtcggcatcacccgcgccaaacgccaactcacactgacccactgcgtcaaacgcaaaaaacaaggcacatggcagttccccgaacccagccgattcatagacgaaatgccgcaggaagatttgaaaatcctggggcgcaaaggcggcgaaccgattgtcagcaaagaagaaggcagacgcaaccttgccgatataatcggaaggctcgacaacctaaaaaaaagcggcgcggcggattaaaccggagccgcaatgccgtctgaaggcttcagacggcatattttttggacggcgcgcgtaaagcggtttacgcccacaaatcctgctgctggtttttcggcacaagatgccccacgccgataccgataaggcggaacgcgtcttccgtctgcggcgagacgcgcgccatcaacatttgcgcagcctgcagcagagtgcgcagtcgggcaatacggaggaataagtcagtgtgcgcgtgatgatgcggaaatcgtaggtcttcagcttgagcgttacgctttgggcttcgacgtttttgcgcgtgatttgccgccacaagtcttcggcaagatgggggaggtgtccggcagcctgctcgagcggcaggtcttcgggcagggtaatttctgtggagatttggaggcgttcgcgttcggctttgacggggcgttcgtccgtaccgcgcaccaaatcatagaggcggtatccgtagcgtccgaaatggtttaagagttcgccgcgctcgaaacggcgcaagtcgcccgccgtccgcatacccagcgactgcatttttttcagcgttaccttgcccacgccggggattttgcccaaaggcagggtttccaaaaatgccatgactttgtgcggcggcaacacaaactgcccgttcggcttgcgccagtccgacgcgattttcgccagaaatttgttcggcgcgatgcctgcggatgcagtcaaacctgtttccgcaaaaatggcggcacggatttctttggcaacgtcgccggcgtaagggatgtttttgaaattacgggtaacgtcaagataggcttcgtccagcgacaagggttcgattaaatcggtataacgcctgaatacggcgtgaatctgcgcggaaacctgacggtacaaatcgaaatgcggcggcacatacaccgcttgcggacacagccttttcgccgttgccaccgacatcgcggaatgcagcccgaactgccgtgcctcatacgatgcggcgcaaatcaccgaacgcgcgccctcccacgcgacgaccaccggccgccctttcaaatgcggctgttcgcgcagctctaccgatgcgtagaatgcgtccatgtcgatgtggataattttgcgtgaagacatcggctcttctgaggataaaagggatattctactgccggcatcgggcaaattccaaatatacgccccgatagacctgcctccataaaaatgccgtctgaaacataccctgtttcagacggcatccgcaaaactacggttttcaattaaaactgccaatccagtttcatgctgacagtgcgcggctctccgtagaagttgtttgcgccgcgcgtacggttgtagttgttctcaaaataagtgcgtccgtttaagttcgtaccgatgaggctcaatttggcgtgtttgcccaattcgtaacggacgaaaccgtctatcagcccgtagccgccctgcctgatgttatacagactgcttgtgccgctttgtgcggacacgccgccgccgacggtcagccccgtattcggtatatggaagctcgttccgaaacggaatatgtgcacgggtgtgaaattgctgaagttgtacgggtctgcactggaatttttggcaaggcgttcggcgttgacttcggcggcgtttttgtagcggctcttgttgtaggtgtaacccgcaaagactttccaatcttcgttcaactcacccgacaactcgaattccgcacccctgctgaccactttgcctatcggtttggcaacggtttggaacgacccctgcttgccgcctgctccgggaacatagccgaaatcgacgaccgtgcggtttttctgttcgaggtaaaacaatgcgaacgaagcattcagccgtccttgcaagaacgcgcctttccagcctacctcatagtttgtgccgaccaaaggcggtaaaacggttttggcactgacatcgacattatcctgctgtttgaagattttggtataacttccgtaaatactctgttgcggtgtcaagtcataggtaatgcctgcatagggcgtcaatttatgaccttgcatcttggccgtgtaatggtcctgatccgccctaatgctcgatgccgtctgaaaatcgcttgccggctgcccatagcggacaggcatatctttggtttgcgaagtctcatagcgcgtgtagtgcagcccgcccaaaaggtgcagtcggccggttacgttgaaacgcgtgctggcagtcagcgaatgggttttgttggtgttgaggtatttggcgtagttatacagcgcaggaacatggtcgtctgccactttgacggttttccaaaccggcaccgtaccggaaaaaccggtaaaggcaggcgtgccgtcgggattggtctcctgaatcttgttgcctttttcgtccagctcatatacatcgacatataccggtgtccggctgccgctgtattcgtcatagtaatacacctgcttgccttcggcatcgagcttgggctcggtttttattttcttggcgttcctgcattcttcggcataaacggtacggttgcctttttcatcgtacgcctgccaatcgggttctttatgccccctgaccaaaggagacgacaaatcgccgtccggctcctcctgacaacttcccgcatacacgccgtgcgttgcccccgtattcggacgtactctgtagcggcgttcgtagatttctagatattccgaacgtatcttttcatcaccgtaggcatagccgacaaagaaatcatgctcccgcccgaacagcccatatgtgccggtcaggtcaagtttaattccccattggcggtcgtctttggtatgccgcaacggcatataactgtatcgtcggttggcggtagccttccgattaaaggaagagtcatacaggctgtttggaaaacgttgtgccgcattattaaagatgccctccttcgcaagggctttatcgacaaattccgccttgtcggcatcaacgcccggatccccccaagaaccttgacagataaagtccagcgcgaaagggtcactcatacacttgtcaaaaccggctttgcgttctgcggcacggcggctgcgatactgttcgaaagcagtattatcgaaacggtttttaacaaaatcgtctttgcgctcccggtattccttggcggtttcatcacgatatgctttcagtttctccaatgccttatctttcggctcgaacgggatgacttcgtttttttcagtcaaaaagcctaccgcatcctcacccgacaaacccgccgcatattcgtttttcagaaaaaactgccccaccttcgcatcggattcattcttggtataagacacttcggcattgagctgccaaccgttgtcaaacacatgtttgaatcctgagaaaaggttgtatttgtcggcacttaaccgcgaccaatcctcccccaaataagtgttgcgcggcagttgcaaaggccggttgcaggcaggcgttgaactgaacggggcagttttctgattttcacagggcaaaataatgcccgaaaaatcaggaacctccctactcttctgatacatgccgcccaaagtaagcacactgctgtcgcccgcatcggcttcggcaatgccgtaaaccatatgtttcctgccccaaactcggtctttaaacgattttttatactcttccgcacccaccaaccttccgcgtaaggtattcgccttattcaggctgcctgaaacatccaacactgcacgccggctgccgcgatggtcggcggtcagctctccggtatgtttgaaagaagcggtaggtcacttacggatcaaattgacggttcctcccggctctgaattggattgggtcaaccccgttgcaccccgtacaacttcaatatggtcataaaccgccaaatcggtactcggagacacgtcgattttcgccgtatatcccgaacggcctgcaacattgacggtcataccgtcttcaccaatctgatcaatatagaaaccgcgtgacaaaaaccgcgtctgcaagcctgaatcgcgcacaacgttgacacccgtcgtgtttttcattgcctcttcaagcgtatgcaccgccttatcgtcaaggcggctgcgcgtgatgacgctgaccgactgcggcgtatccttgcccgcaatcctcatacctgtggcggtggacatccgatctatcgtataagaacgggtcttttcggtcttgcccaacaaagcatgagagccgcgtacattgaccgtatccagactgacggtattgccgtctgaaacaggcacaacaccgtctgcaaaagaaccaccgtaagccgataacagcataacggtcagaattttaagtgaaaaatgattttgattcatagagacctctgtaatatgcaagtgtgcaaatcgtccaaaggctctcacaactgttttgattttttatattaattgaaaaaaagtaattctcaattaaatttatagataggattgtattcccattttgacaaaaaacaaactactccttaccgtttatttcaaaaaacgataacattgtattgaaaaatatccgaatttaaatacagaccgccaatgcagaaaaaaacacccaaattggctataatcccgacaaacacactcaaggacaacaacatggcagcctcgcccgaagcaaaattcaccgaagaaaagattttgtgggtcaaacaccacacgccgaaactcatcactttcgccatcagccgtcccgaatcctaccgctttaaagccggacagttctcccgactcggtttctacgaaggggaaggtttcatttggcgtgcctattccattgtttccgcagaatatgccgacacgctcgaatattttgccgtactcatccaagacggccccatgtcggcccgtttcgccaaaatgcaacagggcaacaccatcctgctcgataaaaatgccaccggcttcctcctgcccgaacgcttccccgacggcaaggatttggtgatgctctgcaccggctcgggcatcgcccccttcctttccattctcgaacaacccgaaatccgtcaacgtttcgataccgtcaacctgatacattccgtatcttttcccgaagaattgattttcaacgaccgactcgccgcattgactgaacatcccctggtaggcgaatacggacactctttccgtttcgtccctgttaccacccgtgccgccaacccctcgggcttaagcggaaaacgcattccggaactcttaaaaaacaacagcatcgaacaggcgctgcataccaagttcaccccggaatccacacggtttatgatttgcggcaacccggaaatggtcaaagacactttccaaacgctgctcgacatgggttacgccatgcaccgcaaccgcattcccggtcaaatcatgatggaaaacggcttctaaaaaccaccctgcttgtccgatgccttcggatggacgggcaaaccgacacggcacgaaaaccgcgtcggcaaaaatgccgtctgaaaaaattcagacggcatcttcggatacattacctgcaaacggcaacacaccggcacaaaccgattaggcaatcaacacggtgacggctgtttacatacttgccggctttcaccaaccgatatcgatttaaccgatttccttaatatttttcctgtccgttttaaacttcgccttaaacgcatccggtaaatctttatcgaaataccaaagcccgtcatccatttccaatgcgccgcccattccgtgcagaacgactttttcccccgtcaaaggatcggtttcggtaatttccacctcatgcatttttccccaatccaaaacaggcaacttgtgtgcaaacgccaaaacctgttcgtcagaacggccgcacgccttatcgcatcggcctgaaacatatacgggacaaggctcatcctctgcataaccgtccggaaggataccggctgcggcaggacacaatccgtatgtttccgcccacgacgacaaagcccgtctcgctgcctttttattggcaaataatccggtaggcggattatccgtcacaccgtttttcaaagccgctgttttcgcattcaacatgccgtctgaacctttttcaaacctgacggtcgtaaatgttttaagcagatttttggcagacacataacaatccgaatgataacgcccgaccaattccgctttaatcttatatgcatgcaggctgcccaatgcgggaaaaaaacggacttcctccgtattgcaccaatcaaacggggcttttccggagtccaataaagccgaaatctcgctatatacccgttcaaacgtaccgatataatttactttccctccgccgtcgaaacaagccagcacccccataccgtcaggcaaaccgtacaactgttccctcaaccgttcgggcagcgcggcaggcagcggtttcggattcatcaaacggaaacactgcctgatccatgcctcaaccccgtgttccgacagactgtattccaaataatcacacaatgccgatacatccgccatcgcacgatgcctgtcttccacaacaatccccaacctttcgatgatactgtccaggctgtgcttgtaaaattgcggatacagacaccgggacagctgcacactgcacaaagcaggcgatgaaaatccgatacccgcacgatgaaactcatgctttaaaaacgtatagtcgaaacggctgttatgtgcaaccagcacacaacccttcaataccgaaaacaactcgccggcaatctctgcaaaaacaggcgcatcggcaaccatgccgtctgaaatccccgtcagccccgccacaaactgcggaatcggtttttgaggattaaccaaccactcatgcctcaccacccttccctgctcaaacttgaccaaagccacttcggttaccctgtcttcatacagattgccgcccgtcgattccaaatcaaccacggcaacaggcattccaaaccgtaaaaataccttttccagcaagggccagcgagaagcaacaatcattttattctctttaaattcaaacaacaaaccaatattttacacttttaaggcatttcatccaacaaaacaattgacagaatccgatgattaccctaaaattcgaatctttcttgcagcgcacccgtagctcagttggatagagtatctggctacgaaccagagggtcgggcgttcgaatcgctccgggtgcgccagtaagaaaatacaatatgcgcccatcgtctagcggttaggacatcgccctttcacggcggtaaccggggttcgattccccgtgggcgtgccaaattctaaatccccgagattatcgctcggggattttttattgtctcagcaactcgttaccatatctttacctacccccttcatcagaatctcagacgtaatcgaatcatattcaaacctttgccgtgcaaaccgatatcccataaccggatgcggtgtccgtccaacattttacccgattgaaacgcctgatatattgcaccccatcaacgtggcattacttttcttaacaatcccctttgacagcaactgactagggcttttttatgccatcatcaaatttatagtggattaactttaaaccagtacggcgttgcctcgccttgccgtactatttgtactgtctgcggcttcgtcgccttgtcctgatttttgttaattcactataatattttctctcccgattgaaacaggcgtaacagaatgcccgaagctccggctgctttcttgtttaccgccgcgatatttagagtataataccaaatttgagcaatagttctaaaacagttagaaccatttttcatgagcctgactgattcgtacactcggagaaactgatgcagaatatttttgaccctttggttattcgtggaaaatcccttacccccatcgtgcaaggcggtatgggggtcggtgtttccgcatcgggtttatccagcgcggtggcgcgtgaaaacggtatcggaacgattgccagtgtggatttgcgccaccttcacgaagacctactcgccgaatcacaaatcaatccgagtgaagagaaatatacatctttgaactgtaccgcattagacagggaaatccaaaaagccaaaagcgcttcagagggaaaaggactgattgcggtcaacgtgatgaaggcggtcaaagaccacgccgcatatgtccgccaggcttgcgaatcaggggcggatgcggttgtaatgggtgccggcctgcctttagacctgccggaaatgaccgagggctatcataaagatgtcgcgctgctgccgattctgtccgaatcgcgcggtattaatatcgtcttgaaacgttggatgaaaaaaggcatattgcccgatgcgattgtagtcgaacatcctgcccacgcggccggacatttgggtgcatcaaccgttgaaggcgtaaacgatgccaagttcgacttcaaacgcgtgattgaggaaacgtttgaagttttcaaaagtttagggctggaaagcgaaaaaatcccgcttattcttgcgggaggcatggcaaattttgaaaaagtcaaaaccgccctaaagaactggggagcatccgccgttcaaatcggtacggcttttgccgttaccgaagaaggagatgcacaccttaacttcaaaaaaacgctcgccggtgcggaaactgaaaaagtagtcgaatttatgtctgttgccggtttgccggcgcgcggtgtccgcaccaaattcctagacagctacatcaagcgtgaaagcaaacttcagacaaacgccaaagccgacccgcgccgctgtacccaaggtttaaactgcctaaccagttgcggtctgcgcgacgggctttccaaagcaggacagttctgtattgatatccagcttgccgccgcattccgtggagaagtagataaaggcctgttcttcagaggtaaagaccgctgcccttcggcaatgccatccgcaccgtccgcgagacgatacaatatctgctgacggggagcgaacctgttgcaacgctcggacgctgacatcaggtaggatttgatttgcaaacaaaatgccgtctgaagggctttcagacggcgtttttcaggctgcgttccggaatagtgttaaaaaataaacgggatgagatacatttattttcgtccgacaaatcaaaccatcgcgccgaatgatcaaataatgcctgcacggcattacatctggcaaagcaatgcaatgaaaacacggcttttttatttgctttcagtattattgaaaagcttgtccatcggggtcaaatcgaccgcattgccttggctggtaatccatttgttctcgacgcgccacacgcctgccgcgtcctccacgcgcacataccagtggttggtcggcgaaagggttttgaacaccgcctcatattccgccctgccgttctgcgcgctgccgacgggcttgagggcgacggtttgatcgtccgccttgcgggtcgggtgcatcagcagcaggttcaaaggctgtttgccgtcaaactcgccgccgacaaacacttttgccgcattcatatcgggggaaatgagaacctgcaccccgatatgccgtctgacggcttcttcatcccgatgaagctggatgtcgatatgtttgccgtctttataataatcgtccgtaaccaaatctgtcgcgtgctgctgcgcgacaaaaaacatagcgacgctggcgatgacgacaaaaatcggccccgccatcaagatccacggccagacgtgtttgtaccaaggtttgattggagtgttttgagacacggttattctccgataaaggttgcatcttcttccaagacgaccggcttgccgtcgggcgcgccgctttcgcggtattggaaggtaaattcgatagggtggctgcctttgtccgcgtattccggaatggtggacacttggacgggaagggttaccgtttcgcgcggggcaaccttgataccgccttcgggcagcccggtcagggcgatttcgtcaaagcctttgacacttgcggtaatcagctgttctttttcacttttgttgatgatacgcaggctgtatgcgttttccagccagcctttggcgttttcgcgcaccagtacgccacggtctttcaaaatatcgacctcgaccattttgcgcgtggacaaaccggccaggaaggcaatgataactaacgccaacaccgcgccgtaacctgccacgcgcggtctgagcagccgttttttaatgtctttttcagaatattcgtgttccagcgcgctttcggtcgtataacggattaatccgcgcggatagcccattttgtccataatctcatcgcacgcgtcgatacaggcggcgcagccgatacattggtattgcagaccgttgcggatgtcgatgccgacggggcagacttggacgcacatcgcacagttgatgcagtcgcccaaacccgcctcttccttattgaccgttttcttgcgcgcgccgcgcggttcgccgcgttccgcgtcataagaaacaatcagcgtgtccttgtcgaacatcgcgctttggaaacgtgcatacggacacatatgcaggcatactttttcacgcataatgtgggcgaagaagaaggtcataaagccataaaacgctgcggcaaacatcgcgccgccacctgctgctccagtgaataaatcgggaacgaactggcggatagggacaaaccagcctgcaaacgtgatgcccgtccacgcgcagacaaggaaaatcagcaggtatttggtggctttgatgcggattttagtgaaattccacggcgatttttccagtttcagccgtttgtttctatcgccttcgaccaggttgtcaatccacagcataatttcggtgtaaaccgtttgcgggcaggaatagccgcaccacagtcgccctgcaatcgtcgtccaccaaaacagcccgaaggcgcaaatcatcagcagcaaggcaaggtaaatcaaatcgcccacccccaacgacaatccgaaaatgaagaaatgccgttcggggatattgaaaacgacggcctgcctgccgctccagttgaaccacggaatgacgtaaaacacaaactgcgtcgccaatacggcggcgatacgcagtttggcgaaccgtccttccgcctttttgggatggatgcgttcgccttcgggatggatttgaatcacgctggctcgcggatcgaatgttttttttgctttcggcgcggcttttgtttgttcggacgtgccgattccggatgccggactgccggcttggttttccgtggtcattctgcattccttagatttttgattgatggtttgcccgttaccgccgccgtttgcttttcagacgtcatttttcttgttttttaaggcgttgtgtttcaagttttgagaaaatccgtttttcccaaaatatatttccgctattgtacaactttatgcgccgtccggatgtatggggcggatacatttcccatccgcatcaaaacgcctggattttaccttaccgcccgaacaaaatccgaatacggttaaaaaaaaagactaaaaaaaccgacacccccatatcggcagaaccgacggcgcaagctcataaacaaacgctatcgacaatccggcacacaatctataactttttatttcaaaaggaataatggcaggcttcgcccgcaaatcgaaaatccttccccgcctgtcccctgccgccgccttcccacgcgtccgcccttttcttgaaagcataagcgaatcgggcgataatcaacgctttccgattatccacttatctgaaacaccagcaaggaaaatacaaaatgtctcaactggcaaacgcaatccgcttcctctcggccgatgccgttcaaaaagccaattccggccaccccggcgcgcctatgggtatggcggaaatggcggaaacattgtggacgaaattcctcaatcacaaccccgccaaccccaaattctacaaccgcgaccgcttcgtcctctccaacggccacgcgtctatgctgttgtacagcctgctgcacctgaccggctacaacctaagcattgaagacttgaaaaacttccgccaactgcacagcaaaacccccggccatcccgaatacggctacaccgacggcgtggaaaccacgaccggcccgttggggcaagggattgccaacgcggtgggtatggcattggcagaaaaaatccttgccgccgaatttaataaagacggtttgaacatcgtcgatcattacacctacgtctttatgggcgacggctgtctgatggaaggcgtatcgcacgaagcctgttcgctcgccggcaccttgggcttgggcaaactgattgttttatatgatgacaacaatatttccattgatggtaaagtggacggctggtttaccgaaaacatcccgcaacgctttgaaagctacggctggcacgtcgttcccaatgtaaacggtcatgacaccgccgccattcaagccgccatcgaagccgcacgtgccgaaaccggcaaaccgtccatcatctgctgcaaaaccttaatcggcaaaggcagtgccaacaaagaaggcagccacaaaacccacggcgcacctttgggcgcggacgaaatcgaagccacgcgcaaacatttgggctggacttaccccgcctttgaaatcccgcaagaaatttacgatgcgtggaatgccaaagaacaaggcgcgaaactggaagccgactggaacgaactgttcgcgcaatatcaagccaaatatcctgccgaagccgcagaatttgtgcgccgtatggataaaaagctgccggacaatttcgatgaatacgttcaagccgcattgaaagaagtgtgcgccaaagccgaaaccatcgccacccgcaaagccagccaaaacagcatcgaaatcttggcaaaagagttgcctgaattggtaggcggttctgccgacctgaccccgtccaatctgaccgactggtcaaacagcgtctccgttacccgcgacaaaggcggcaactacatccactacggcgtgcgcgagttcggcatgggtgcgattatgaacggtttggtattgcacggcggcgtaaaacccttcggcgcgactttcctgatgttcagcgaatacgagcgcaatgccctgcgtatggctgcgttgatgaaaatcaaccctgtatttgtgtttacccacgattccatcggtttgggcgaagacggcccgacccatcaaccgattgagcaaaccgccaccctgcgcctgattccgaatatggacgtatggcggccgtgcgacaccgccgaatccttggtggcttgggcagaagccgtcaaagccgccgatcacccgtcctgcctgattttcagccgtcaaaacctgaaattccaagcgcgcagcgagcaacaactgaacgacatcaaacgcggcggctacgtcatcagcgaagcccaaggcaacgcccaagccgtcatcattgccaccggctcagaagtcgagctggctttggaagcgcaaaaagccctcgccgcgcaaaacatcgccgtgcgcgtcgtttccatgccgtccaccaacgtattcgaccgccaagacgccgcctatcaagccgccgtcctgcccgaaggcctgccgcgcatcgccgtagaagccggacacgccgacggctggtacaaatatgtcggactgaacggcgcagtcgtcggcatcaaccgcttcggcgaatccgcccctgccgatttactcttcaaagcattcggctttaccgtggacaatgtggttgatacggtgaaatccgtgctgtaaccccacacctaaacaaatgccgtctgaaaccaattagggcttcagacggcatttttatattctcgcggccatgatgctttctcatcccaccaatctccattataatatttgcgaatcactcttattcacatttcaaaaggagaaacgcatgagcacccgtaccgaacacgacacgatgggcaatgtcgaagtcccatccgaagcctattggggcgcgcagacccagcgcagccgcaacaatttcaaaatcggtggcgaaaccctgccgcagccgttgatttatgctttggcattggtgaaaaaagccgccgctgccaccaatgtttccctcggtaggattaagcctgaacaggcggatttgattacgcaggcggcggatgatgtgttgagcggcaagctcgacgggcagttcccattggtagtgtggcagaccggttccggcacgcagtccaatatgaacatgaacgaagtgctggcaaaccgcgccaacgaaatcgccggtacgggtttggcggcttatcagcccgtccatcccaacgaccatgtgaaccacgcgcaatcgaccaacgacgcattcccgaccgctatccacgttgccgccgcgattgaaatcaaccgccacctcatccccgccgtaaaagccctgcgcgacacgttggacaaaaaagcccaagctttcgcccctatcgtcaaaatcggccgcacccacttgcaagacgcgacgccgctgactttgggacaggaattttccggctacgtttcccagcttgatcacggtttaggccgtctgaacgatgcgcttaaagacttgtatgaacttgctttgggcggtacggcggtcggcacgggtttgaacagccatcccgaatacgccgaaaaagccgccgccaaactcgccgaattgtccggcttgccgtttgtcagcgcgccgaacaaatttgaagccctgggcggacgcgatgccgccgttgccgcttcgggcgcattgaaaacgctggcggcaagcctgaacaaaattgccaacgacatccgttggctggcaagcggcccgcgttgcggtttgggcgaaatcaaaatccccgaaaacgagccgggttcgtccattatgccgggcaaagtcaacccgacccaatgcgaagcaatgacgatggtgtgctgccaagtgttcggcaacgacgttaccatcggtatggcgggcgcgtcgggcaatttcgagctgaacgtctatatgcccgttatcgcctacaacctcttgcaatccatccacctgttgggcgacgcgtgcaacagcttcaacgaacactgcgccatcggcatcgaacccgtgccggaaaaaatcgactatttcctgcaccattccctgatgctggttaccgcattaaaccgtaaaatcggttacgaaaacgccgccaaagtcgccaaaaccgcctacaaaaacaacaaatcgttgcgcgaaaccgccgttgagttgggcttgctgacgggcgaagaatttgacgaactggtcgttcctgccgatatggttcatccgcgctaatccttccctcaaataaaatgccgtctgaaacctcgttcggacggcattttccgttgcctgcaaactagcggcgtttgaacagcctgtcccccaccgccgccgtaaccgcacccccgaccacgatcagtgcgcctgcataacccaaaccgttcatatccggcgcggcaaaagtatcaggcatcacataatgcccgagcaaagaaaatattacggtaaacacggggagcaaggttgttaccgcgctgactttggaagcctcccaatgtttcaacgcctcgccgaacgagccgtaaccgattaacgtattcaagcagcaatacgcaaaacaaacccacgccaacgtaccgtccaaacttccgatgtgtgccggttcggcaaacggcaggaacacggcggcacttgccgcataaatcaacagcagaatctgttgcggcccgaattgcgccgacagcagcttttgcgccacggcataacacacccatgccatactgcctgccgcacacagcaacacgcccttcgcatacgcgcccaaacccgacaactcgccgaatttatcgttaaaaaacataagcaaaccggcaagcagcaaaaccaagccgattttctgagcggcagtcatccggtctttaaacaccaacacaccgacaacaatcatcgtaaacggcgaaatctgccacaaaacctgcgtcgtggtcggcgaaatataatgcagcccttgggcaatcagcacaaagtttgccgaaatgcccgccacgccgagcagcagcagcctgaatgagcaccaagaaaaatcccgccgcttcggcagccgcccgcccagtgccagcaaaacaaacaataccgccgccgccacggtaaaacgcacccacaccagcgtcggcgcatcgacaaacttcaatacctgccgcacggcaatcggcagcgttccccacgtcatcgccgccaaaagtgccaacgcgaagcctaggagcggcctttggttttccatcctgattttcctatttttaaacaaccgtattgccggacgatgccggtttgccgcatcgggcaatgatggttcaagcgtttggcgtttgattccaaccctttgatttcaaacaaaccggctgaagctcggctattgcttcgcgctatttgaaaacaccgcctgaattttaaaatatagtggattaacaaaaaccagtacagcgttgcctcgccttagctcaaagagaacgattctctaaggtgctcaagcaccaagtgaatcggttccgtactatttgtactgtctgcggcttcgtcgccttgtcctgatttttgttaatccactataccgtctgaaaacagcggggacgtgcggcaggcatcactgcctcaaaacgcccgaacggcgcaatcgcaacgttccgcccaacgcaaagggcggcaacaagccggcccaaatgcaaaaaagagaaaccctgccccgtaaggtttaaggtttctccgtcctttatgatttccctccgcgaggatgtccggccgtaaaattcagaacgggatatcgtcgtcaatgtcctcgaccggggcggcggcaggcacgggttggcggcgcggcgcggctggtgcttcttggggatgggacggcgcgtcggaggcgggctgccggctttgctgcgcggggcgttggtaagcctcctgactctgaccgtaaccttcctcgtaaggcgcaccgccgctgttttcattgcgcccgcccaacattttcatttcgttggcgacaatatcgtaagcggtgcgttcgatgccgtctttgccttggtatttgcggctttggattctgccttccaaataaaccagcccgccttttttgaggtattgcccggcaatttccgccagtttgcggtacatggtgatgttgtgccactcagtacgctctacacgttggccgttgcggtcgttccaagtttcgctggtggcgacgctgaaattacaaaccgcctcgccgttgggcatatagcgcacttcgggatcgcgtccgaggcggccgatgaggatgactttgttcaatgacattttttaaactcctgtgatgattttttcagcggcagcctgatcgaaacccttctgcaacactttgagatagacggtctgcccgtcgaaactgaaaccgatgtcttccacaccctcaagctccgacaaggcgcggtataacccttcctgattgccctgccacacgccgccgacagggtaactgaggtttttgacgggcttgggcgcaggcgataaaacggcaattaccagccacagcagcatcaatatactgcaaaaggcaaacacgccggaaaagccgtatttttgaaacagcaaaccgcctgccgcgccgccggcaaacagtccgagcgactgcatcgtgttgtacacgcccatcgccgtacccttcaggtcggacggcgcgattttggaaaccatagacggcaggctcgcttccaacacattaaaaccgataaagtaaacaaccaaataagcggtaatcaagcctaccgagcgcataccggacagcaaaccgagctgcgccgccgcaatacagacgatacccaaaacaaaaacctgcttaagcttgttgcgcgtctcgccgacgataatcagcggaaccatcaccaccaagcccgtaatggtcgaaggcagatagactttccaatgctgtattttttccaaaccgagctgggtcatcgcgaaaggcagcgcggtaaacaatgccatttgtgcggcgtgcagggcgaaaatgccgaaatcaagcgtcagcagcctacggtttttcaaaacttcgcctatgcgcgaaggctgcgcctgcgtatcttcgtgcagcttggaaacttcgggatcgggagtcatccacgccaccacgccgatgctgatgacggtcagaatgccggtcagcataaacagtccgcgaacgccgaccgcgtcggcaatcacgggggcaacgacgaggctgaccgaaaacgtcaaaccgatactcaaaccgatcatcgccattgcgcgggtacgtacgccgtcgcgcgtcaaatccgccagcagcgcggtaaccgccgcactgaccgcccctgcaccctgtatggcgcgtgcggcgaccagcatgggcagcgtatcggcggcggcggcaagaaagctgcccgccgcaaacacgaccagtcccgcataaatggttttcttgcgcccgaacttgtcggaagcgatgcccaaaggcagttgcagcagagcctgtgtcagcccgtaaatgcccattgccagcccgaccagcgttttgttgccttccgcgccgggcagcgaggcggcatacaccgccaatacgggcagcacgaggaacatacccagcatacgcagcgcgtacacgccggaaagcgtcgtactggcgcgccattcgtgcggaaacatttggatgcggttgtctcttgccatcatattttttcagacggcatcaacagttgcaatgccgtctgaacttccagtgaacagattttcggattatacaggattcgccgtatttcggttgcggcgcgggttcaaaatcaacgccactgccagcggttgcgccacgcgcccaaaacggcgttcggatatttattgctgcccaagctgccgttaaagcgggcaagcgcgcggacgatgttgcctttttcaagattccggtaatggcgcaggatggtacagccgtaacgcaggttggtgcggatgtcgaacaggttgtgcgccggtttgccgatgtagtttttccaaaacggcataacctgcatcaggccgcgcgcgccgacaccgctgattgcatactggcggaacgcgctttccacctcaatcagccccaacacaatctgcgtatccaaaccggcccggctgctttcgtactggatattgaccagcagcctgcgccgctcctcctcctcggggacgaaccttgccaaacgtgccgacatggcagacaaccaacgctcgccctctttcggattgtcaaacaccagcctcggcggattgacgctgccgacagaactcctcatcacggaagccacatcgtcggcaagcgtttcctcacgttgcgcgccggcgtgcgccagaggactgagcaacaacgcaccggcggcacacaacaggcggcggcgttgcagattaacgggtagggtatcggtcggttttctcatagggaacgggggcgcgtccggacgtttcagacggcattaaatattcaaacagacataattgctttcaacgcgaaaaaccgcgcgcaaaatccaagcgcggcatatcgccctgcccttttcgggcaaacctcaattctaccgccctcaagaacgcttgtccaaacaggcacaggcaacaccgcccgggcatttccgttttcaccggttatccgtcgtccggattatgcagcagcaccatcagcgcatcacgcttttcgggcggcagcaggcggaaatatagtagattaaatttaaaccagtacagcgttgcctcgccttgccgtactgatttaaatttaatccactatatcttgaggcctttgcaaaattcctttccctcccgacagccgaaacccaaacacaggttttcggctgttttcgccccagatacctcctaattttacccaaatacccctttaatcctgcccggacacctgataatcaggcatccggggcaccttttaggcggcagcgggcgcacttagcctgttggcggctttcaaaaggttcaaacacatcgccttcagatggctttgcgcactcactttaatcagtccgaaataggctgcccgggcgtagcggaatttacggtgcagcgtaccgaagctctgttcgaccacatatagtggattaacaaaaaccagtacggcgttgcctcgccttagctcaaagagaacgattctctaaggtgctgaagcaccaagtgaatcggttccgtactatttgtactgtctgcggcttcgtcgccttgtcctgatttaaatttaatccactataacgggttttcgacaaatatcggttgcgtttggtttgcgcctccgtcagcggacggttgcggcaggctttgcgcataatgccgttctgcaaccgatgctctttcagttttccgtaggtcggattctcgaatccgacattacttcaatcgtatccaatagaaaagtccgcattgccgccaccccaattatgcggataaataccctgtttgacataacggtgaaacgtagaaaacccccaatcggaaatttgtcctacatagccatgtttgaccggattgaaatgcagataatcaaaatgccaggcaaaatcggcctcatcgcggatagtatattcccaaaagcgtttttgccaaagcctgagattgccgccgattaaatattggctgtgccgcttgatttgccgccagcgttccgaataagcagaatcattgtccggcagccgccatatggtatgcagatggtcgggcatcaacacccatgccaaaatttcaaacggataccgttcgcgcaccgccattaccgcctgccgtaaagccaaacgcaccgcatcatcggtcaaaatcttctgccgtttattggttacaaccgtaaaaaagtaagtgccgccattgcggtaaaaacgacggtatttcatagtattatgctcggaatgattttgtaggtcggattcttgaattcgacattttgggcattgctgcaatggattgcaatgatgggaatgttaaaggttttgtcggatacaagtatccgacctacgcttgctgaaccgtcattcccacgaaagtgggaatctagaatctcggggtttcagtcatttccgatagattcccgccgcgtcagggggtctggattcccgcctgcgcgggaatgacgggtttcaagattgcagtgttgtcgggaatgacgggtttcaagattgcggtgttgtcgggaatgacgaatccatccatacggaaacctgcaccacgtcattcccacggaagtgggaatctagaatcccggggtttcagtcatttccgatagattcccgccgcgtcgggggtctagattcccgcctgcgcgggaatgacgggtttcgagattgcggtgttgtcggaacgcaactgaaccgtcattcccacgacagtgggaatctagaatctcgggggttcagtcatttccgatagattcccgccgcgtcagggggtctagattcccgcctgcgcgggaatgatgggtttcaagattgcggtattgtcgggaatgacgaatccatccatacggaaacctgcaccacgtcattcccacgaaagtgggaatctagaatcccggggtttcagtcatttccgatagattcccgccgcgtcagggagtctggattcccgcctgcgcgggaatgacgaatttcgagattgcggtattatcgggaatgacgaatttcgagattgcggtattgtcgggaatggcgggtttcaagattacggtgttgtcgggaatgacggttcgggtatttccacgcccgccccgcgcctgtaaacggcaggtgaatcaaaaatgccgtctgaaggttcagacggcatcggtgtcggggaatcagaagtggtagcgcatgcccaatgagacttcgtgggttttgaagcgggtgttttccaagcgtccccagttgtggtaacggtatccggtgtctaaagtcagcttgggtgtgatgtcgaaaccgacaccggcgatgacaccaagacctaagctgctgatactgttgctttcgtgataggcaggtttgttggtcggaccttgtacgattttgcctggcactgtagcgccttgcgctggtggactgaaagtagtcgtggtttcttttctcaccgaatgaacctgatgtttaacgtgtccgtaggcgacgcgcgcaccgatatagggtttgaatttatcgaatttatcgttgagtttgaaatcgtaaatggcggataagccgagagaagaagcggcgtggaatgtaccgttttcctgattttccgtcttcagttcttgccagatgccactgctattgtttttttgcaactcttttgtgtttacggaatatttattgttgttccattttctgtaactggcataatctgccgctatcctccagccgccgaaatcgtagccgaccgacacccgggggtggatggaatgcgcacggatgtttctgaaataatcgcttactgtgcttgtgttgtttgcaccggttgctttcggataatcgtgggtaatgcgttcggcggcataagctaaatccgcctgcacataatacgggctgcggctgccgtcttcacttgccgcctgcgctgcggaagagaagagaagagaagagaagagaagagaagagaagagaagagaagagaagagaagagaagagaaggttttttgggggctggattcattttcggctccgtattcggttttaactgattaaaaagaaagattttcaatgatgttgcaggagcggactatatcaggtttgtggcgatgtttcaacacaatatagcggatgaacaaaaaagagaacgattctctaaggtgctgaagcaccaagtgaatcggttccgtactatttgtactgtctgcggcttcgttgccttgtcctgatttttgttaatccgctataaacaacgcttcgtccgaaaaaacgattgaatttgcgggcagaagctggacgaaaaccgccgacagcctgccgcaaaaggcacacggtttgcgctagggcttaggcgtgtcgcgcgaaatcaatgcgggcaggcatcatttcctctacggcggcatcagcggcggcggcgtgcattattgggataacaaagatttcagcgaacagagcctgcgcctgtcgttcggctataaaaaccgttcggtaacgcgctcgttcggcatcgtgccgtttgtcgagcaaaacctcttaggcggcagccgatacaatttcgtcggcggcttcaatgccgatttctcccaacgcttgagcgaacgctggcggttgacactaaacgcgggcaatatgtggaagcattatcaggaagaccgcaccgccgcccgatacgacagccatatgccgctggcgggcgcgacgctgatgtattccgcgccgaaagactggctgctttacggcggtgcggactggtcgcacaacataacgaaagaggcggaacaggcttccatccgcaagggtttgcgtgtcggcgcggtcaaaacgttcgacggcggcttgggtctgcgggcaaacctgcgctatacccgcaggatgtttgacgcacccgggaccattgtgtaccgcttcccgcgcaaagaccacgaatatcaggcaaacctgtcgttgtggcatgacaaaatctcttggaagggctttacgccgcaactcaatttccgctatctgaaaatcgacagcaatatgaaaagtttttacacacgcaaaaacatgcagattttcatgagcgtggaaaaggatttcaaataagcgcaaaaaatgccgtcggcaacatccgtgggcagaatcaaaaaccgccgcatcatttattgtcaacgcctgcgccgtcagagtaacattgcgtttttcccccaccggtatccgccatgaccaccacccccgcaaacgtcctcgcctccgtcgatttgggttccaacagtttccgcctccagatttgcgaaaacaacaacggacaattaaaagtcatcgattcgttcaaacagatggtgcgcttcgccgccggactggacgaacagaaaaatctgagtgccgcttcccaagaacaggctttggactgtctggcaaaattcggcgaacgcctgcgcggcttccgccctgaacaggtacgcgccgtggcaaccaacacattccgcgttgccaaaaacatcgcagatttccttcccaaagccgaagcggcattgggtttccccatcgaaatcatcgccgggcgcgaagaggcgcggctgatttataccggcgtgatccacaccctccccccgggcggcggcaaaatgctggttatcgacatcggcggcggttcgacagaatttgtcatcggctcgacgctgaatcccgacattaccgaaagcctgcccttgggctgcgtaacctacagcctgcgcttcttccaaaacaaaatcaccgccaaagacttccaatctgccatttccgccgcccgcaacgaaatccagcgtatcagcaaaaatatgaggcgcgaaggttgggatttcgccgtcggcacatcgggttcggcaaaatccatccgcgacgtgcttgccgccgaaatgccccaagaggcggacattacctacaaaggcatgcgcgccctcgccgaacgcatcatcgaagccggttcggtcaaaaaagccaaatttgaaaacctgaaaccggaacgcatcgaagtttttgccggcggacttgccgtgatgatggcggcgtttgaggaaatgaaactcgacaggatgaccgtaaccgaagccgccctgcgcgacggcgtgttttacgatttgatcgggcgcggtttaaacgaagatatgcgcggacaaacggttgccgagttccaacaccgctaccacgtcagcctcaatcaggcgaaacgcaccgccgagaccgcgcaaacctttatggacagcctctgccacgctaaaaacgttacagttcaagagcttgccttgtggcaacagtatctcggacgcgccgccgcgctgcacgaaatcggtttggacatcgcccacaccggctatcacaagcattccgcctacatcctcgaaaacgccgatatgccgggtttctcacgcaaagaacagaccatacttgcccaactggtcatcggtcatcgcggcgatatgaaaaaaatgagcggcatcatcggcaccaacgaaatgttgtggtatgccgttttgtccctgcgccttgccgcactgttctgccgttcgcgccaagacctgtctttcccgaaaaatatgcagttgcgcacggatacggaaagctgcggcttcatcctgcgtattgacagggaatggctggaacgccatcccctgattgccgacgcattggaatatgaaagcgtccaatggcaaaaaatcaatatgccgttcaaagtcgaggccgtctgaaccttgcggaacaaatgccgtccaaaccctgtccagacggcatttgcctgtccgcaacatcccgatatgcgcggcacatctgctcggaacggtcatgcaggcgtaaaaaacaaggggcacataacccaaaaaccgcctgaaaatcttcaggcggtttcgtttgggttgccggcaggcggcatcccatcatttttgccaaggcaacaaattatttggcggcatctttcattttgtctgccgcttcctgagtcgcgtcggcagctttgttcaaagtatctttagctgcttcagttacagcttctttggcttcagttacagcttcctcggcacttgcctttgcatcagccgcagcatctttgacttggtctttcgcttcttcgacggcagaagcggcagactcggcggcagaagccgcagtgtctttaacatcggactcaacggcttgaaccgcttccttaacctcctgtttggcttcttgcgaacaagctgccaaggcagccgccatcattgcggcaatcaataattttttcatgtcttatccttcttgagttgttgattaaggttttgcttaaaaatcggaccgtgttccatcaatcggctgattttgcccatcgaccggagagaaaacggtttcccgtttagttaaaacccattatatttaaatataaaggtttttttctcgaacaataaggcggcatcaatgccatattgaaacacgtccgaaaactattttatgaaaacagttcggaaaattgtaacacatatccccctccttttgagtttcccgacggtgcggactttttcctgcagggtttgaaaaacccaaatatattccgggatgtccgaatacctcaataatggcggcggcggaaataaaacgccccttcgctgtcgatttccagcacatagcgtccgttctgcacggcggcatagccgcttttgcctgcctgatagggttgcagggcggcatgcgaaactaggtaatccgtcagtttgccgccgtcttcggcgatattgcccaccagtttggcaaacaaggtatggcacacgccgttttctgcccaacctgccggactgtccttatcatcggtttccatacatttgccgctgacggcttccaagtcgccgggatgcttgccgatcagtcggataacattttgttccggcaagcctttaatcggataactgatttgttttttgccgtcgttggttttgccttcgctgctttgtcccaaatccaaaccggcaatcgccgtattgtcgatatatttgactttgaaaaccggtttcggcgcgctttgtaccgcgttttgcggctgttccgccgtattttcggatttgccgcaggcggcaagcagcaggcagccgcccaatacggcaaaagatgttttcagcattccacactcctgatggtttcaaaatgccgtctgaaacgcggcaggcggaggttcggacggcatcgggttcatttcaacgggcggatgccgaccgcatcgcgtactttgtccaataattcgcgtgcttctttacgcgctttcgccgcgcctgcctgcaaaatctcttcgatttgcgaagggtcggcggtcagctcgttgtagcgttcgcgcggttcggcgagttcggcgttgattttcgccgccaaaagttttttggcttcaccccacgccaagccgtcggcaagcattttcgtaaattccaccgtttcagacggcgtggagaaggctttgtagatttcaaacaatgggctttcgtcgggctgtttcggctcgcccggctctttcatattggtgatgattttgttgaccgatttttgggtttttttgtcgttttcccaaagcggaatggtgttgccgtaggatttggacattttgcgtccgtccaaaccgaccaagagttcgacgttttcatcgattttcacttcgggcagggtgaagagttcccggaagcggtggttgaagcggccggcgatgtcgcgcgccatttcgacgtgttggatttggtcgcgcccgacgggcacttcgttggcgttgaacatcagaatatcggcagtcatcagaatcggataactgaacaaacccatttccacaccgaaatcagggtcttcctgcccgttttctgcatttgcctgcacggcggctttgtaggcatgggcgcggttcatcaaacccttggcagtgatgcaggtcagaatccagttcaattccatcacttcgggagtgtcgctttggcggtagaaggtggtgcgctcggggtcgagtccgcaggcaagccaagtggcggcaacggcttgggtggattggtgaatcatctccggctcgtggcatttgatgataccgtggtaatcggcgaggaagaggaaggattcggtatcgaggttttgcgccgcgcggacggcggggcggatggcgccgacgtagttgcccagatgcgggatgccggtggtggttacgccggtcagaactcgttttttgctcataaaaatgtccttgcggcatcaatgccgtctgaaagggaaaaagatgtgccgattatacccgatttgccacctacatccagccgacaacagacttttccatattaagaagatatagttatacacattattatacatttttatatactttaaattcaatgatatatcgaattaaatatagaaaaacagaaaacagaacttgagttatccacaattatgcacatataggcttcgacagcggacattttgaaaaggaaacaaaaatgcgatacgacaaattaaccgccaaattccaacaagcccttgcagaagctcagagtttggcgttggctgcggacggcagctatctggaagcgggctttgtgttaaaagccctgcttgacgaccaaaacagcggagccgccgcgctcttggctcatgcgggcgtgaacgtgccgcaggtgaaacagcgtttgcagcagcatttaaacagcctgccgaaagtgtccggtcagggcggcgatattctgcccagccgagaattgcaggcggtgttgaacctgatggacaaagctgccaccaaacgcagcgatgcctatattgccagcgaacttttcctgcttgccttggtacagcagaacgatgcgaccggcaaaattttgaaagaagccggcgcgaccgaacaaaacatcaatgccgcgattgacgcagtacgaggaggacaaaacgtgaacgatgccaatgccgaagaccaacgcgatgctttgaaaaaatatacgcttgacctgacccagcgcgcccgcgacggcaaacttgaccccgttatcggtcgtgacgacgaaatccgccgcgcgattcaggtattgcaacgccgtaccaaaaacaaccctgtgctgattggtgagccgggtgtgggtaaaaccgccattgttgaaggcttggcgcaacgtatcgtcaacggcgaagtacctgaatccctgcgtaacaaacgcttgctggttttggatttggcggctttgattgccggcgcgaaataccgcggcgaatttgaagaacgcttgaaaggcgtgttgaacgatttggcgaaagacgacggcaacactctgattttcattgatgaaatccatactttggtcggcgcgggcaaaaccgacggcgcgatggacgcgggcaatatgctgaaaccggctttggcacgtggcgaattgcactgtatcggcgcgaccactttggacgaataccgccaatacatcgaaaaagatgcggcactcgaacgccgcttccaaaaagtattggttggcgagccaagcgtggaagacaccatcgctattttgcgcggtttacaggagcgttatgaaatccaccatggtatcgatattaccgaccctgctatcgttgccgcagcggagttgagcgaccgctacattaccgaccgcttcctgcccgataaagcgattgatttgattgacgaagccgccagccgtgtcaagatggaaaaagaaaccaagccggaagcaatggacaaaatcgaccgccgtctaattcagcttcggatggaaaaggcgcacgttgaaaaagaaaaagacgatgccagcaaaaaacgtttggaactgatagacgaggaaatcaacggtctgcaaaaagaatacgccgatttagacgaaatctggaaagccgaaaaagcaatttcagacggtgctgctaatattaagaaacaaattgacgaagtcaaaattaaaatcgaacaggcaaaacggcaaggcgatttggcactggcttcaaaattgatgtatgaagatttggagcatttggaaaaacagcgtgcagccgccgaacgggcagatacggacagcacaaaaccggcaaacaaactcttgcgtaataatgtcggcgcagaggaaatcgcagaggtggtttcccgtatgaccggcattcccgtatccaaaatgatggaaggcgaacgcgacaaactgctgaaaatggaagaagtattgcaccgccgcgtggtcggacaggacgaagccgtgcgtgccgtgtccgacgctatccgccgcagccgctccggtcttgccgatccgaacaagccttacggcagcttcctgttcttgggcccgaccggcgtgggtaaaaccgagttgtgtaaagccctggcaggctttctgttcgacagcgaagatcatctgattcgcatcgatatgtccgaatatatggaaaaacacgccgttgcccgcttaatcggcgcgcctccgggctatgtcggctacgaagaaggcggctacctgaccgaacaagtgcgccgcaaaccgtacagcgtgattctgctggacgaagtggaaaaagcccatcccgatgtgttcaacatcctgctgcaagtattggatgacggccgcttgaccgacggacaaggtcgcaccgtggacttcaaaaataccgttatcgtgatgacttccaatattggtagccaacatatccaacaaatgggcattcaggattacgaagcggtgaaagaagttgtgatggaggatgtgaaagaacatttccgccccgaaatgatcaaccgcatcgacgaagtggtcgtgttccacggactggatcaggataatatccgcaacattgcgaaaatccagctcaaaggcttggaaaaacgtttggaaaaacaaaacctgcgcctggctgtttccgatgccgcactggacatcatcgccaaagccggtttcgacccgatttacggcgcacgtccgctcaaacgcgccatccagtcggaaatcgaaaacccgctggcaaaagccctgcttgccggaaactatgcgcccgaaagcgaaatcagggtggaagccgacggcgacagactgaaatttgcctgattcgttcctgctgttgaaaatgccgtctgaaacgggaatctccgtttcagacggcattttttatcctcggcagacaaaccgtccccttattggcggtaggtttgcaggaatcttgccagcctgcccatcgcctcttcaatctgatggacgtaaggcagcgtaacaatgcggaaatggtcgggcttgatccaattaaaccccgttccctgcaccagcaagactttttcgcgcaccagcaaatcgtaaacgaatttcatgtcatcgcggatacggtacatttcggtatcgatttttgggaacatatacatcgcgcccatcggtttgacgcaggatacgccgggaatctggttgaccagttcccacgccctgttgcgctgttccaaaagccgtccgccgggcaaaatgaattcgttgatgctctgatagccgcccaatgccgtctgaatcgcgtgctgcatcggcgtattggcacacaggcgcatagacgagagcatatccaaaccctcgatgtaaccttttgcatgatgtttcggcccgttgagcaccatccagccttggcggaatccggctacacggtaggctttggacaaaccgttgaacgttaccgtcaaaaggtcgggggcaagcgcggcgatgtggtggtgaaccgcgccgtcataaaggattttgtcgtaaatctcgtcggcgaaaataatcaaaccgtgcttgcgcgccagttcggcgatttccaacaggatttccctgctgtacaccgcgcctgtcggattattgggattgatgacgacgatggctttggttttgggcgtgattttggcttccatatcggcaaggttggggaaccagccgttttcttcgtcgcacagataatggcgtaccgtaccgcccgcaagcgttgccgccgccgtccacaagggatagtcgggcgcgggaatcaggatttcgtcgccgtcgttgagcaatgcctgcatagacatcgtaatcagctcggacacgccgttgccgatatagacatcatcaaccgtaatatcgcgcaaacctttggtctgatagtagtgaacaatggctttgcgggcggaatacagccctttagaatcgcaatagccttgcgaagtcggcaggttgcggatgacatcgaccaagatttcatcaggggcttcaaagccgaacggcgcagggttgccgatattgagtttaaggattttattgccctcctcttccaactgaagggcttttttgtgaaccggcccgcgtatgtcgtaacagacgtgatcgagctttgcagacttgggaaatttatccatgatgtgttccgtaaattttgggcaatgggtgggaatgtactctttttcacgcggaatttaaagcatcaaaccgagattttcaggctttttacctgccctctttgcgccgttcgctgacgcttttgccgcctattccccagttatcggtatccacttcgtcaatcacgacaaccgttgtttcgggatttttgcccagcacgcgtgccagcaattcggttacgccgccgatcagttccgctttttgcgcggcagtcggtgcttccttgccgccggttactttaatattgacataaggcatgatctttctccgttttaaaatattgctatcttatcaaacaagttgcctccgcccaaacgtccgcttcattttctgaaaaattcaaatcgatatagtggattaacaaaaatcaggacaaggcgacgaagccgcagacagtacagatagtacggaaccgattcacttggtgcttcagcaccttagagagtcgttctctttgagctaaggcgaggcaacgccgtactggtttttgttaatccactatacaaaaagacagttttcagacagcaaatccgtcttcacacgatacctattttgttataacataacaaaatctttaacccacacgagacaaaggctgcaccatgaagaaaacattgacactgctcgccgtttccgccctatttgccacatccgcccacgcccaccgcgtctgggtcgaaaccgcccacacgcacggcggcgaataccttaaagccgacttgggctacggcgaatttcccgaactcgaacccatcgccaaagaccgcctgcacatcttcagcaaaccgatgcagctggttaccgaaaaaggcaaggaaaacatgattcaacgcggcacatacaactaccagtaccgaagcaaccgtcccgttaaggacggcagttacctcgtcatcgccgaatatcagcctactttctggtcaaaaaacaaagcaggctggaaacaggcgggcatcaaagaaatgcctgacgcaagctattgcgaacaaacccgaatgttcggcaaaaacatcgtcaacgtcggacacgaaagcgcggacaccgccatcatcaccaaaccggtcggacaaaacttggaaatcgtcccgctggacaatcccgccaacattcacgtaggcgaacgcttcaaagtccgcgttctgttccgtggcgaaccgctgcccaatgccaccgttaccgccacctttgacggcttcgacaccagcgaccgcagcaaaacgcacaaaaccgaagcacaggctttctccgacagcacagacgacaaaggcgaagtggacatcatccccttgcgccaaggcttctggaaagccaatgtcgaacacaaaaccgacttccccgatcaaagcgtgtgccaaaaacaggcgaactactcgactttaaccttccaaatcggtcattcgcaccattaatcccgcccgcacaaaaatgccgtctgaaggcttcagacggcattttttgttcaaacatcaataccaaccgcgcagtttcatcgctttttcaacacggcggatactcatcatgtaagacgcggttcgcaaatcgacatcatactcttgcgccaagttccatatatcgcggaacgcgcgtcgcaggacgacggtttctttctcttgaacttcgtcaaactcccaataatagccttgcaggttttgcacccactcgaaataggaaacgaccacgccgccgcagttcgccagaatatcaggcacgaccaatacgccgttttgacgcaggatcacgtcggcttcgggcgtagtcgggccgttcgcgccttcgactacgattttcgcgcggactttaccggcgttttcggaagtcagttggttttccagcgcgcaaggggcgagtacgtccacatccaaagccaaaagttcggcgttggtaatttctttgccgtaaccggcttcgttggtgatgaagcctttttcttggaactctttaaacaaagcttccatatccaaaccgttttcgttgtaaatggcaacgtcaacagtagaaaccgcaacaactttcgcgccggattgatgcgcgtaataacctgtgtggtaacccacattaccgaaaccttgaatggcgtaagtggcacccttcacgtccttgcccagtttttccaaagcttggacggcggcgaggttcacgccgtaaccggtagcctcggtacgcgccaaagagccgccgaactcaaccggttttccggtaaatacgcccggcgcggaatgtttcaccacgttttcataagcatccaccatccacgacataattttgccgttggtattcacatcgggggcgggaatatcgattttctcgccaatcagcggggcaatcgcttcagcataagcgcgggcgatgcgttccagttccgcctcggaataatcgcgcggatccaaggtaatgccgcctttgccgccgccgtaaggaatacccgcaacgcagcatttgatggtcatccaaattgacagggctttgacttcgtccaaattcacactgggatggaagcgcacgccgcctttataggggccgacggcgttgttgtgttgcgaacggtagcccgtgaaggttttgaccgtgtcgtcgtcgagtttgacgggaaaattgacttccaacacgcgggtcggactcttcaggatttcataaacggccggatcggttttcagccggtcacaggcggttttcacctgtttgcgcgcgatttcaaacggattgagggtttcttttgcaagggcttcagacattttgcttccttttcacaaagagaggttcggaatggaacaagccatcaggttcgcaactataaccaattttcaagcaaaatgtaatagcgtgtagttggaatcggcccgatttgattaatctatatatgattttatttcccaagccgcacggaatccgtctgaaaaaagcggaacacatatccaaaaagcaaatgtccaattaaataaagatataagaatccttttattttttaaaaatttaattggaacggcgccgggatttgcacacccttcccgactccgttccgaaatccggaaacaccgccggcaaaacctgtttcgattgttaacaatccatacattagaagccctgtgcaaacgatgttaaaataaaccttttcaacccgacagaaaaccggattatgaatgcagccatcgaacacgtccaagccgtcgccttcgatttggacggcacactgtgcgattccgtccccgaccttgccgccgccgcagaagcgatgttggaacaactcggtatgaaaccgctgcctgccaaagtggtcgaaagctatgtgggcgacggcatcggcaaactggttcaccgcgtcctcaccaacgaccgcgaccgcgaagccgattccgaactgtgggaaaaaggtttcgtatctatatgaaatactaccgcgaccatttgagcgtcttcacccgcccctatcccgaaaccgaagccgggctggcattgcttaaatctttgggcatcccgctcgccgtcgttaccaacaaaaacgaaatccttgcctccgagcttctaaaacaactgggactcgccgactattttagcctgatactcggcggcgacagcctgcccgagaaaaaacccagccccctgccgctgcggcacgccgccgaagttttgggtatcgatgttgcaaacatggttatggtcggcgactcgcgcaacgacatcatcgccgccaaagccgccggctgcctgagcgtcggcgttaccttcggttacggcgatatgacgctgctctcgcaagacgatgcgacccgccccgactggattatcggctcgctgcccgaaatttacgaaaacctgcaacctcagaaaaacaaagaagagtaggcattcggacggctccggtttgcgccgctatgccgtctgaaacctgccccacgccgaaaccgccgccatgaaaccgcaaaaatccctacgcgcccgcgcgatggacatcctctcgcgccaagaactcagccgcatcggtctgaaacgcaaacttgcaccgcacgccgaaagcgaagaggagttggaaaacgtgttaaacgaatttgccgaacgcaactggcagtcggatttgcgctatgccgaagcctatatccgcagcaaaagccgcaaacacggttcattgaggctgaaacaggctttggcgcaacagggcatagatgaagaaaccagccgcaacctgcttcccgaccgctcaagcgaaaaactggccgccatagccgtgttgcgtaaaaaattcaaacatccggccgccgaccttaaagaaaaacaaaaacaggcacgcttcctcgcctatcgcggttttgatgccgataccgttcagacggcattgaaacatgcctgggatgacggctgggaggaagactgctgaactgaatccttgaatctttttgcatgacggcgtaaccttacctccatttccaacttttccgattgagaataaaatgtccgaacaatccgagaaaaatcacaacccacttcttgaagatgaacgcaaaaacccggtttaccgtatgggtcaggcagttgccggattcatgctcgtcgtttgggcaggcgtattggcactcgtgtttttcctagtcttccgtttttggctttcctaaacaaaatgccgtctgaaaccttcagacggcatcggcagcccatttcggcaggctatcccatcatagctttttttagcttgaattccactttcccattccctaaaatttttccacacccatttcaaaataccctttcttaaaacaggtacactatgacacaacaacgccaactgccttcgcacgaactcattatgtccgaactgatgatgccggacaccgccaatttcagcggcaacgtacacggcggcgaactcctgctcctgctcgaccaagtcgcctattcctgcgccagccgttacagcggcaattattgcgttaccctgtcggttgacaaagtcctgtttaaagaacccatccatgtcggcgacctggttactttctacgccagcgtaaactacacggggcgtacctctatggaaatcggcatccgtgtcgaagcacaaaacatccgtacgggagaaatccgccataccaacagctgctacttcaccatggttgcagtcaaagacggcaaacccgtccctgtccctccgctggaaatcctgaccgaccgccaacgctgccgctacgaaaaagccaaaaaacgcagagacatcagcctgcaagcctccggagacgtgtcctgcggctgctgacggcggactatgccgtctgaaagacaggcacatcgcgccatccgtttccattgcaaacggatgaaatcaagcaaatatagtggattaaattcaaaccagtacggcgttgcctcgccttagctcaaagagaacgattctctaaggtgctgaagcaccaagtgaatcggttccgtactatctgtactgtctgcggcttcgtcgccttgtcctgatttttgttaatccactatacccaaacacagtcaaacaaatttatatgccccatcccttccgaataatttgaaaacacagccgccaaaaacaaaaatgccgtctgaaaacctttcagacggcatttccaacttgatttcaggcagaaagtcagaacgcgatatagctgttcgggttaaccggtttgccgttttgacgcacctcgaaatgaagctgcgttctggaagcatcggtattgcccatcaaagcaacctgctgaccgcgtttgacctgctgcccctcgccgaccagcaatttttggttgtgcccgtatgcggtcaggaaagaagaattatgctggatgatgaccaagtttccgtatcccctcaaacctgaaccggcataaaccactttgccgtcagccgccgccaaaacgggctgtcccgcattaccggcaatatcgacacccttgttgttgccgccgaaatcggcaaccactttaccttgcgtcggacgctgccaaacaatgccgccgaccgaacgcgtgccggaaggcgaagcggcaggagattgcggggcgggcgcgggaaccgctttattttccgcagcgggcgcggcaggttgcggcgcggactgcacaggcggttgcgcggcgggtttcacaggggtttgcacggcagccggtacggcgggcctgctttctacggctgcggttttcggtgcggcatatcctgccggtttgactttaacaatctgaccgatgctcaacatattgtcggtcatgccgttccacgcacggaaatcgtcttgagagatatggtagcgtttggaaatgttgtacaccgtgtcgccgcgcacaatagtatgcgtcgccgcgttaatgtcgacgggtgcggactgtacgggcggttgcgcggcagccggtacggcgggcctgctttttacggctgcggctttcggtgcggcatatcctgccggtttgactttaacaatctgaccgatgctcaacgtattgtcggtcatgccgttccacgcacggaaatcgtcttgagagatatggtagcgtttggaaatgttgtacaccgtgtcgccgcgcacaatagtatgcgtcgccgcgttgatgtcgacgggtgcgtaagaaggaacgtatgtacccgaaacggcaggtgcagacggcggaacataagcaggaggcgtataaaccggcgcgctttgcaccggcggcacataaggcgcatcgccggcaggagccgggctgtacggcgttgctccataggggttgttgtaaactgccgaagacggcgcgtcctgcatacctgaattgcctgcaatgacaggagcaggctgttgggtggcgcaaccgcccaacagagcggcaacggcggtacaagctgccaaaagtgtcgtttgtttcaacataagataaccttcatgttccgatatatagcctgaatgcggtatatcataataaaaatgcgcgttcttctcaagcgcaaagcccgacggtatagtggattaacaaaaatcaggacaaggcgacgaagccgcagacagtacaaatagtacggaaccgattcacttggtgcttcagcaccttagagaatcgttctctttgagctaaggcgaggcaacgccgtactggtttttgttaatccactatatttgatgaaacggtcagtccgcatgccagaacgccgctgtttccgccatgtccggataggcggtcaggtcgatttgcagcggcgttacggtaatgaaacctgcgccgcattcaccgaaatccgttccctcttcccgatcggaaacttcgccgaccggtcctatccaataaatctgttcgccgcgcggattgcgcgcgggaatgacgttctgaccgtgatgcctcctgcccaaacgggcgattttaatgccccgcacatcttccggcgcaacggcggggatattgatgttccacaaaataggggactgcggggggtttttgaaaaaatgcgccaacaatgtccacagtgcctgttctgcggtcgcccaatagcgtccggaagcgtcgtttaaggaaaacgccacggcgggtatgcccataaggtaggcttcggttgccgccgcaaccgtccccgaataaagcgtgtcgtcccccatattcgcgccccggttgatgcccgaaaagacaaaatcggcctgaaaatccgaaaatacagactgcccgatgtggatgcagtcggtcggcgtgccgttgacatagtagaacccgttttgcgcctgtttcaactgcaaagggcgttccagcgtcagcgaattgctgaccccgctcctgtcgcgttcgggcgcgaccaccctgacgttggcaaattccgccgtaacgcgcgccaaaacggcaatgccttcggagaggtagccgtcgtcgttggaaatcaaaacgttcattttctatcctgaatgcttattcttcgggcaatttggtgattttgacccgctcgatgcgctgcccttctttttcgaccacttcaaaccgccagccgtggaaatcggcaaaatcgccgacatcggggatggtttgcaattcttccataatcagcccggcaaccgtatggaaatcggcatcttcctcctgctgcggcaggttgagttgcggtgcgagttccacatattccaacgcgccttccaccgtcaggctttcatcgggattcccctgaacggctggttcttcttcgcgctcaaattcttcggggaactcgcctgcgatggtttcgagcaggtctttcatggttaccatgcccaataccgcgccgaactcgtccaccaccaaagcataatccgcgctgctttggcggaagagttcgattgcgcccagcgcggtggtgctgtcgggcaggacgagcggctggcgcaatgccgtctgaatgtcgagaccgcctgtttccagcagttgggacagcaggtcttttttgttgatgtagcccaaaggttcgtccacgcccgccttaccgacaacgagcaggcggctgtaaggcgtgttttgcagttgggcacactgttcttcgcggctttgggaaatgtccagccgttcgatgtcgcggcgtgggatcatcacccccataatcgggcgttcggcaagcgtcagcacgctgcgtatcatcgatttttcgttttcttcaaaatgcgcgtcgtccccggattcgccgcccgcgtcggcaagcacgctttcgcgtatacccatcatacccaagacgttttcggcggtgcgcttgcgccacgagctgccgatgtagtcgtttttgcggctgttgcgctgcgaaatctggttaaacaattcgattaaaatcgagaagccgatggcggcgtagaggtagcctttgggaatgtggaaatggaaggcttcggcaatcaggctgaaaccgatcatcaacaaaaaaccaaggcagagcatcacgacggtagggtgtctgtcgacaaattcggtcaagagtttgctggcagaaatcattacagccatcgcgacgacgaccgcacccatcgccacgacgatatgatcgaccatcgccaccgcagtaatgaccgaatcgatggaaaacacggcatccagtatcaggatttgcgcgaccacgccccaaaacggcgcgtgttttttttggctgtcggcaacggtaaaacggttgtgcccttcgaggcgttcatgcagttcggtggtggctttgtaaagcaggaaaataccgcccgcgagcataatcatgtccttgccggaaacggcgaggccgccgatttggaacagcggctcggtcagcgtgatgatgtgcgccataaaagcaagcataatgatgcggatgacgactgccagccccagcccgataatccgtgcgcggtcgcgccgtgcgggctggaccttgtttgccaaaatcgccacaaagacaagattgtctatccccaatacgacttccaacaccaaaagcgtggcaaaacctatccaggtatgcggttctgccaaccaactgaaatccatgattttcgtattcctcaagttcaaacgcgaaaaggcagcctgaagcgctcaagctgcctgaacagacggtacgcacaaaaaacggcgggcgggcttgctgctctgctcggggtcttgcatgtgcgtgtaccttcggtcgaaataatttaaatagtttaacagcttatcggggcaatggcaaaacgccataccgtctgaaaggatgttcggacggcatgagcttattttgaaatgtttcaacacacggacggcacataaagccttcccctatgtgttgccctgattgaggggttgcgcccctctcaaatacagtctgattctaccgccgcgaagaacggatgttcgagtgcggacggagtcccaacgcttaaggggtgatgatgaagccgtctatcggcgcgtagcctttggtgttgccctctttatcggtaatgactatccactctttctgcctgctgctggtaaacggcaggtaatacagctcctccccttcggcgagacctgcctgtttcagaatgtccgcaaccgtcgtttttctcgcatccgccaagactttcagcggtttcagatgtttgcggatttcttctgcttccttgtcggaatacggcagccactggtcgggacgcatactcggctcgatacctttcagggacaaatccagcgtcttgttcttctcatccgcatcctcaggttctttcaatgcaatgcggcggatgccgaaccacgacaggctttgcagcccttcgggggctttgtgcaaatcttcgaccacgacttccgccgccgtaacaatggtcatacgatcctgttcaaacgcttccaccacaggacgcgccagcgaaacgctgtgcagaccgtacaccaaagccgccagctggatgatgccgaccatggaaaaatcgaccatgcgtgcctttgtctttttcttcgggcttgccaaaattaaagtcagcagcggaccacatacaatatcgacagccaccaccagctgataaagcgacagccctcccgtcagctcggcataaggataaggataccaaaccttaaaaaccagcaatgccgccagccctgcaaccgacaggctgattaagaggtgccagcccgcacttttcaaggcaaaacgccatctcgggactgtttttccgttttccatcatatcttgttcaaatcaaaaataaccgtaaaaacagggcgcattgtacaacagatagagactgcttaaaatgcggcgccgtctgaaatcctgccgttcagacggcatccgtcacccgacatccatacacagatatttcaattctagatattcgtccgcaccgtatttgctgccttcacgtcccaaaccgctacgtttcacgccgccgaacggtgccgcttcattgctgattaagcccgtattgatgccgaccataccgtattccaaggcttcgccgacgcgccattggcgggcggtgtcggcggtgaaaaggtaagctgccaaaccgtattccgtattgttcgcagcctcgatgacctcggcttcggtttcaaaacggaataccggacacaacggcccgaaggtttcttcgcgtgccaccgccatttgcgccgttacgccgcttaaaacagtcggttcgaaaaacgttccgcccaacgcgctgcgtttgccgccggtcaggcagcttgcacctttagcaagcgcgtcggcgatgtgctgctcgactttctccaccgctttttcctcaatcagcggcccttggttcacaccatcctccaagccgttgcccaatttgagcgcggctgctttttcactcaatttgcggcaaaattcgtcgtaaatggcggattgagcgtaaacgcggttggtgcagacgcaggtctgaccgctgttacggaacttgctggcgagcgcgccttcgacggctttgtccaaatcggcatcgtcaaacacgataaacggcgcgttgccgcccagctccaaactgagttttttaatgtccgccgcgctgtcggcaaaaatttttgcgccgacttcggtcgagccggtgaagctgattttgcggataatcgggttcgtagcaaattcatggccgatttccgaagcactgccgctgacaacaggcaacaaatcctgcggtatgcccgcttcgtaagccaacgaagccaaggcatacgcactcaaaggcgtgagcgatgcgggtttgacgatcatcgcgcaacccaccgccaaagcaggcgcggccttgcgcgcaatcatcgcggacggaaagttccacggcgtaatcgcagcggtaacgccgacgggctgtttcaacacgaccagtttttgcgacgctttcacactcgtcagcacatcgccgtcaatccgccgcgcctcttcggcaaaccagcgcacaaacgaagccgcataatcgatttcgccacgcgcctcggtcaggcttttgccctgctccatcgtcatcaggcgcgctaatgcttctttgttttctttaatctgaaaataccaacgccacaacacatcggcgcgttccaacgcagtttttgccgcccataatttttgtgctgcagctgctttttgaatcaggtttttcagcttgtccgaatccgtcttgcggacaaacgccaaagtctcgcccgttgccggattatcgactttgatgccgtctgaaaccgggggaagggaaatatcgggatgcttgattaattgggaatattcgttcatttcgtatcctccggtatgcggaataaccgctttcaaatgccgtcaatctcgcggacattatcatcttcatattccaaaactgcaaacccttccgatgccgtctgaagcatccgatcgggcagcgcaacatccgggcggtgtctgaatatggcgcgggcgcaatccctgtcgtttaagaaaaatattttttatacgatagtaatctttagaaagaaaagtaatgcagccctttgatggggtgcaatatataaggagcaaagattgcagttgcaacgtgtggtagagtatggcaaaaatccgaacattatagtggattaacaaaaaccagtacagcgttgcctcgccttagctcaaagagaacgattctctaaggtgctgaagcaccaagtgaatcggttccgtactatttgtactgtctgcggcttcgtcgccttgtcctgatttttgttaaatccactatacagtcaaaattacggagatcaaataatgatttttaaacagaatcaaaattattgggcagtttttgatgctaataaagaaactctgattgttcaaacatgttcaggtttggggttaacggcaatagaccacctatatcccccccatatcctgccattggataccgacaatgaaactttaggcacgacagtcttgcaagcgttggcaaacagcaggactttcgtttatgacagtccagaagaccaagatttttttgataccgaaaaaattcggcaacgctatgaggattgggttgccaagctatgcgggaacttgggctataaaaccagacgcgccctatttaaaaacatgatgagcgtggatatttggctgcacaacggctgcctgaaaatcagcccgagccgccatgtcaagctggaagcgtggaatgccattgatgcagacgatgtcattttatcattggataacagccctgaagaaatcggagcaggtttaaagttggcattgagccactgccgataatatttgacaaaaggccgtctgaaaaacagctttgacaaagacgcggttgccaaagagatcgacctacaaagggaagtaacgcaggcgttcggcaaaacgccgcccaagccgcagcggccgttgccgacgaactcggcaatacccgaagttacggacggtatcaggcagcccgaaccctgccggaggccgaactgcaaaacaaatccgacacaaaaaaccgtccgtccgacacaaaaaaccgcccgaaaaatctggacggcggttcaaacaggctgccccgtttaacgggcgcggcaggaagtttcgaccgaattgccgtaggcatcggtaaagccgaaaaaggcttcgccgcctttctggtgccactcggttgcgtttccgaacaaaccgtgttcggcggtatagcgttcgccggatgcggcaacgtcggaagagaggacggcacgcctgccgtccagccgcaacgcgactttgccgctgtccaaatggcggacgcgcacagacaaaccgttctcgcaggaaaacgcccgaaaatcgtccgtgccggcttggttttgaacgggcggcatatgcccgcgtccgccgtcatcatacgcctccggcacggcacaggccgccaaagacaaaaccggtacggtcagcgcgaaaaacctgatattcataaaagctccccaataaaaataagatatgaaacaaccgccctgattccaagctgcggcaacgccatactataaacggacgcgcaaacacacaagcccgataaccggaatttacctgcgatgaatcaataatccggattgcgcgccccttctttacccctcttccgatgccgccttttgcctgacgatgccgtctgaacctgcctgcccgcccggaggaatgtaaattttttccaaattccaagtaaaaaccgctatcggtgtgctaatttgcgttaaaatcctattcggcgtttaacgttttgtgcgcccgcatccctgcactgtttgatgcgggcataaggcacaaatcccgacaagcgcactgtttcatacttcgtcaatcattcagactccggtttgtgcccgtgccggcagatggttcggccgtttcccgccgttcaggcatattccgacagtgtgagataaggatttattcgatgaaatcactcaaaaccttcctcatttggggcatagtggtactggtcggcttagcatcctttaccactctggccctcagccgaggcgaacaggtcagcgcggtatggatggtcaccgccgccatatccgtttactgcatcgcctaccgtttttacagcctctacatcgccaaccgcgtaatgcggctcgatcctgaccgcctgactccggcagaacgccacaacgacggcttggactacgttccgacgcacaaaggcgtattgttcggacaccactttgccgcaattgccggcgcgggccctttggttggtccggttttggcggcgcaaatgggttatctgcccggtactttgtggattatcttcggcgtggtatttgccggcgcggtacaggatatgatggtcttgttcgtctctatgcgccgcgacggtaagtctttgggcgatattgtgaaacaggaactcggcactgtccccggcgtgattgcctccatcggtattttgatgattatggtcatcattatggcggtgttggcgttgattgtcgtaaaagcattggttcacagcccttggggtacgttcaccattgcagcaactatgccgattgcgctgtttatgggtatttacacgcgttatatccgtccgggcaaaatcggcgagatttccatcgtcggctttattttgctgatgctggcggtaatttacggcgaagatgtggctaaaagttccatcgggcattggttcgaccttgacggcatccagctcacttgggcgattatgatttacggctttgtcgcctccgtattgcccgtatggttgctgctcactccgcgcgactatctctccaccttcctgaaaatcggtacgattgcggccttggctttgggtatcgtcatcgtcaatcccgctttgcaaatgcctgccgtaacccactttatcgacggttcgggtccggtattctcaggcgcattgttcccattcttgttcattaccatcgcctgcggtgcggtttcgggcttccacgcgctgatttcttccggcactacgccgaaaatgctggaaaacgaaacccacgtccgcatgatcggttacggcggtatgttgatggaaagtttcgtagccattatggcacttgccgctgccgcatcgcttgatcccggcgtgtacttcgccatgaacagcccagccgccctgatcggtacggatgccaataccgccgccgaagtgattaccaccaagctgcaattccctgtcgatgccgcaaccctgttgcacactgctaaagaagtcggcgaaaacaccatcctttcccgtgccggcggtgcgcccaccctcgcagtcggtatggcgcacattatgagccgcctgattccgggcgaggcgatgatggcgttctggtatcacttcgccctgttgtttgaagccttgttcatcctgaccgccgtcgatgccggtacgcgcgtcgcacgttttatgattcaagacttgggcagcatcttctacaaacctttcggcaacaccgactccatccccgccaacctgattgcgaccttcttcgccgtggcattgtggggctacttcctctacacgggcgtgaccgacccgttgggcggcatcaactcgctctggcctttgttcggcatcgccaaccaaatgctggcaggcgtagccttgattatgtgcgccgtggtgctgattaagatgaaacgcgaccgttatgtctgggtggtactcgttcccgccgtcggcgtactgttcgtaacctgctacgccggcctgcaaaaactgttccacagcgacccgcgcatcagcttccttgcccacgccggcaaatacagcgacgcattggctaaaaacgaaatccttgcgcctgccaaagacatcggcgaaatggcgcaaatcatcttcaacgacaagattaatgccggtctgaccatcctcttcttgtcggttgtcgtgattgtcgccgcgtacggtttgcgtaccgccctcaaagcacgcaaagtcggctggccgaccgccaaagaaatcccggcggtgtaccgcgacggcaaacagccggaggcacaaagtgaagcataagctcgcgtcttggtggaaaaccatcaagctgacggcaaacttgatggcaggcgtgcccgattatgaaaactacgttgcacagcagcgcaaacataatcccaacgcccccgtgatgaccaagctgcagtttcaagactattgccgcaaacgccgctgcggcgcaaacggcggacgctgctgttaagcctgcttgaaacaaattccgtctgaacgccgcttcagacggaatttttataatatagtggattaacaaaaatcaggacaaggcgacgaagccgcagacagtacaaatagtacgaaaccgactcacttggtgcttcagcaccttagagaatcgttctctttgagctaaggcgagacaacgccgtactggtttttgttaatccgctataccacgatgaatccttcgcaatatctgtttatcgacctcaattttgacaaaataccggatacgcgcctttgttgcttttccatcttccaaccaactgtaaatctcaaacagccggtacacgccatgcttcagtttcttttcctgtcggcggattgtttcgacaaagaattgaaaatccatttcatgcaccttaaaatttaatctgcattcaaaccttttcactttggaagcaccatttatcggatgtcccttcgcaataaacaaattttcccgataccgccgcccatttcaacccaaacccaaaagctatgaaaaacctcatcgccttcaacaaaccctatggcgttatctgccaattttcaccgcacgaaaaacacaaaagcctcaaagactttatcaatcttcccggcttctaccccgccggacggctcgacaccgacagcgaggggctgctgctgctgaccgacgacggcaggcttcaggcacaaattaccgaccccaaattcaaacaccctaaaacctactgggcgcaactggagggcgtacccgacgaaagccgattggaaagcctaagaaaagggatagacttaggcggtttcgttacccgtccggcaagcatccgcatcttgaaacacggagaagcagattcgttatgggagcgcatcccgccgatacgcgtccgcaaaaccgttcccgatttttggattgaaattaccatttctgagggcaaaaaccgccaagtcaggcgaatgaccgccaaggcgggctatccctgcctgcgtctgatcagagtggcaagcggcaggctgaaactgtttgatttggatttaaaacccggggaatgggcatacgccccgtttaaaccataatcacgtttatctcatcatttccacaaaagtgggaatccggaattttatagtggattaacaaaaatcaggacaaggcgacgaagccgcagacagtacagatagtacggaaccgattcacttggtgcttcagcaccttagagaatcgttctctttgagctaaggcgaggcaacgccgtactggtttttgttaatccgctatattccgccatctctaagatttacagcgatacacgggtgatttaaggaatgcccgaaccgtcattcccgccacttttcgtcattcccgcgcaggcgggaatctagaatctcggactttcagataatctttgaatattgctgttgttctaaggtctagattcccgcctgcgcgggaatgacgaatccatccgcacggaaacctgcaccacgtcattcctacgaacctacatcccgtcattcccacgaaagtgggaatccagaacgtaaaatctgaagaaaccgttttatccgataagtttccgtaccgaacagactagattcccgcctgcgcgggaatgacgattcataagtttcccgaaattccaacataaccgaaacttgacagtaaccgtagcaactgaaccgtcattcccacgaaagtgggaatctagaaatgaaaagcaacaggcatttatcggaaataactgaaaccgaaccgactagattcccgcctgcgcgggaatgacggctgcagatgcccgacggtctttatagcggattaataaaaatcaggacaaggcggcgagccacagacagtacaaacagtacggaaccgattcacttggtgcttcagcaccttagagaatcgttctctttgagctaaagcgagacaacgctgtactggtttttgttaatccactataaatatccaattgaaatcttcagacggtatatcaaatttacacttttttaatgtttatgccgcctgaaaaaaatgctagtatatttcctaattgtctgactgtttattgttgaggaaaatatgagatcttctttccggttgaagccgatttgtttttaccttatgggtgttacgctatatcattatagttatgccgaagatgcagggcgcgcgggcagcgaggcgcagatacaggttttggaagatgtgcacgtcaaggcgaagcgcgtaccgaaagacaaaaaagtgtttaccgatgcgcgtgccgtatcgacccgtcaggatatattcaaatccagcgaaaacctcgacaacatcgtacgcagcatccccggtgcgtttacacagcaagataaaagctcgggcattgtgtctttgaatattcgcggcgacagcgggttcgggcgggtcaatacgatggtggacggcatcacgcagaccttttattcgacttctaccgatgcgggcagggcaggcggttcatctcaattcggtgcatctgtcgacagcaattttattgccggactggatgtcgtcaaaggcagcttcagcggctcggcaggcatcaacagccttgccggttcggcgaatctgcggactttaggcgtggatgacgtcgttcagggcaataatacctacggcctgctgctaaaaggtctgaccggcaccaattcaaccaaaggtaatgcgatggcggcgataggtgcgcgcaaatggctggaaagcggagcatctgtcggtgtgctttacgggcacagcaggcgcagcgtggcgcaaaattaccgcgtgggcggcggcgggcagcacatcggaaattttggcgcggaatatttggaacggcgcaagcagcgatattttgtacaagagggtgctttgaaattcaattccgacagcggaaaatgggagcgggatttacaaaggcaacagtggaaatacaagccgtataaaaattacaacaaccaagaactacaaaaatacatcgaagagcatgacaaaagctggcgggaaaacctggcaccgcaatacgacattacccccatcgatccgtccagcctgaagcagcagtcggcaggcaatctgtttaaattggaatacgacggcgtattcaataaatacacggcgcaatttcgcgatttaaacaccaaaatcggcagccgcaaaatcatcaaccgcaattatcagttcaattacggtttgtctttgaacccgtataccaacctcaatctgaccgcagcctacaattcgggcaggcagaaatatccgaaagggtcgaagtttacaggctgggggcttttaaaggattttgaaacctacaacaacgcgaaaatcctcgacctcaacaacaccgccaccttccggctgccccgcgaaaccgagttgcaaaccactttgggcttcaattatttccacaacgaatacggcaaaaaccgctttcctgaagaattggggctgtttttcgacggtcctgatcaggacaacgggctttattcctatttggggcggtttaagggcgataaagggctgctgccccaaaaatcaaccattgtccaaccggccggcagccaatatttcaacacgttctacttcgatgccgcgctcaaaaaagacatttaccgcttaaactacagcaccaataccgtcggctaccgtttcggcggcgaatatacgggctattacggctcggatgacgaatttaagcgggcattcggagaaaactcgccgacatacaagaaacattgcaaccggagctgcgggatttatgaacccgtattgaaaaaatacggcaaaaagcgcgccaacaaccattcggtcagcattagtgcggacttcggcgattatttcatgccgttcgccagctattcgcgcacacaccgtatgcccaacatccaagaaatgtatttttcccaaatcggcgactccggcgttcacaccgccttaaaaccagagcgcgcaaacacttggcaatttggcttcaatacctataaaaaaggattgttaaaacaagatgatacattaggattaaaactggtcggctaccgcagccgcatcgacaactacatccacaacgtttacgggaaatggtgggatttgaacggggatattccgagctgggtcagcagcaccgggcttgcctacaccatccaacatcgcaatttcaaagacaaagtgcacaaacacggttttgagttggagctgaattacgattatgggcgttttttcaccaacctttcttacgcctatcaaaaaagcacgcaaccgaccaacttcagcgatgcgagcgaatcgcccaacaatgcgtccaaagaagaccaactcaaacaaggttatgggttgagcagggtttccgccctgccgcgagattacggacgtttggaagtcggtacgcgctggttgggcaacaaactgactttgggcggcgcgatgcgctatttcggcaagagcatccgcgcgacggctgaagaacgctatatcgacggcaccaacgggggaaataccagcaatttccggcaactgggcaagcgttccatcaaacaaaccgaaactcttgcccgccagcctttgatttttgatttttacgccgcttacgagccgaagaaaaaccttattttccgcgccgaagtcaaaaatctgttcgacaggcgttatatcgatccgctcgatgcgggcaatgatgcggcaacgcagcgttattacagctcgttcgacccgaaagacaaggacgaagacgtaacgtgtaatgctgataaaacgttgtgcaacggcaaatacggcggcacaagcaaaagcgtattgaccaattttgcacgcggacgcacctttttgatgacgatgagctacaagttttaaaggcagcccgcattttgtagaaaaccgcaatgccgtctgaaagcccttcagacggcatttgtttccccaaacgcatcatcctgccgcaagcctatgccaatccgttttatcgcatcggcaactcaaagaaaaatccatttcattcccacgcagggaagccggtttttgatttcggttatttttggttgtttcgggtaatttatgagtcgtcattcccgcaaaagcgggaatcagtttttttaagtttcagccatttccgataaattcctgtggctttagctttccggattcccactttcgtgagaatgacgtggtgcaggtttccgtacggatggattcgtcattcccgcgcaggcgggaatctagaccgttcggtttcggtttttttggttagtgccgcaacattaaatttctagattcccactttcgtgggaatgacggcggagcggtttctgctttttccaataaatgcccccaacctaaaatccgtcattcccgcgcaggcgggaatctagacattcaatgctaaggcaatttatcggaaatgactgaaactcaaaaaactagattcccactttcgtgggaatgacgtggtgcaggtttccgtatggatggattcgtcattcccgcgcaggcgggaatctagtccgttcggtttcggtttttttggctaatgccgcaacattaaatttctagattcccactttcgtgggaatgacggcggagcggttgctgtttttcccaataaatgccccccaacctaaaatccgtcattcccgcgcaggcgggaatctagtccgttcggtttcggtttttttggctagtgccgcaacattaaatttctagattcccactttcgtgggaatgacggcggagcggtttctgcttttcccaataaatgcccccaacctaaaatccgtcattcccgcgcaggcgggaatttagacattcaacgctaaggcaatttatcggaaatgactgaaactcaaaaaactggattccctctttcgtgggaatgacgtagtgcaggtttccgtacggatggattcgtcattcccgcgcaggcgggaatctagacattcaatgctaaggcaatttatcggaaatgactgaaactcaaaaaactggattcccgctttcgtgggaatgacgcgattagagtttcaaaatttattctaaatagctgaaactcaacgcactggattcccgcctgagcgggaatgacgaagtggaagttacccgaaacttaaaacaagcgaaaccgaacgaactggattcccactttcgtgggaatgacggaatgtaggttcgtgggaatgacgggatgcaggtttccgatggatggattcgtcattcccgcgcaggcgggaatctagacattcaacgctaaggcaatttatcggaaatgactgaaactcaaaaaactggattcccacttttgtgggaatgacgcgattagagtttcaaaatttattctaaatagctgaaactcaacgcactggattcccgcctgagcgggaatgacgaatttcaggttgctgtttttggttttctgtttttgtgaaaataatgggattttagcttgtgggtatttaccggaaaaaacagaaaccgctccgccgtcattcccgcgcaggcgggaatctagtccgttcggtttcggtttttttggctagtgccgcaacattaaatttctagattcccactttcgtgggaatgacgggatgtatagtggattaacaaaaaccagtacggcgttgcctcgccttagctcaaagagaacgattgtctaaggtgctgaagcaccaagtgaatcggttccgtactatttgtactgtctgcggcttcgtcgccttgtcctgatttttgttaatccactataaatttaatccactatattttttgttccaaagtcaaaatatgccgtccgaacattcgggcggcagacaaaacggcactgcccgataaaggcagtgccgttgtccgtttcaaaccgtgaaacatcagcccaaattaaaggctttatgcaataccctggttgccagttccatgtatttttcatcaatcaatacggaaactttgatttcggaggtggaaatcatttggatgttgataccctcttcggcgagcgtgcggaagattttggcggctacaccgacgtgcgaacgcatacccaaaccgactgcggagactttgcatacggtgtcgtcgccatcaatagaagccgcgccgatactgtcttggcgttccgacaggatttccaaagtctgcttgtaatcgccgcgcggtacggtaaaggaaaaatcggttgtgccttcgctgccgacattttggataatcatatcgacttcgatgttggcatcggcaaccgcgcctaaaatctgataggcgacgccaggtttgtcgggtacgccgcgcacgttgatgcgggcttggtttttatcgaatgcgataccggttacggcagctctttccatgttgtcgtcctcttcaaaggtaattaaggtgccattgccgccgtcttgcaggctgctcagtacgcgcaggcgcactttgtattttccggcgaattctactgaacggatttgcaaaactttcgaaccgaggcttgccagttcgatcatttcttcaaatgtaaccgtatccatgcggcgcgcttcgggtacgacgcgggggtcggttgtgtaaacgccgtctacgtcggtatagatttggcactcgtcggctttgagcgcggcggcaagcgcgacggcggaagtgtcggaaccgccgcgtccgagcgtggaaatatcgccttcactgctgatgccttggaagccggcaacgatgacgactttgccggcggtaaggtcggcacgcattttttcgtcatcaatgctttcgatgcgggctttggtgtgggcggtatcggttttgagggcgacctgccagcctgtgtagcttttggcatccacgccgatgtctttcaatgccatcgccaaaaggccgatggttacttgttcgccggtagctaagacgacgtccagctcgcgcggatcgggatgctcttgcatttcgtgcgccagtgcgaccagtcggttggtttcgccgctcatggcggatacgacgactacgatgtcgtgtccttcggcgcgggctttggcgacacgtttggctacgtttttgatgcgttcgggcgagcctactgatgtgccgccgtatttatgtacgattaacgccatgtttcgtgctttcttgtgggggttgtcgggcagcttggtttgctggaaaaagggttattattactattttttacatggaattcaagaacggactgcgctttcccgcctgccgtttgacagcggtcagcgaaaaacctgttctttcagattgttgacaaaatgccgtctgaacggttttcagacggcatccggacgacaatcaggcggcggacaacgcattttgctggtgttgcagcagttcgcctatgcctttttgcgccagtgcaaccagtttgcccaattcgtccaaactgaacggcgcgtcttccgccgtcccctgtatttcgatgatttttcccgatgcggtcatgacgatattcacatcactgtcgcaaccggagtcttcgggataatccaaatccaaaagcggcacgccgttcactacgcctactgacacagcggcaacggcttcgcggatggggttttcactcaaaatgccgtctgaaaccagtttgccgacggcgatttgcagcgcgacaaacgcaccggtaatcgaagccgtgcgcgtaccgccgtctgcctgaatcacatcgcagtcaatcaagatttgtcgttcaccgagtttttccatatccacgaccgcgcgcagggaacgcccgatcaaacgttggatttcttgtgtgcgcccggactgtttgcccgccgaagcttcgcggagcatccgggaagcagttgaggcaggcagcatcccgtattccgccgttacccagccttggtttttaccgcgcagaaacggcgggacgttttcatctatggaagcggtacaaatcactttggtattgccgcattcaataaggcacgaaccgtccgtatgcggcaggaaatgaggggtgattttgatatcgcgcaggctgtcggcggcgcgcgagatgcggatgtaatcaggcatactgccctcccgttaaaaacagataaattaaaaagccttaaatatgaaaaatcacatttaaggccttcaaactgaaaatttctacgcctcttcggctttgctgcggataatcaaaagcggcaggtggctttggcgcattaccgtttcggcaaaactgcccattaaaaggtgcatcagcccggtacgtccgtgcgtacccaacaccagcaggtcggcaccgttttcatcggcataatcaaccaaatcctgcgccatttcacgcgcacccttattggcaaccagcaggtgtttgacggtattttccacacccagttcctgggcggtgcgctcggcggcatccaaaacttcgttgccttgcgcgacggcggcggcttcgtagctttcgtgttgcaaaaattcgggggcgagtgccatatattcggcaggattggcaacgtgcaccaaagtcaggcgcgcaccgttgaccccggcaagctcggcggcatgtttcagggcattgatggacgtttcactgccgtcaacggcaacaaccaaatgtttgtacatatcgtattctccttttgcaccgcctcgcggtgccctcttgtcggatgggcgcagggacagtttgcgctgtttcattatagacccgccgtcgggctttatacaacagccgaacagcccgaccgctttccagtataatatgccgcttccgtgcagtcaggcattttttgccggctttcgttcactttttgatttgacgcaatcttgcaggattcgaccatgtccgacaacgctttgacctcttcgcgacgcttcggcggcatcgccagactctacggagactctgccttggcgcacttttcacaggcacacgtctgcgtagtcggcgtgggcggtgtcggctcgtgggcggtcgaggctttggcgcggacgggcatcggacgtttgactttgattgatttggacaacgttgccgaatcgaatgtcaaccgccagctgcacgccctgaccggcgacttcggcaaagcaaaagttaccgccttgcgcgaacgcattacacaaattaatccgcaatgcgaagtgtttgaaattgaagatttcgttaccgaagacaatttgccggaatacttcggaaaaggttttgatttcgtcatcgacgcgatcgaccaagtgcgcgtcaaagcagcaatggcggcttattttgtggaacgcaaacaaccgtttgtcctcagcggcggcgcgggcggacaaaaaaatccggcgttaatccaaaccgccgatttgagccgcgtaacccacgacccgctgcttgccaacctgcgctacaccttgcggaaacgctacggattcagccgcgatacgaaagcaaatatgcgcgtgccttgcgtgtattcgaccgaaaatatcgtgccgccgcagtctagggaggcttgttcggcagatgccgctccgcaaggcttgtcgtgcgccggctacggtgcaagcatgctcgttaccgcttcgttcgggctatattgcgcacaggcggcggtggaacacatcgcagacaaaaaataagcaatgccgtctgaaacaggattcagacggcatttgaacaaactatggttatgatttaagacaacaaaggatacggataaaaaataacataaaatatatgattcctaataatataccaagtatcggagagctatttaatggaattcgttaataatttagttattttttcatttttattactaatgcttattccgatattttttgtagtatatggtatataccataagatacgttatcgcaaaatatgtatcctaagaacaagttttatattattagtggtaatactttgcagtatgtattacatatattgccgttatcttgaccaacaaaaagtagcttattattgcatagatgaacaatgtatttctattgttcatctatacaaagattatggtataaactctcccacatatgcgagaatttacgcaggaaaaatattgtttagatttcaagtaagagctaaaaattacgctgaattacttatggaagatgatatatcaattagtaaaaaaattttggggaataaatttatcatttatgggtcgctacctgtaatatacggtaatgtagataatattgaagtaaaagaagctactggttatatagatagatccagtactgattatattgtctcaagaaacttaaaattcagacatttatattaattaagaggttttagcaagagtgccgtcaaaatatagggcgcatcatcgaattcgcgaaagacaaacgctacgatgaacgtttcaaggatttgaaaaaagaatccataggctatctgaaccggcatcccggtttggtgtccgactacctgaaggcggcaatcaagctgtcggttcagaaaaaccaacatcagcacgcctaaaaccgtattcacaacctgctccttttcaaaacatttgcatttaaaagccgttataatgccgtctgaacatctgcccgaccacattatacgtgaatgtcggcagattgttttcttttgtaaacttatattaaaatccacttaccgattcacgccatgccgcccatccctgccccatctgcaccatccgagcacactgtcgcatgggtattcggccaacccgttaccgatttgccccaggatttgtttattccgcccgatgcattgaaagtcgtattgggcagcttccaaggccctttggatctactgctgtatctgatccgcaaacagaatatcgacgtactggatattccgatggtgaagattaccgagcagtatctgcactacatcgcccaaatagaaacctatcagtttgatttggcggcggaatatcttttgatggcagcaatgctgattgaaatcaaatcgcgcctgctgctgccgcgtaccgaaaccgtcgaagacgaagaagccgacccgcgtgccgagttggtgcgccgcctgctggcttacgaacagatgaagctggcggcgcagggtttggacgcgctgccccgagccggacgggatttcgcgtgggcttacctgccgctggaaattgccgtcgaagccaagctgcccgaagtctatattaccgacttgacgcaagcgtggctgggtattttgtctcgggcaaaacacacgcgcagccacgaagtaatcaaagaaaccatctccgtgcgcgcgcaaatgacggcaatcctgcgccgtttgaacggacacggaatatgcaggtttcacgacctgttcaatcccaaacagggcgcggcttacgtggtcgtcaacttcatcgcactgttggagcttgccaaagaaggattggtcagaatcgtgcaggaagacggtttcggagaaatccgaatcagcctcaatcatgagggggcgcattcagacggcatttccggcacacgaggcgggcgcgatgtgttctaatacgccccaagccgccaccaaaaatcgggagacacgccatatgaccggcatcatacattcgctgcttgacaccgacctctacaaattcactatgctgcaagtggttctgcaccagtttccgcagacgcacagcctttacgaattccgctgccgcaacgcctcgaccgtctatccgcttgccgacatcagggaagacttggaagccgaactcgacgcgctctgccaactacgcttcacccacgacgaactcggctatctgcgctccctgcgtttcattaaaagcgactttgtcgattatctcgaactcttccagctccaacgccgctttgtcgaaatcggcacagacgataaagaccgtctgaacatccgcatcgaaggtccgatgatacaggcgatgttttttgaaatcttcatcctcgccattgtcaacgaactttacttccgccgcctggaaacccctgcagtcatagaagaaggcgaacgccggcttcaagccaaagccgcgcgcctcaaagaaatcgccgccgcacaaaaccccgacgaaccgcccttcctgatttccgacttcggcacgcgccgccgctacaagctcgcgtggcaggaacacgtcatccgcaccctgcttgaagccgcccccggcatcgtacgcggcaccagcaatgtctttctcgccaaaaaactcggcatcacccccatcggcaccatggcgcacgagttcctgcaggcattccaggccctcgacgtacgcctgcggaatttccaaaaggccgcgctcgaaagctgggtgcacgaataccggggcgatttgggcgttgccctgaccgacgtggtcggtatggatgccttcctgcgcgatttcgacctctatttcgccaaacttttcgacgggctgcgccacgacagcggcgacccttacgtttggggcgacaaagcctacgcccactatcaaaagctcaaaatcgacagccgcaccaaaatgctgaccttctccgacgggctggacatcgaacgctcttgggcattgcaccaatatttcaaagaccgcttcaaaaccggcttcggcatcggcaccaacctcaccaacgatatggggcatacgcccttgaatatcgtcttgaaactggtcgaatgcaacgggcagtccgtcgccaagctgtccgactctccgggcaaaaccatgaccaacaacagcaccttcctcgcctacctgcgccaagtgttcgacgtacccgaacccgaaacgccgtaaaccggcagaaaaagcgcacaattcctgtttctgccgcataaaatcttttaaaataccgcctgatttgaatttaaccgaaagaccgaacttcatgaacctacatcaaaccgtcgaacacgaagccgccgccgcctttgccgccgcaggcatcgccgacagccctattgttttgcagccgaccaaaaacgccgaacacggcgatttccaaatcaacggcgtgatgggtgcggcgaaaaaagccaaacaaaacccgcgcgagttggcgcaaaaggtcgccgaagcattggcggacaacgccgtgattgaaagcgcggaagtcgccggtccgggcttcatcaacctgcgcctgcgccccgaatttctcgcgcaaaacattcagacggccttgaacgacgctcgtttcggcgtggcaaaaaccgacaaaccgcaaaccgtcgttatcgactattcttcgcccaatctggcgaaggaaatgcacgtcggccacctgcgttccagcatcatcggcgacagcatttcgcgcgtgttggcatttatgggcaataccgttatccgtcaaaaccacgtcggcgactggggtacgcagttcggtatgttggtcgcttatttggtcgagcagcaaaaagacaatgccgcgttcgagctggcggatttggagcagttttaccgcgccgccaaagtgcgctttgacgaagaccctgcctttgccgacaccgcacgcgaatacgttgtgaagctgcaaggcggcgatgaaaccgttttggcattgtggaaacagtttgtcgatatttcgctctcgcacgcccaagccgtttacgacacgctgggcttgaagctgcgtcctgaagacgtggcaggcgaatcgaaatacaacgacgatttgcagcccgtggtcgatgatttggttcaaaaaggtctggcggttgaggacgacggcgcgaaagtcgtgttcttggacgaatttaaaaacaaagaaggcgaacccgccgcatttatcgtgcaaaaacaaggcggcggcttcctctacgcctccaccgatttggcgtgcctgcgctaccgcataggccgtctgaaagccgaccgcctgctgtacgtcgtcgaccaccgccaagccctgcacttcgaacaacttttcaccacttcccgcaaagcaggctatctgccggaaaacgtcggcgcggcatttatcggcttcggcaccatgatgggcaaagacggcaagccgttcaaaacgcgcagcggcgacaccgtgaaactggtcgatctgctgaccgaagccgtcgagcgcgccaccgctttggtgaaagaaaaaaatcccgaattgggtgcggacgaagccgctaaaatcggtaaaaccgtcggcatcggcgcagtcaaatacgccgacttgagcaaaaaccgcaccagcgactatgtgttcgactgggatgccatgctctcgtttgaaggcaacaccgccccctatctgcaatacgcctacacccgcgtgcaaagcgtgttccgcaaagcaggcgaatgggatgcaaatgcgccaaccgttttgaccgaaccgctggaaaaacagcttgccgccgagctgctgaaatttgaagacgtactgcaaagcgtggcggacacggcgtatccgcactacctcgccgcctacctctatcaaattgcgaccctgttcagccgcttctacgaagcctgtccgatactcaaagccgaaggcgcaagccgcaacagccgcctgcaactggcaaaactcaccggcgacacgctgaaacaaggcttggatttgctgggcatcgatgtgttggacgtaatgtaaaaccgcaccgcccgattgcggacaacagcctcgccatccttatccgaatctgaaaaaagcggcgcgatacaccgtatccgccgcccctcccaaaatgcgaaacaaacaaacgccaagcaagcaagcaagcaagcaagcaagcaagcaagcaagcaagcaaaaaattataacccccttcctgccgacgcacgcactttccgcgcggcgcattccccttttcccgcccctcaaatccgccttttcttcaggcagggtttcagcccgcctcttttccctgttttcctttccccgacacgcgtgcgctccccctgccgcactgtgctgcactttcgcgcccggacggcatcgttccgccatccggttctctgttttacatacccctgtttcagaaagaaatgcagatgtttcaacacacaggacgacacataaagcaccgccctatgtgttgccctgatttggaaggggttacgcctcccaaataaagtctgatcctgccgccccgaaggacagatgtccgagtggcgaagtttcaaccgaaaaggaaatacgatgaatattcacaccctgctctccaaacaatggacgctgccgccattcctgccgaaacggctgctgctgtccctgctgatactgcttgcccccaatgcggtgttttgggttttggcactgctgaccgccaccgcccgcccgattgtcaatttggactatcttcccgccgcgctgctgatcgccctgccttggcgtttcgtcaaaattgccggcgtattggcgttttggctggcggttttgtttgacgggctgatgatggtgatccaactcttcccttttatggatctcatcggcgccatcaacctcgtccccttcatcctgaccgcccccgccccttatcagataatgaccgggctgttgctgctgtatatgctggcgatgccgtttgtgttgcagaaagccgccgccaaaaccgacttccggcacattgccgtctgcgccgccgttgtggcggcagccggctatttcaccggccatttgagttactacgaccggggtcggatggccaatatcttcggcgcaaacaacttctactacgccaaaagtcaggcgatgctctacaccgtcagccagaatgccgactttattaccgccggcctggtcgatcccgtcttcctccccttgggcaatcaacagcgtgccgccacgcatctgaacgagccgaaatctcaaaaaatcctctttatcgtcgccgaatcttgggggctgccggccaatcccgaacttcaaaacgccacttttgccaaactgctggcgcaaaaagaccgtttttcggtttgggaaagcggcagttttcccttcatcggcgcgacggtcgaaggcgaaatgcgcgaactgtgtgcctacggcggtttgcgcgggttcgcactgcgccgcgcgcccgacgaaaaatttgcccgctgcctccccaaccgtttgaaacaagaaggttacgccacctttgcgatgcacggcgcgggcagttcgctttacgaccgcttcagctggtatccgagggcgggctttcaagaaatcaaaaccgccgaaaacctgatcggtaaaaaaacctgcgccattttcggcggcgtgtgcgacagcgagctgttcggcgaagtgtcggcatttttcaaaaaacacgacaagggactgttttactggatgacgctgaccagccacgccgactatcccgaatccgacattttcaaccacaggctcaaatgcaccgaatatggcctgcccgccgaaaccgacctctgccgcaatttcagcctgcacacccaattcttcgaccaactggcggatttgatccaacgccccgaaatgaaaggcacggaagtcatcatcgtcggcgaccatccgccgcccgtcggcaacctcaatgaaaccttccgctacctcaaacaggggcacgtcgcctggctgaacttcaaaatcaaataacaacaatgccgtctgaacgcaccaacagccttcagacggcattttgcagacagaccgacccttcaagcccacttttttcatcatctccgataaattgctttgtatagtggattaacaaaaaccagtacggcgttgcctcgccttagctcaaagagaacgattctctaaggtactgaagcaccaagtgaatcggttccgtactatttgtactgtctgcggcttcgtcgccttgtcctgatttttgttaatccgccataaagaccgtcgggcatctgcagccgtcattcccgcgcaggcgggaatccagaacgtggaatctaaagaaaccgttttacccgataagtttccgcaccgacagacctagattcccgcctgcgcgggaatgacgggattttaggtttctgattttggttttctgtccttgtgggaatgacgggatgtaggttcataggaatgacgtggtgcaggtttccgtatggatggattcgtcgttcccgcgaaagcgggaatccggaaacccaaagccacgggaatttatcggaaaaaccgaaaccgctccgccgtcattcccgcgcaggcgggaatctaggtctgtcggtgcggaaacttatcggataaaacggtttcttcagattttacgttctggattcccactttcgtgggaatgacgggatgtaggttcgtaggaatgacgtggtgcaggtttccgtatggatgggattccctcttgcgtgaggctgacagatgccgtctgaaagactttcagacggcatagctttttctctttgaatttatagtggattaacaaaaatcaggacaaggcggcgagccgcagacagtacagatagtacggaaccgattcactcggtgcttcagcaccttagagaatcgttctctttgagctaaggcgaggcaacgccgtactggtttttgttaatccacgataaatttgccacaaaaaagctgcctcaaatgaatacccgggcagctttttgttgatatgactccaatcagcggtgttgcggattgtaacgtttttccaaacgcaggaatatccagcctaagaaagtcgtcatcaacagataaatcagggcgacggtgtaaagcggttcttcataaaccgaataccggcccgtaatcgtattctgaacatacgccaactccgccacagcaatgaccgacagcagcgagctgtctttcaagagcgtgatgaactcgctcgccaaaggcggcagcatgcggcgcaatgcctgcggcagaatcacatagcgcatcgcctgcggataggtcagccccaaagaacgcgccgcctccatctgtcctttgtctatagactggatgcccgcgcggaaaatctcacagatatacgcccccgagttggcgatcagtgccaaagaaccggcaatcagcggcccgtatccgcgacgcagcgcgattgccgcctcgccgctgaccaaaatgccgtctgaaggatggacgaaaaacggaaaccacacatacgcccaaatcacaatctgcacaaacagcggcgtaccccggaacagcgtaacatacagcagcgaaactttacgcaacgcccacgccagcacgcgcatcggcgcaccggctttttccaagtgaatcaggcgcgccaacgccaacaacagacccaataccgaaccgcccgccgttgccacgaccgtcagccccaaggtcgtcagtgcgccgtaaagaaacatccagcggtattcgtaaataatgtcaaaacgaaaatccataaaccgtccgtatcaaaaaccggcggaactgccgccgttgcaaaataatccgccattttaccgtaaaaaccgccgcctgaacttttttatcgcggcagacggcggttgcgcgtctccgcaaaaatgcagggcgcgcggttttcagacggcatttgccgttcaaagccgtgcggtgtctttaccaaatgcccaaccattcgcccacggcatccatccaatccttattgcccccgccgctcctgcctgctcggcggtacgcccacggcgcttgcggatttttagctttccacaatcctttgcgttccctttccgcctgaatttgagcgtcggcataatcggcaaaatccgccttatcctgctgttctttagcataacttttataatgccacgccgccccgtcctgcacctgcatcaggttcaaatcggttttgccgacagaaacctgcgccacttcgcgctggtagcggtcggtatcgaacacgcgcacgctgactttcctgccttccgccgccgcgcgcaggttgtcgcgcgaacgcgtgccgtaagcctgtttcatctccggcgcgtcgatatacgccatccggattttgtgtttcgcgccgtcgccgtcgataacgtgaagggtgtcgccgtcatagactttggacaccgtgcctgtgtagcggtggccggatttcgccgatgctcggcggcgggcgggcgcgtcggaacccgcgtcccctgccgcgccgagtacgtcgagtacggcaaccgccgtccgcaccgcctcgctgccgtaccccgtataacccaacgcacccaaaagcgacagggcgacgggaagccatttcatgatttttttaatctgcatatttttcaaatgccgatgccgtctgaacatatcggaatcggatttcagacggcatcttaacgtcaggattacccttggcagggatagatgactttcgcaccctcttccgtccccaaaatcaacacatcggcggcatcgcgggcgaatatgccgttttcgagcacgccggtgattttgttgatttcgtcttccatcgtcagcggctgatcgatattcaagccgtggacatcgacgatttggttgccgtaaaacgtggtgtagccgatacgcagttcgggctgtccgcccatagcgagcagtttgcgcgaaacaagagagcgcgcgctttcgacgacttccacaggcagagggaatttgcccaaacgtgaaacatatttgctttcatccgcaatgcagatgaatttttcggacgcgctggcgacgattttttcgttgaggtgcgcgccgccaccgcctttaatcatttgcagggcgtggttcacttcatccgcaccgtcgatatagaccgccaaccccgatacttcgttcaaagaaacgacgggaatatcgtactgggcaagcagttcgccggattttttggaagtagataccgcgcctttgatttttttgccgctcttacccaaggcttcgatgaaaaagttgatggtcgagccggtaccgatgccgatatattcattttcgggtacgaattcgactgctttttcggcggcgatgcgcttgagttcgtcttgtgtcgtcatatttttgtcctttgggaaaccgtatcaacaaacagccgccatcttaacatttttttgcacgtcctgcccgccgcgttcaaatgcgtaccagcaataccgccgcctgcgcctctatgccttccatccgcccgagatagccgagtttttcgttggttttgcctttgatgttgacgcacgaaatgtctatgcccaaatcggcggcgatgttggcacgcatttgcggaatgtgcggcgcgagtttgggtttctgtgcaatcacggtcgtatcgacattgaccgcctgccaaccctgcgcctgaacgctttgatacgccgcacgcaaaaggacgcggctgtccgcatctttgaactctgcggcggtgtcggggaaatggctgccgatatcgcccaaacctgccgcaccgagcagcgcgtcggtaacggcgtgcagcagcgcatcggcatcggagtgtccgagcagccctttttcaaatgggatttcaactccgccaagtatcagctttctgccttcggtcagttggtggacatcgtagccctgtccgatacggatgttcgtcatcgtttgtgttcctgatgttttgaattgaagttcagacggcatcgagcagcagcctgacgatgtatgcgtcctgcggctgcgtcagtttcaaattgcgcacgtcgccctgtatcagtagcggacgcacacccaatttttccacggcggacgcttcatcggtaatgccgtccaagttttccgcagccaatgcgcggtgcagcagcccggcgcggaaaagctgcggcgtttgcgcctgccaaaggctcgtccgctcgacggttgcactaatgttcccaccgtccgcgcacttgagcgtatcggcaatgggaattgccaaaatcccgccttcggcggcgttgcccgcctgttctatcaaccgcgtcaaagcttcagacggcaggcagcaacgcgcggcatcgtgtaccagaatattgtcggtttccgccgccaaaccggtttccaacagttttgccacaccgttgcggacggtttcggcgcgggtctgtccgccgtttttccacacccgaacctgtggaaatgccgtctgaaccttatcggcaaacgtgtcttcgggcgagacgacaacgacggtcaaatcgacggcctcatgccgttcaaaaatcccaatcgtatgttctaaaacggttttgcttccgatttcgacatattgcttgggtttgtccgcaccgaaacgcgccccgatgccggcggcgggaatcagcgcgatatttttgcgcttcatgcgtccgtcccgccgttttcagacggcacggcttccttgcgccagatacaggcttcgcccaagccgtccaaatattgcccgtgcgccgccaactcgttttcgtccgccctgatgactttcagtttgccgctgcgtttggtttcggtatgcaccacgggtttggtttccattttttcctctgcggccgcacccatcaggtcgaactgccgccgcgtcatagcaagatagacttcgcccaaaagttcgcagtcgatcaatgcgccgtgcaggacgcgcttgctgcggtcgacggaaaaacggttgcacaaggcatccaggctggctttctgcccggggaacatttcgcgcgccatcgccagggtatcggtaacggtacagccgagttcctcaacggtcggcaaccccatccggcggaactccatattgaggaagcccacgtcgaatttggcattgtggataatcagttccgcaccgcgcaggaaatcggcaatctgcctgccgacctctgcaaacggcggcgcgtttttcccttccaaaacctgtatcgtcaagccgtggacgcgtgccgcctcttcgggcatatcgcgctcggggtggacatagaggtgcaggtttttgtcggtcatttggcggttgaccatttccaaaccggcaaactcgaccaagcggtcgccgccgtcggcatacagaccggtggtttcggtatcgaggatgatttggcgtgtcgtcatatcggtgtctttcttctatcttcgtaaattgcttattttttaagcaatgtatttttctgttttcatttcaatgcacaaacccacttattcacagtgtgttcacaacattgggcaggcggattgtgtattttggggacaattttttcagacggcattcaaggttttttcctgattgccgccgcgcctaaaaaccgcctttcgcgcttaatcaaaaataccgacaacggaatattgcccaaagcgacaatcagatacaacaaggaaatgctgtcaaacaaaaacagcaacaccgcgctcaaaacggcagcggaaaccataaaaataccgttaacgatattgttggcggcaacggcgcgggcgcggaaagtctcgctactggcggtttgcagccaggtatagagcggaacggagaaaaatccgccgaaaaagccgatcagcgtcatcaccgccatcacgggatatgcccatccttgcgataaaaaccaaaaaatgccgttcagcccttcaaaacggtgtccgtgcgtcagccacaccaaaaccaagccgcaaaccgtcaaacccaacgcaccaaccgttacccaagccaacatcaggcgttccctgctgaacttggcacacagtaccgaaccggcggcaataccgatggaaaacagagcaagcatcaggttgaaaacattgtcgttgccgcccagatggatttgggtaaaggtcggcagttgcgtggtataaaccgcgccgacaaaccaaaaccacgaaataccgataatggcggtaaaaacgggcttgtgccgcaccgtttcacgcagcagggattttgtgccacggacaatattccactcaatttgtgtatcggcagccttggcgggtacggacggcataaacaggctgccgaccgtgcctccgacggcgaccagcaaaaccagtatcccgacaatataaggcggtacacctgccaccgccgttcccaaaatctgaccgaacaggatggcgacaaacgtacccgattcaatcaggctgttgcccatcatcaactctttgtcgtcgagataatcgggcaggatggcgtatttcagcggcccgaacagcgtcgattgcgcgcccatgcaaaacagacacgccaaaagcagcggggcagaccggatataaaacccgtatgccgccaccgccataatgatcatttccagcaccttgacccaacgcgccaaaacggccttgtcgaatttgttacccaactgccccgacagcgaggaaaacaggaaatacggcaaaataaacagcaacgcgcccaagttcaacatctgtccggcaggcaggaagccgttttgccccaaaccgtaaaacccaatcatcacaaacagcgcggttttgaacacattgtcgttgaacgcgccgagaaactgcgtagcgaaaagaggtgcgaaacggcggcttttaaccagtcccaaaccgccttttttagcgtacatcgttttccctctctttttcaatcagtttacttgtcgaatcatcatccatcaggatgcggtgcgccggcccttccaagtcgtcaaactgcccgtttttgcccgaccaccaaaaaaaccagccgatgacaaacgccaaaataatgctgatgggcaccaatataaacatgctttccatcacatattccctgtcaaatcgttcaaaacaaaagtctgccccgacacggtcagatattcgttacgcaaagttccgacgggagcttcgtcaaaaaacagctcgatacggtctttgaccacgcgccaatattgggggatttccgtctgaccgaacggcgacaggacatgattttccattccgccttcaagtttgacggcaaaacgcccgctttgcggccgtgcttccgattcgtcgtcggcaagcaggatgaaaaagcctatatgccgtcccgattggtcatgaatactgaaataatgcataaatttcccacccgccttttttcagacgacaccaactaaaaacagggcgaatgtaccagtttggacgggaagaatgcaaagaaattctccctcccccagccgaaaacaccggcaaaccgcatatcccccttttttccgtcaaaatgcctgacttccgccattttcacgcaaacgcccgattaagccaagcaattgcaaagattttttgctagaatagcctgcttcttttatcaaccttttcagacggccccactactttcccgcccaggaaggcaaaacggattcggcacgaatccggttagtatccgtgtccgattccaatgccgtctgaaactttccggagtaagaaaatgtcccaaaaattgatcttggttttgaactgcggcagctcgtccctcaaaggcgcggtcctggataacggcagcggcgaagtcctgctcagctgccttgccgaaaaactcaacctgcccgatgcctacatcacattcaaagtaaacggcgaaaaacacaaagtcgatctgtccgcacatcccgaccacaccggcgcggtcgaagccctgatggaagaactcaaagcccacggcctcgacagccgcatcggcgccatcggccaccgcgtcgtcagcggcggcgaactgtacagcgaatccatcctcgttgacgacgaagtcattgccggcatcgaaaaatgcatcccgctcgcccccctgcacaaccccgcccacctcttgggcctgcgtgccgcgcaaagcattttcaaaggcctgcccaacgtcgtcgtattcgatacctccttccaccaaaccatgcccgaagtcgcctacaaatacgccgttccgcaggagttgtatgaaaaatacggcctgcgccgttacggcgcgcacggtaccagctaccgcttcgtcgccgacgaaaccgcgcgcttcctcggcaaagacaaaaaagacctgcgtatggtcattgcccacttgggcaacggcgcgtccattaccgccgtcgccaacggcgaatcgcgcgacaccagtatgggcctgaccccgctggaagggctggtaatgggtacgcgcagcggcgacatcgatccttccgtattcggcttcctcgccgaaaacgccaatatgaccatcgcccaaatcactgaaatgctgaacaaaaaatccggtctgctcggcatttccggcctgtccaacgactgccgcaccattgaagaagaagccgccaaggggcataaaggcgcgaaattggccttggatatgtttatctaccgccttgccaaatacatcggcagtatggcggttgccgcaggcggtttggacgcactggtctttaccggcggcatcggcgaaaactccgacatcatccgcgaacgcgtgatcggctacttgggcttcctcggtctgaacatcgaccaagaagccaacctgaaagcccgcttcggcaacgccggcgtgattaccactgccgacagcaaagccgttgccgtggtcattccgaccaacgaagagctgatgattgcccacgacactgcccgtttgagcggtctgtaaggttttatccgcacacgaactgcctccggaaatggaggcagtttttttatccggctttccatgcttaaacagcactgcctcttttcagacattgacggttgcagccgcttacctgaaccttatagtggattaaatttaaatcagtacggcgttgcctcgccttgccgtactatctgtactgtctgcggcttcgtcgccttgtcctgatttaaatttaatccactataatgattaactattttttaatcatgttattattttccataaaatacatgacattaagatgtttttccacaaaagatacacacaccggcaaacaccggctgtgtttatcttttcttatgcctattttttaatcatcgtatttttatcttttaatttcaatacgcaaactaacttatacacacggttttcacatctttagactgcttccgtgtgtatagtggatattgccgttttcctttctgacaaaaatgccgtctgagaacttcagacggcatttgaaacatcggaatcagcggttttgttcataccactcgataaacttgtctgctttgacaaaacccagcagcggctcgctgcggctgccgtcggagcggacgacaaacacgcccggcggcccgaacagaccgtattctttcaacaacgcctgatgttcgggcgtgttggcggttacgtcgatttggaaaaagcgttccatatcgactgcctgatgcacttccggctgattgagcgtgtaagccgccatttctttgcaggaaatgcaccagtcggcataaaaatccaaaacgacgggtttgtcgggatgttctttcaacgccgtatccatcgctgccttcagcgcggcagtatcggcaaacattttgccgtgttccgaagatttgcctgcttcggctggtggattgagggtcaggaaatggtgcagcgcggtcgttttgccgtttgcgccctgccagccgaaccacgcgccgcctatcagcaatataccgcccaatgcgaatgccacagctttcggacggcgtttctgcctgcgtccgttgaccagcagcataaaggcaggaaccagcatcagcagcgtgtacagcgcgacgacgagataatagggcaagtgcggcgtggcgaggtaaacggcgacggctagcaggatgaagccgaatgcgtatttgacggcattcatccaatcgcctgccttaggcaggatatgcccgccgaacgtgccgatggcaatcagcggaacgccggtgcccaacgccaaagtgtaaagtgccaaaccgcctaaaaccgcatcgcccgtctgaccgatgtagcccaaagcaaatgccagcggcggggcgacgcacggcccgacaatcagcgcggacaatatgcccataataaagacggaaacgattttaccgcctgaaagcctgctgctttgattctgaaaatacgactgcacggcgttgggaagctggatgttgaacagcccgaacatagacagtgccaagacgaccattaaagccgatgccgccaataccacccaagcctgctgcaaccatacggtcagcagtgcgcccgtcagtccggcaacaatgccgaccagcgtataagtcagagccaaaccctgaacataaacgacggacagcacaaacgcccgcgccttgcccgcctttttgtcgccgaccacaatactggaaacaatcggcaacaggggatacatacaggcggtaaaactcaggcccaaaccagcgagaaaaaacgccaaaagattggcgttgagcgtatcccaagacagcttgaaacggctgtcgccgccctcatcccccttcgggggcggcagcgccccgctgccgttttgagaggaaggctgcaaaaagcggtctttggcggatgccggttcgtcggtttgcggatggtaagtgccgttgccgaaaatatcaaactcggtatccacgggcggatagcacacgccggcttcggcacagccctgataggtcaaaaccaatttatacggttcgccgacagcctttgcataaggaaaggcaacctgcgcctcgtgatggtaaaccgtctgcctgccgaaaaactcgtcttccttctcttcgcccttgctgaaagaaggctgtcccaacaaatccgccggatcggtcttgccgacgattttcgcctgatacatatagtatccgtcggcaatcctgaaacggacgttcacaccgtcgtcggcaacggcaagctccggcacgaatgccttttccggcggcagcagatcgttcgcatccagcgcgaaagctcgtccgcacaacatcaaaaatacggcgaacaggcaaatcagttttttcataatcgaatccgtttcagacaaataatttgtctgcattataaatggtaaggttgacggtgggatttaatttatgtaaaacccgccattatccgaacctatttccataaacatcttatcgaacccgccatgtacgatgtcaatacccacgatgtccgccgctttttcgcccgcgtgtggcagcagcggctcaatccgctgcaactgagcgcactggaacagaaagccctccgcattgtcgaagcccatcccgaataccaccgttatctcgaacgcatcgaagaccatctggacaccgactggctgcccgaaaacggcgaaagcaaccccttcctgcatatgtcgctgcatctgtccgtccaagaacaggcgggcatagaccagccgcacggcatacgcgcaatccacgacaccctgtgcgccaaacgcggctggctggaagccgaacacgaaatgatggaggcactggcggaaacactgtggacggcgcaacgctacggcaccggtttggatgtcaatttctacatgacccgactgcgcaaactcatcggcttgggtgcagaagatcaagccagattgaacccgcatgaaatcgcctgaccataccaaccgcctgcaaaatgccgtctgaagcggaacaacccctttcagacggcattcattttcccccaatcatttccacaacgcctttttcagcataatcaaccaatccttcttatccaaaacggggcgttgtgcaaacacatcgtatcggcacgcgtccagtttctgcaaaatcaactgcgcccccaacacaatcatacggagttccaaaccgatacgcccattcagttcccttgccaaaggcgaacccgccttcagcatacggaacgcacgccgacactcatacgccatcagccgctgaaacgccgcatccgcccgtcctgccgcgatctgttcctcagaaacaccgaatttcaacaaatcgtcctgcggaatataaaccctgcctttttgccaatccacagccacatcctgccaaaaattcaccagttgcaaagccgtacagatgccgtcgctttgcgccacgcacaccgcatccgttttcccgtacaaagccagcataatgcgtccgacagggttggcggaacgccgacaataatcggccagctcgccgaaatttccataccttgttttaaccacatcctgagaaaatgcagaaagcaaatcataaaacggctgcaaatccaaaccgaacggcacaaccgcctcggcatccaatcgtgcaatcaaaggatgcgccgaccggccgcccgatgccaacacgtccaactcgcgctgcaaaccctccaaccccgccaacctggcttcagacggcatactgccctcgtccgccatatcgtccgccgtccgtgcaaacgcgtacaccgcgtgaaccggcttcctcaacctgcgcggcaaaatcagcgaaccgacgggaaaattctcataatgcccaaccgacataccttctccatccatcaaacaaaatgccgtctgaaacggaacaaacccttttcagacggcatcagatacctccaagctgccggcaatcagtggtggtgatgaccgtgcgggccgtggacatgaccgtgtgcgatttcctcatcggatgcatcgcgcacgctttcaactgtagccttaaagcggattttcatgcctgccaaaggatggttgccgtccaccaccgccttgccgtcggcaacatcggttacacgatagacgacaacatcgccggtttcaggatcgtcggcttcaaacatcatgccgacttcgacttcaacagggaacacgcccgcatcttcgatacggaccaactccggatcctgctcgccgaacgcatcgtcgggcgacagcgccacatcgaccgtatcgccggcatccttaccgtgcaacgcctcttccaccaaagggaaaatgccgtcgtaaccgccgtgcagatacgcaatcggttcttcggttttgtccaaaagctgattgttggcatcatacatctcataatgcagcgaaaccacggaatttttcacgatagccatatttgtcctttcaggaacagcagattaattacaggcgcattctaacacaaccgccgcgccggccgattaccgttaacctgttcataaactgtacagcacatatttcaatgtaaatctttgttattttattgcggtgtaacttttttacaacattcttaaaaccattccgacctgtctgccgactttcccaatccgccttaataaatcatacaagatactgaaattatattaatctctataatatttatccctatcgaatttttaacagcaaaaccgttttacaggatttatcaatccgcccgccagaaaacttttcattcaaacctttttcccatctgtacgacattgcaatcccttattccatagtgcataattacgcaaattcagcgatgaatttccaacccggtttgtagtatggtcgataaagacctatttgtttcaataatttaaattggttctaaaggttactaaaatgaaaaaatccctgtttgccgctgctttgttgtctttggttctggcagcctgcggcggtgaaaaagccgctgaagctcccgctgctgaagcacctgccgccgaagctcccgctactgaagcacctgccgccgaagctcccgctgctgaagcacctgccgccgaagctcctgctgctgaagctgccgctaccgaagcacctgccgctgaagctgccgctaccgaagcacctgccgctgaagctgccgctaccgaagcacctgccgctgaagctcctgctgccgaagctgcaaaataagcattttccgcttgcaaaaaagcaggatacgttcagtatcctgcttttttgatttttcagacggcatcagattcccttcctcaatcttctccctacccttccgacaaacatgcttgaccttcataccgaattttcccgactcctaccggcagatgaaattgccgaaccttctccgacgcttttaaaagaccagcgcaaccgctttacgtctgcaccagacatcattttgcagccgctcagcgttaaaagcgtgcaaaccattatgcgtttctgccaccaacaccgtattccggttacgccgcaaggcggcaatactggtttgtgcggcgcggcagtatcggaaaacggcgtattgctgaacctttccaaactcaaccgcatccgcagcatcaatttgtcagacaactgcataaccgtcgaagcaggttccgtactccaaaccgtccaacaggcagccgaagcctcaaacaggctgttcccactcagtctcgccagcgaaggctcgtgccaaatcggcggcaacatcgcctgcaatgccggaggtttgaacgtattgcgttacggcacgatgcgcgacctggttatcggtttggaagtcgtcctccccaacggcgaactggtttcccatctccatcccctgcataaaaacaccaccggctacgacctgcgccatctgtttatcggtagcgaaggtacattgggcattatcactgccgccacgctcaagctgtttgccaaccccttagacaaagcaaccgcatgggtcggcatacccgacatcgaatccgccgtccgcctgctgaccgaaacccaagcacactttgccgaacgcctatgcagttttgagctgatcggccgttttgccgccgaattgtcttccgaattcagcaaactccccctgccgacacattcagaatggcatattttacttgagttgaccgactcattacccgacagcaatcttgatgatcggcttgtcgaatttctttataaaaaaggctttaccgacagcgtgttggcgcaaagcgaacaagaacgtatccatatgtgggcgttgcgcgaaaacatctccgcatcgcaacgcaaactgggcaccagcatcaaacacgatattgccgttcctatcgggcgcgttgccgactttgtccgccggtgcgccaaagatttggaacagaatttcaaaggcatacaaatcgtctgcttcggacatctgggcgacggcagcctgcactacaatactttcctgcccgaaatcctcagcaatgaagtctatcgttacgaaaacgacatcaacagcacagtctatcgcaacgtccttgcctgcaacggcacgattgccgccgaacacggcataggtatcatcaaaaaacagtggctggacaaagtacgcacgcctgccgaaatcgccctgatgaaaagcatcaaacaacaccttgatccatataacattatgaatccgggcaaactgcttccgtaaccggcatttctgatttgcatacacaacaaagaaagggacaatagatccgattgtcggtttagcgcgagctcgtgagtgcggttaaaaattggtggaaattacacgaaaaatgaccgcacttttaaaataaaaaaatcggcagtgaatttccctgccgattttattttgttacaacttaacttaaaacgtccactgtaaattcaacgcaccttgtttagcttgatgatgtttgcctgtttggcggttgaatgtggcttgtaaggttaagtgagatttgattttcactgctacacctaattggctctcaattgccgtcttattgtttatcactcgacgctctccgtccatttccacaccgaaaggtttgttgtggtaaagcgcgttcacagcggcgaaaggttcaatagcgatatttttatagagtgaaaattgagctttagcttgaacgccaacccgagtttgtaattggcgggagccaagtaaattcacgtgggcattttcgctatcgctgaattttccgtttacccccaaataagtcaattgtgcctgtggttgtaggtaaacacgaaggctgttgccctttttagtgaagtgttccgccaataacgcattgtaacctgcttcaattgaggcagtaataccttttgaagtaaaacgttctgtaccatcttcagtgttgatacggtggcggaagcgttgatattgcatccagctatccgcatacgcacctgtctgtttgtcctgaagttggtgccaagtggcgtaaacgcctgcaccaaagcctttcacatttcccgttgtaagattgtctgtatctgggttgtggaaagtgctacgttgttctgcttgtccgcccattaagccaatagaaagttgattactttcgttttgccatgtgaatacttcgccgccgagttgcacacctttacgatagccttctacaggtgctgttttgccttgcacccattggttggaatgtccgtcaatcacacgcaaccacaagcctttgcgtggtaaagtgcggtcgaaaatatcgctgtttttgttgttcaaacgcaaggcgaataaggtattggcggcttgagcctgttgtgcataaatcgccatatcatcgcgttcttgcactttggtaaaaaagccctctgggcgttgttgtaaagaaagcgtataaattcccttttggtgtttgccagaaagacggaatgcgtgtttatctgctgtgccatttactttgataatttgatgcccatcgaggctttttaaatcgtctattggattttcgaagatgatgtcggaagtgccagtaacatttttctcaaaaattaatgcagtatttttcgcttctttaggatcgtaagcaaaacgaaaacgagctccgccagcataatcttcttttacgagtaaactttcacttttagtattaaaacggatgtctgcattcgttgtttttaatttcccaacattagaatcccaacggggctcccagagagaattttctaagcggaattcatccaaactaatcgtttgcccgataacgtgcgagttgtctgtaacctcaatatagtggaatggatctaaaccagaatatagatgtgctgcaaaagaaacataattttcaatatgatgaattacttgattagcccattctgtataattcccgacagataaaatttcgctgttgatatgactattttttatttttggacctaaggagaatatatgactttttactataagaggatgggatccaaatttttcagcttggcaagtactataatcacgtatcttagtgttagaattaaaacattccttaaaatatttccgtatttgttcttctgtgtccccatttctttttgcaacccctaaacctcgggcgaagccaactaggtaaccttcggtatattcttgatcataaaaagaaatcttttttgagttattgatgttttcgaattggtatgttctagggtatagtgcgggaaagggtggaacttttggattatcctcggttataagataagtttcttttttccaatattcactcgttttatcgcggagtttttttaagcgggtaatttcatcattagtgagcttggttttgtcgtaaacgtaatcaacagccaaaagcggagaggtataaagaatagaaaaaaatagacttacaataaatgattttttaaacttctgcttgcttgcttgcttgcttcgagtttcataataaattttcctttgtcaagtaaaaataaatggggcgtggattttagcataaaactgaacaaaaaatgtcatttatctcacatttttctctatttatttcttgtttattaaaagtaaacgtttgctttttgctattttgtcaagccagtttgaaaatgtgtataattgccctcgttatttacaaaaatttcaggaaaaatgaccgcactttacccttggctaatgccaatttatcatcaaattgctcaaacctttgacgaaagcttggggcatcatgccgtgctgattaaagcggatgctggtttaggtgtagaacgtttacacatcaggcggcagccttgcccataccgtctgaagcactgtttccacaatcagcgcgtatgcttaatcaaccgctgtttctcgcgtttccaatccgcctctttcatactctggcgtttgtcgtgctgtttcttaccttttgccaaaccgatttccatcttgatttttccgcgtgaaaaatgcaaatccagcggcacgatggtgtagccggcacgttcggttttgccgattaatttgttgatttccgactggttcaacaagagcttgcgcggacgtacggcatctggtttaatgtgtgtcgaggctgtgggcaaagccgtaatatggcagccgaccagataaaacgcgtcttttttccaatagatataactctctttaagctgtacgcgcgcggcgcggattgctttgacttcccagccttccaagaccaaaccggcttcaatccggtcttcaatgaaaaaatcgtgaaatgcttttttattgttcgcaatagccataaacatcctatcaatatccgccgtcagacggcataaacccgaaaacagaacccatcataccgcctcttcaaccgcctgcacaatcttctcgggatacagcctgttgaggcagtcggtatgccccagcggacattcccgcttaaaacacggcgaacattccaagtgcaggctgacgattttcgccctatcgctcaaaggcggcgtatgcgtcgggctggaagaaccgtaaaccgccaccaccttcctgcccaaagctgccgccaaatgcatcaatccgctgtcgttacacacgaccgtgtccgccaacgacagcaaatccattgcctgcgacaaatcggttttgccgcacaaattgacacacataccgtctgaaaggcggttgatttcctcggcaatttcatcatctttttgcgaaccgaacagccaaacctgccaacccgccgccagataatgtttgcccaactcggcaaaatgccttgtcggccaacgctttgccggcccgaattccgcacccggacaaaaagccagaacaggctttccaatatccaagccaaaggtttcgacagaaatttcccgccgccgttcatcaatggaaaactcggggaatcccgaatgcccgtcaaaatcttcctgactcggatgcgcgagagccgtatatcgatccaccatcaaaggcagacgttccttatccagcctgcgtatatcgttcaacagaaaataacggctttcaccgacataacccgtccttttaccgatacctgtcgccagcgcgatgattgccgatttcaaagaaccgggcaacacgataacctgatcgtatccgcgccgccccaaatccctaccgacccgccaacggcgtttcaactccaacgcaccatgtccgaacgaattctcaagaatttcattcacttccggcatacgctcgaacaccgccatcgaccacttcggtgcgaacacatcaatcgtgcaaccggggtgaagttccttcaaacggcggaacaagggctgggtcatcacgcagtcgcctatccaactgggggaaataatcaggattttgatggacataacaagaaaccgaaatcagacaggcagaattttaccgcgaaaccgttggaaaacctatcttgccgcattccgaacgccggacgtgcaaatatgaaaaagcccgaacattcaagttcgggcttcaaaattctggctccccgacctgggctcgaaccagggacctgcggattaacagtccgtcgctctaccgactgagctatcggggaatggggcgtattatagcgtccggaaaaaatgtgtcaatccttaattttggaaaaatgggcgacaaaacgacaagcatatgaatcagaaagacattaagaccgatgccttaaaaggattgccgttgtatgaatttccacagccgtcatcacaccatatttaagcccgatgagccgttctgccctccccccgcttaaaacaatgccgtctgaacttcgccgtgttccaaagccagtaaaaactgtttgcggttcaacccgcccgcgtagccggtcagtttgccgtcgctgccgatgacgcggtggcagggaatcaggatagatactttgttctgcccgttggcggcggcaacggcgcggacggctttggggttgcccaaacgctgcgcctgctccttgtagctgcgcgtttcgccgtaaggaatcgccaagagcgcgtcccatgcctgcttttgaaactcggtgccaatctgctccaaaggcgtggcaaaggttttcagacgacccttgaagtataagtccaattcctgccgcaaaagttgcgtccgctcatcctcccgaaacacaaaccgtccgcgcaaggctttttggacggcggcaatttcctgttccaaatgcttctgtccgacaaattccagcaaacacaaacccctgctaccgaacaccgccagcatctcgcccaaaggcgtggcaatggcggcacacaccagctcgttcaaactgtcgggataacgcgcttccaacagacggatggcgcggcggatgcggacatattcttcaggcgcgcagccgatattgtcccaaaaatcccgctcgaactgtttggcttcgcattccgtcagattgggatgcggcataacgccgcactcaaaaacccgagattcgagccaatggcggatttcatcccattttgacggcagattgtttaaggaaggcagggtaatcatttgtttgctccgtatccctatcatagatttgacggcaaaatccccaatttttgccattcccgcacgccggagcaggaacgggctatgacgtaaatcttgagggttaggttgcggcaatacctaaatattcgatatttctaaagcatcagagaaaggaatgtttcaacacacaggacgacacataaagcgccgccccatgaaaaatttcagacgacctgcaaagggtcgtctgaaaccacgatttttgcatttgcgcattctggcacatcatccaaccgtttcggcacattcctgccgccgttgacagcctataatgaatccacttattcatcaagcaaaggaatcatctatgcaaaccctcatcctctccgccgtactgctggctttttcaaccgctgcctttgccgggggcgcattcacgctgcaattcgacaacccgtccgaagacggcggcttcacgcaaaaccagcttttgagcgcgccttacggcttttgctgttcaggcgacaatgcttcgcccgcgctgtcgtggaaaaatccgcccgccgggacaaaagtttcgtcctgaccgtttacgataaagacgcgccgaccggactgggctggatgcaccgggtggtcgccgacattcccgccgatgtccaccgccgcaacgcgacctcgctgcaattaagccgctgcgccaacatcgccgaccggactgggctggatgcactgggtggtcgccgacattcccgccgatgtccgccgccgcaacgcggcctcgctgcaattaagccgctgcgccaacatcgccgacgaccagtccgcagccatatcggcggtaatcagtttgcggatttgccgcatcaggttgacgccttcgtacacggcaaaaccgatgccgtcatgctgcaaccacgccaacacgccgcaaagcgcggcctccgcagcattgtgcggcacttcttcatccgccagtaccgcagcctcataatcaaacgccgcgcccatacgcccggaatacggcagctttaccgcatcgcacactgcctgcgccgtcccgtattgtgcggcgaacctttctacggtttcctgttcgaaagcaatccattgcgcctgatagaggccgtctgaatcgggaatattgatgacgtcaaacgtctgtccgcctgccaaggcgaccgccttacccgccgcagcttcttacttccgcgccgcacgataagcacagccggttcatataccgccacgctgcggtacaaggcggtatgatgttgcacgatgccgcctaaagcacccaatcgttcgcgcgtatgaaagtatagtggattaaatttaaatcaggacaaggcgacgaagccgcagacagtacaaatcgtacggcaaggcaaggcaacgccgtactggtttaaatttaatccactatatctcaaacccacgttaggtctaagcaaatggtcggacatccttatccgacagcccatcttcttttcagacggcattgcaaatttaagtttgacgtgcgttcaaaataaggcagttaatgcgaagcgaaattccgtcggcgtacctgcaacttggcccctcccctataggggagggtcggagggagggtaaaacggggcagatacagacaatatttccgttgccgccccgatgccctctccctaaccctctcccacgggagagggaatggattgccgttgaaataaatcgctctacataaaaaatcaatgtgttatctcaaacccacattaggtctaatcaaatggtcggatatccatattcggcaagcaagctgctttcagacggcatttccagccaacaagcgcgccaatatcccctcatacaccgcagacagcttcggaatgtcgtttagccgcacgttttcgttgatttggtggatggtcgcattggacgggcctaattcgataagttcttgcgcaatggctttgatgaagcgtccgtccgaagtgccgccggtggtggacaattcggcctcaatgccgcaggtttcggcaatggctgcgcgtgccacgtcggtcagtttgcccgcttgggtcagaaagggctgccccgaacacgaccactgcaaatcgtattgcacgccgtgtttgtccaaaatggcgtggacgcgttgtttcagccctgcttcggtggactcggtggagaagcggaaattgaatttgacgttcagctcgcccggaatgacgttggtcgcgcctgtgccgccgttgatattggaaatttgaaagctggttggcgggaaatattcgttgccttcatcccagacttcctgcgtcagctctaacaaggccggggcaaaagtatgcacgggattgattgccaaatgcggataggcaatatggccttgcttgcctttgacggtcaggttgcccgacagcgagccgcgccgaccgtttttaatcatatcgcccaatttgtccacggcggtcggttcgccgacgatgcagtagtcgataagctcgtcgcgcgctttcaatacatcgacgactttggtcgtgccgtccaacgcgtcgccctcttcgtcggaagtaatcagaagcgcaatgctgccttggtggttgggatgtttggcaacgaagcgttcgcaggcggtaacgaaacaggcaatgctggttttcatgtctgccgcgccgcgcccgtataatcttccgtcgcgctcggccggttcgaacgggggcgaatcccatttttcgacaggacctgtcggtacaacgtcggtatgccctgcaaaacagacgacgggagctttcgtgccgcgtcgcaaccagatgtttttggtgtcgccgaaatggagttcttcagccgcaaaaccgattttgtgcaggcgttcggcaaggagtttttggcaatccctgtcgtcaggggtaacggatggtcgggaaatcagctctttggcaagctctagggattgagtttcggtcatatttgttcacttttgaaattagaccgtctgaaacgttctgaatgtgattttcagacggcatttaggttaggttggcatacggggtgggtattttacccatcagtcttctgaatcatttgccgtggcaggcttcgtaaagcggcagcaaatcttccaccgtttccgctatccatttcgcgacatcctgcctgcccaaatcgtcgcgttcgatgtgtttgccgatgcagaaaaagtcttcgtcgttttgcaactttcggtcggactcgttttgttgcgcgacggtgcggtagtcgtcgtattcgctttccgcaccgtgccacatatcgaaagaagcgtatttttcggtatcaaaattatccaaccagcggttgtaatcaggcagcgcgatgggggaaacatcggctttatagcagtgccaatccaagctgacgctcagacggcggcggttgagcagtatcgacaaaatcgctgcggaatttttatattgttcgtatttgaagtaggcaaagaaatgggcgcgaacctgccagccgttacaccagcgttcgatgtgcggcggcgcaaacggcgcacccaattcggcggcaacctgctgaatcagctgctgccatatctgccagttttctttatagtcagccttgatttgcggaatgctttcaggctggtattttttaagctgggaaaattggaaaaacgggatattgaacaaatcgcaacttttcggggtcagcataatatatccttgagacgattgtttcagacggcattatttgcgccggcgcgccgccataatttcgccgatttcggtcagtttttcttttgggataaaggtgttgcccatatcaaacagcggctcttcaatcgccaaatgaacatcatatcccgccacaaaacgtttgaacgcttcctcatcggggacataagcgttgtctgcttcgagtttggcaaattcggcggaaacagccgcccagttgtcgtgcagcccgatatgttggcgcaaaagctcgtccacgctttcttgggcttgcggcgcatattgcagcagcagcgggaagaagttttcttcttcgtcttcatggtgcagcggcgcggcaacgttgaaatactgggcgatttggcggatggtttgcaaaacaatctgattgcagccgttttcggcgatatagtccgacagcatggcgacttgtccgcaaaaacggcgcactttgccgtggcaggcatacagcatttcaatcggttcggcaaaggtaacgcttttggtttcaaacggattcatgttttcgttctcaacgggcacttttcaagcagtcattttataataaaacagcctgcacaaagcaggctgtccgtcttttgagactttaagcggattaatcgaccaaagtcactttgccgttcatcaaagcaccgtgacctgggaaggtacaagcgaatttatattcgccgtcggccaatttagcaggatccagagtcagggaagcttcttcgccgccgccgatcagtttggtatgggcaacaacgcgtgcatcatcaggtttgacatagtcggtatcggcagcacctacgccgtctttaaatacgccgtccatgtcttcagctttggcaatcacgagattgtgacccatgctggctttgggttgcgtaccggtatgtttcagagtgatggtgaactctttacatgctttgctgacttggatgtctttggtgttgaactgcatattgtcgttggattcgacagttgccgcacagttgccggcagcaggggcttcggcagcatctgcaggagcagcttcggcggcaggcgcttcggaagcgggtgcttcagcagcaggagttgcctcggcagcaggcgcggcaggttcttgagagcaggcagccaaaccgataacggcggcagaaatcagagccagatacgctttcataacaaatctccaatcgataaaataatattcggttttacagaaatcaaagtgcaaccgccattaacaaaaccttgaaaaagattccgccgcgttgcacaaacagatgtttcggagcggcattttgctacaaatttcatttgaaatcaaagcctgtttgcaagtttacaatcgtttacccaaaaaagggcaattttaccccgaacctatttctttagtattagacctattatcctttacttcttaatattaacggatgtttacacaaattcccgtatacattttatgcgccatgccttctaaccaagtttgccaatgcctccgccaattcgggatgccgtttttccaactttgccgccgccgaaccgaaactctccagcgcagccttactcaaatgcagggtattggttttcggcggtttttccggtttcgggaccagcctgaccgaaacagagcgtatcgaagcatcaagccctgccaactgcggcaataccgacggtgcaatcattttcaagcgcgatgccgccatattgtttgccgccaaaaggacaagcctgccgtcttcgatacatgccgtctgaaaatgcgggtgcaggttggcaggcagcagttttttcacggcggcatccaaccgccgccactgtcccgcctgtttcaaaagtccggaaagcagcgcgtcccgcctgcccaactgttccaaattcataaaacatacacccaaaaagattgaaataccgcaaacgcgcctttatttcagacggcattagcactttgcacaaacgcttgtgttaaaatcgcgttttcgcccactattatatcaggcgcaggaattattcatgctgacaaacattgccaagaaaatcttcggcagccgcaacgaccgcttgctgaaacaataccgtaaatccgttgccagaatcaacgcgctcgaagaacagatgcaagccctaagcgatgctgatctgcaagccaaaactgccgaattcaaacaacgcctcgccgacggtcagactttggacggcattttgcccgaagccttcgccgtctgccgcgaagcgtcccgccgcaccctcggtatgcgccacttcgacgtgcagcttatcggcggtatggtgctgcacgacggcaaaatcgccgaaatgcgtaccggcgaaggcaaaaccttggtcgccaccctcgccgtctatctcaacgcgctggccggcaaaggcgtacacgtcgttaccgtcaacgactacctcgcctcacgcgatgcgggcattatggagccgctctacaatttcctcggccttaccgtgggcgtgattatttcagatatgcagccgttcgaccgtcaaaacgcctatgccgccgatatcacctacggcaccaataatgaattcggcttcgactacctgcgcgacaatatggttaccgaccaatacgacaaagtgcagcgcgaattgaattttgccgttgtcgatgaagtggattccatcttgattgacgaagcgcgcactccgctgattatctccggtcaggcggatgacaacatccagttgtaccaaatcatgaacaccgttccgccccacctcgtccgtcaagagacagaagaaggcgaaggcgactattgggtcgacgaaaaggcacatcaggtcatcctgagcgaagcaggtcacgaacacgccgagcaaatcctgacccaaatgggattgctggcagaaaacgactccctctattccgccgccaatatcgccctgatgcaccaccttatggcggcattgcgcgcgcattccctcttccacaaagaccaacattacgtcatccaagacggcgaaatcgtcatcgtggacgaattcaccggccggctgatgtccggccgccgctggtcggagggtctgcatcaagccgtcgaagccaaagaaggcgtggaaatcaaacgcgaaaaccaaacgcttgcatctattaccttccaaaactatttccgcctgtacaccaagctctccggcatgaccggcacagccgataccgaagccttcgagttccaaagcatctacaacctcgaaaccgtcatcattccgaccaaccgccccgtacagcgcaaagacttcaacgaccagattttccgttccgccgaagaaaaattcgaagccgtcgttaaagacattgaggaatgccacaaacgcgggcagcccgtcctcgtcggcaccaccagcattgaaaactccgaactggtatccaagctgctgacccaagccggactgccgcacaacgtcctcaacgccaaagaacacgaacgcgaagccctgattgtcgcccaagccggcaaagtcggcgcgattaccgttgccaccaatatggcgggacgcggtacggacatcgttttaggcggcaacctgaagcaccaaaccgatgccatccgcgccgacgaaaccttgagcgacgaagagaaacaggcacaaatcgccgcactcgaagacggctggcaggcggaacacgacaaagtgatggaagcaggcggtttgcacatcatcggtacggaacgccacgaaagccgccgcatcgacaaccaattgcgcggacgttccggccgtcagggcgaccccggatccagccgcttctatctctcctttgaagacccattgctgcgcttattcgcactcgaccgcgccgccgccatcctcaaccgcctcgcccccgaacgcggcgtcgccatcgaacacaacctgctgacgcgccaaatcgaaggggcgcaacgcaaagtcgaaggcagaaacttcgatatgcgcaaacaggttttggaatacgacgacgttgccaacgaacagcgcaaagtcatttacagccagcgcaacgaaattctgaccagcaaagacatcagcgacctgatgcaggaaatccgttctgatgtcgtcagcgacctcgtggatacctatatgccgcccgacagcatggaagaacaatgggacatcccgactttggagaaccgtctggctgccgaattcagactgcacgaagacatccaatcctggctgaaggcggacaatgcgattgacggtcaagacatcaaagaacgcctgatcgaacgcatcgaaaacgaatatgccgccaaaaccgaactggtcggcaagcaggcaatggccgatttcgagcgcaacgtgatgttgcaggtcatcgacaaccaatggcgcgaacacctcgccgctatggactacctgcgacaaggcatacacctgcgcagctatgcccaaaaaaatccgaagcaggaatacaaacgtgaagcctttaccatgttccaagacctgtggaacggcatcaaattccatattgcctccctgcttacctcggttcaaatcgaacaaaaccctgtcgcggtggttgaagagcaacccatcggcaacatccagtccatccattccgaatcgcccgatatggaagaacttttgggtcagtcgcaaaccgatctggttaccgaagcctttaatcccgatgggacagatttcagccccgaagccttggaagcgcgggggcaaatcgtccaccgcaacgacccctgcccctgcggcagcggtttgaaatacaaacaatgccacggcaaactggcttaagcgtttgaacgcaaatgccgtctgaacatcccgctcccgtttcagacggcattttgcctgaaccgccacatccgactgccattccgaaaaatcccgatttcgtaccgtccgtaccaaaaacagacatcccgtccgccccacatcatgattccatccgacttcattgacgagcttttagccaaaaccgatattgtcgatattatcgacgagcaggttccgctgaaaaaaggcggggcgaactatatggcgtgttgcccgttccacaaggaaaaaacgccgtcgttttcggtcagtccaaccaagcagttttaccattgtttcagttgcggggcacacggctcagcgattggttttgtgatggaacatcagggactgtcgtttccggaggcggttcagttccttgccgaccgcgtgggtatggtcgtgccgaaagtgcacgggcaaaacgataatcccgaagtccgtgccgaacgtaagaaaaaacagcagacactggaggaaacgacggctgcggcagctgatttttacgcgcaacagctaaaattcaatccagcggcaaaagcttatttggacaagcgcggcttgagtgcagaagttatcgcgcattatggtttgggctatgcgcccgacggctggcagcctttgacgcaagtgttccaaccgtatcctaataccgcgttagtggatacggggatggtgattgacaatgagggacggcattacgaccgcttccgccatcggattatgttccccatccgcaatccgcgcgggcaggttatcggtttcggcggcagggtgctggacgactcgaagccgaaatatttaaattctcccgatacgcctttgttcgataaggggaaaaacctttacggactgtatgaagggcgtgccgctgtcaaggaagcggggcggattttggtggtcgaaggctatatggacgtggtcgcgctggcacagttcggcgtgggctacggcgtggcggctttgggtacggcgacgacggcggaacacgtcaaaatcctgatgcgtcaggcagacagtatttatttctgtttcgacggcgacagcgcggggcgaaaagcggcttggcgcgcgctggaaaacgcgctgccgcagttgaaggacgacaaatcgctgcattttttgttcctgccggaagaacacgaccccgacagctacatccgcgcctacggcaaagcgcaatttgaagacgcgcttctgaatcaaagcaagcctttgtcggagtatttctgggaacacctttcagacggcattcatctcaatacgcaggaaggcaaggcggaattggtaaaaaccagttcgccgcttttggcgcagattaccgcgccggcattggcttatttgttaaaacaacggcttagcgagctggtcggcatcgaccccgacaacctcgcgcaactgctaggacaggaagcgccgaagcggcacgtcaaacaaaaaaactacaaactgcctccgatttccgtcaaacagcccgtcatgctgacgctggtacagcggcaaatccgcagcctcttgataaatccggattgggctgcatatatagacctgcccgattatctggcgttggacggtgatttcgcctgccttgccaatcttgccgaatcgattaaaaaccatgccgccgtacccgaaaccgctcaggttttagagtatatgcgcggctcgccttacgaagaaacgataacccgaatcttccattcaacgcaccaatcggaagaaatgaacagcagcagtgaagaagattgcgagaatttccaaatcggcatgaaaaaactgctcaatgagttaaaatacagccaaatcgaaacattaaaacaaaaaagcctgcaatccggcttaaatgaaagcgagaaaaaacttttgctgtcgctgctgaccgcaaaacaaaattgaccggcggattccgccatccgtaaaccgttatgccgtctgaaaagcattcaccccggctgcaacaacgacacctgcagaacacccatccccaaaagccttcagacggcatcagagtaccctactctgccacgccttcaggtgcgtccaaacgcaaaccgtcggcatcttaccaacagaaagcagacaatgtccagaaaccaaaatcacgaagaatatcaagacgacacccgtccgttaagcattgaagagcaacgcgcgcgcctgcgtcagctcatcatcatgggtaaagaacgcggctacatcacctactccgaaatcaacgacgccctgccagacgatatgtctgatgccgaccaaatagacaatatcgtcagcatgatttccggtttgggcatccaagttaccgaacacgcccccgatgcggaagacatattgttaagcgacaatgccgccgttaccgacgatgatgccgtcgaagaagccgaggccgccctttccagtgcagattccgagttcggcagaaccaccgaccccgtccgtatgtatatgcgcgaaatgggacaggtcgacctgctgacccgcgaagacgaaatcatcatcgcaaaaaaaattgaaaacgccctgaaaaatatggttcaggccatctccgcctgcccgggatccattgctgaaatcttagaactcatcgaaaaaatccgcaaagacgaaatccgcgtcgacgaagtcgtagaagccattatcgacccgaatgaagtattgctcaacgaattgggcttggggcacttggaaaccacagcgcccgagaaaccttccaacgacaattcggacgaaaacgaagacgacgaagaatcggaagaagatgcggatgaaatctcggcagccaatctcgccgaattgaaacaaaaagtcatcggccactttgcccaaatcgaaaaagactacaaaaaaatgattggccgtttggaaaaacaccacagccggcacaaagactatctcgcctaccgcgacgcgattgccaacaaactgctggaagtccgtttcgccacccggcaaatcgacagcctcagcagcagcctgcgcgggaaagtagaaaacatccgcaaactcgaacgcgaaatccgcgacatctgcctcgaccgcgtccatatggaacgcgactacttcatccaaaacttcctgcccgaaatcaccaatctagaatggattgaagaagaaatcgccaaaggcagggtttggagcgacgcgctcgaccgcttccgccacgccatcctcgaaaaacaaaccgagttggcggatatggaaaaagaaacccgcatttccatcgaagagttgaaagaaatcaacaaaaatatggtgtcgagcgaaaaagaaaccgcagccgccaaacaggaaatgattcaggcaaacttgcgcctcgtgatttccatcgccaaaaaatataccaaccggggcttacaattccttgatctgattcaggaaggcaacatcggtttgatgaaagcggtcgataagttcgaataccgcagaggctataaattctccacctacgcaacctggtggatccgccaggcaattacacgctcgattgccgatcaggcgcgtaccatccgcattccggtacatatgattgaaaccatcaacaagatgaaccgcatctcgcgccaacaccttcaagaaaccggcgaagaacccgattccgccaaacttgccgaactgatgcagatgcccgaagacaaaatccgcaaaatcatgaaaatcgccaaagagccgatttcgatggaaacccccatcggcgacgacgacgattcgcacttgggcgacttcatcgaagatgccaacaatgttgcgccggccgatgcggcaatgtacaccagcctgcacgaagtaaccaaagaaatcctcgaaagcctgacaccgcgtgaggcaaaagtcctgcgtatgcgtttcggcatcgatatgaacaccgaccacacgctggaagaagtcggcagacagtttgacgtaacgcgcgaacgcatccgacaaatcgaggcaaaagcactccgcaagctgcggcatccgacaagaagcgaccgtttgagaagtttcttggacagcgaagacagcaagctgtaaaccaaaaaaccgcaggtttcaaatacctgcggttttttcttacacaataaacaacgcttccacatatcccacactcctatcccgagacctttgcaaaattccccaaaatcccctaaattcccaccaagacatttaggggattttccatgagcaccttctttcagcaaaccgcacaagccatgattgccaaacacatcgaccgtttcccactattgaagttggatcaggtaattgattggcaaccgatcgaacagtacctgaaccgtcaaagaacccgttaccttcgagaccaccgcggccgtcccgcctatcccctgctgtccatgttcaaagccgtcctgctcggacaatggcacagcctctccgatcccgaactcgaacacagcctcatcacccgcatcgatttcaacctgttttgccgttttgacgaactgagcatccccgattacagcaccttatgccgctaccgcaactggctggcgcaagacgacaccctgtccgaactgttggaactgattaactgccaactgaccgaaaaaggcttaaaagtagagaaagcatccgccgccgtcgttgatgccaccattattcagaccgctggcagcaaacagcgtcaggccatagaagtcgatgaagaaggacaagtcagcggccaaaccacaccgagtaaggacagcgatgcccgttggatcaagaaaaacggcctctacaaactcggttacaaacaacatacccgtaccgatgcggaaggctatatcgagaaactgcacattacccccgccaatgcccatgagtgcaaacacctgtcgccgttgttggaagggttacccgaaggtacgaccgtctatgccgacaaaggctatgacagtgcggaaaaccggcaacatctggaagaacatcagttgcaggacggcattatgcgcaaagcctgccgcaaccgcccgctgtcggaagtgcaaaccaagcgtaaccgatatttatcgaagacccgttatgtggtcgaacaaagcttcggtacgctgcaccgtaaattccgctacgcccgggcagcctatttcggactgattaaagtgagtgtgcaaagccatctgaaggcgatgtgtttgaacctgttgaaagccgccaacaggctaagtgcgcctgttgccgcctaaaaggcagcacggatgcctgattatcgggtatccggggaggattaagggggcgtttgggtagaattaggagatatttggggcgaaaacagccgaaaacctgtgtttgggtttcggctgtcgggagggaaaggaattttgcaaaggtctcatcctgttattttcacaaaaacagaaaaccaaaaacagcaacctgaaattcgtcattcccacgaaagtgggaatccagtgcgttgagtttcagctatttagaataaattttgaaactctaatcgcgtcattcccacgaaagtgggaatccaggacgcaaaatctcaagaaaccgttttacccgataagtttccgcaccgacaactctagattctcgcctgcgcgggaatgacgaatccatccatacggaaacctgcatcccgtcattcccacgaacctgcatcccgtcattcccacgaaagtgggaatccagttttttgagtttcagtcattcccgataaattgccttagcattgaatgtctagattcccgcctgcgcgggaatgacgggatttgagattgcggcatttatcaggagcaacagaagccgctctgccgtcattcccacgaaagtgggaatccagttttttgagtttcagtcattcccgataaattgccttagcattgaatgtctagattcccgcctgcgcgggaatgacgaatccatccatacggaaacctgcaccacgtcattcccacgaacctacattccgtcattcccacgaaagtgggaatccagttttttgagtttcagtcattcccgataaattgccttagcattgaatgtctagattcccgcctgcgcgggaatgacgaatccatccgtacggaaacctgcatcccgtcattcccacgaacctacattccgtcattcccacgaaagtgggaatccagttttttgagtttcagtcatttccgataaattgccttagcattgaatgtctagattcccgcctgcgcgggaatgacgaatccatccgtacgaaaacctgcaccacgtcattcccacgaaagtgggaatccagttgcttgagtttcagtcatttccgataaattgccttagcattgaatgtctagattcccgcctgcgcgggaatgacgaattcatccgtacggaaacctgcaccacgtcattcccacgaacctacattccgtcattcccacgaaagtgggaatccagtgcgttgagtttcagtcatttccaataaattgccttagtattgaatgtctggattcccgcctgcgcgggaatgacgaattcatccgtacggaaacctgcatcccgtcattcccacgaaagtgggaatccagttttttgagtttcagtcattcccgataaattgccttagcattgaatgtctagattcccgcctgcgcgggaatgacggcggaaatcttgtttatattgaatcaaaaaaaacctgcaccttaatcagttggcggtttagtccgacttttggggtgcagatcaagctttcagacggtatttcctttaaaacttcatttcgagcgcgagactgaagttcctgcccggtgcggcataccttccatagttgctgtcgccgccgtgccggtttgccgtgctttccgcagtctggcgcaaggattcccaagtaacgtagcggtagttgccgatattgtagatagccgccctcaaggtcagccgttttttcagattcagataggcggaaacgtctgccgtcgaccaagaagacgacgctctttttgtcgaatatcgtttttgatcgcctgccagataagcaagctcgtcagggtttttccctttggaataggtcagcataatgtttgcgccccatttcccctcaggctggtcgtatccgaaccccaaaacataacgcgacggctgtaccgcatccaaagcatagctgcggagggacagtcccggccggttggataccgatttcggtttgatgcggttgtacgccaatgtggtgtacaaaccttcgggcagtttgccatacacgccgttccagtcgatttttcccaatatattaacgccttgaagcgacatattttgggcattgtaataatcgcgtatatcaatctctgtcaattgtcctgcctgattcggcaatttggttttgtgatcggcaacggcaatcatatcggtataacggttgcggaagctgctgatttccaaaaagccgaaatcgcccttccactgcaaaccgatttcccggttggctgccttttccgatttcagggcgggacgctgccagcctttcggataatcgtgataaatgtctatcccgaaaagttcttggaatgagggcgttctgaagccgctggaggcacggtaagacacggaaaaatgccggttcggtttgaacaagatgccgctgttccacgaacggtcaacataccgcccgctgcggacgagttcttccgacgtggtgaagtttttccggtcgtacctgccgcccaagctgaaatcgaaatatttgccgattgaaaaacggtcgttcaaagaaatatggatattgctgccgttgatttttcttggcacgcatttgcgggaacgcagggtttcgatgtagccgcagaccgacccttcgacgacttcgggcttacccaaaagatacttatcttgattgttttcatcgaatcccgtggattccgaaatccttgccgcattgtgggaaagctgttcggggcgggaaatcgctttggaagcatcgtaaccgaagcccaaagtcagatggtgtttcgtccatttgtttttcagcgatttctcaaacgaggcattcaaaacattgtgctgttcgcggtagtggaaacggtcgctgctgtcgtaggaatacggtttgtccgccgacgcgcggcaggatttgtccacagcaggatacacggcgcaattcagcttcagcgtgttgttatcggttgccacgccctgtttgtcaaacgacaacaccgccttatccgcccaattgtcagaatacgcttcgttttcataacgatacagcaaacccatacggcggcggcggtgatgttcgtcaataaatttggtgcgggaatatttcaaacctatgcccctgaccaaatttttatcgcccttccactcttctatattcggcacaaaatacaagccgtcgcggaaatcgtcgccgtcgtacaccccgctcttgtctctaaacttttccgcctcgtccgtaccgtaatactgtttttccgtcatatcgcggatatcgtaacgctgtttggtatcctcaaacacgccgccgacataatgcctgccgccgaagcggtagcccagcttggcaagccaagagccgctgcggtaatccatcggatcgggcaatatcctgccgccgcccgtgtaagcttgggcggacagattttcgtggcgcgcctgcgcctcccgcacctgcgcctcttcttcagcacttaaaggctgattttgttcaatacgttcttttacccagcggttgagctggttgttcaaatatttcccgtagcccgccaattttgccacgggcttggattcacgctcgccctctactgagaaaaatggctctcttgtcttgcgtttaatatcgtatgtctgacggaacgcgtccaaacggtctatgccgtattccaccccgtccgcaatatcgccgtgcgggcgcgtttcccgcccttggcgttcggttcggattaacagcccttcccaaccgtctttgctgaaccccgcgccgagcgacttcataaattggcggtttttactgccgtaggcggtttttgcctgtatcccccaacttttgccgtctgaaatcaggtctgccgcctctttggtgcggaaggcgaccgcgccgccgagtgcgccgctgccgtgatcggacgaaccggcacctttgtcgatttccaccgtgctgatgttttcatattcgatttcgttgattgcaccgctgccgccgcgtccgccgtatccgctcaacgatccctgcacggtaaacgcctgtatttgggcaacaccgtcgaccgaaaccgccacacggtttttatccacgccgcgtatcgagtagccgccgctcgcgccgttgccctgttcgacaaccgccacgcccggatcgtagcgcgtcaggtcgcggataccgagtacctgttctttgttcaacgtttccgacgttttgacgattttgcccaaaccggtcgcctctttcgatcgccgtcccactttggcggcacggacggtaatctctttcagggattgggtctgcgcggcatcaggtgtcgccccccccgcttgggcagcataagccggaaaagcggttgcaatggccaaggcagtcagagtcagcggaaaaccgtgtttcttattcatttttccacctcctgcatatctttcttcgcaccgaataccacgccgaattggtgtttaacttcagattctaactgtttgccaacatcaacttcagcatcaacttcagcttcaacatcaactttattttcagtaccttcagttataccaagagatttcccatcattattgaaaataataccgcccaattcctccgcctgcgggccgtaaaatcccccttctacacgaagattactagcttggaaggttttggggtcggtcgaaccatttcccgaaagattgatgccgttctcccgagtgcgtgctgtcgcgtagaaaccgttgccctcaatcttgccgttttcaatatggaaagcaggttctacaccgttttcctccgtcagcgttccggaaatcgatttcttgccgaaatcaacggtaaatactgcttttgccgcttctttatccgcctgattgtcccattgaatgggtttgccgatacgcgcttcccaagtgccggtatagtgtgcttctccagttttcggaatatccgtttccgccgtgcggatacctttcaggaaaaggtcgatgttcctgcctttaggggcttccggagcgggcaggatgccgtctgaaccgctgccgccttcttctgtcggcgattcttcttcgggttcttcagcttcatcttcaccttctacggcttcgtcttcttcgctgccttcgtcttttacggctgcgtcttcggtgccttcttcatcgtcgatttcgtcttcgccttcttcgacgctatcaacgcctgtatcctcttcgtccctctcttcgtcctgcgccttcggtttggcggcgggacgttcggtttgcatccgtccgattttcacataggtcagaaaatcgcagcaggttcggattgtcgttttcctaccatcggcaagctcgatggtttgttctttgtttaccaaaggaatttcacgcccttcgacaagaagtttgtcgggatgaccaaaatcgggcatagaggaaatggcaaactcacggggatttttatcacttgcctcgtcaacggaaattttcagagaatccaagattttggtgtgttttccagacgacagggcaggttttgtatctgctgcgttttctgtctctgttttttgtttgcctgcgaatacgccgaatacgctgttgtcgttgctgataaaccgtccggcaagctcttctccgttatcgccgaaaaaaccgccctcaagccgctgatcggcatcggtatggaaaaacaaatattctttatcagcgtgttgcgtcttcacctcggtgctaactttggcactgccggtaaagcggttgccgtccaatgttgcggtaatgtcgtaaatggtcagcggttttttgggctcatttggattacttttattttgcacatactgatttttaatcagcttgccattcagggttttgttatcaaaatcaaccgtatattcggcaggatgcttttccctgtcgtcggcatccctagcctcataagaagttgccccaatttcattaccataatatgtggtataacccaaatccgtactggaaaccgccttacctgtccgatgacgtttggcatcggtcatatattgccagttaccggaatattgcaccgttcccgcgctcggtaaagattgggaaggacgttctccggaataatatacaaaaccgtcataactaaatcggttaacaaactccttaccatcagaagtcttttctttttcattatcctttccttccgccctggtaaacacatagcccgcacggacaaattgatattgatatttttcttcttcttttttcgatgtgataaccctcacatcagaataccgttcgttgattttctttttaagtttgtcagcctgttctttcagcgtaccgtctaaaaacaggatatccttctctttaagcggcagatgctcctctgcctgatgcttgtcgggaatttccgtaccgtcttgtttataggaagcaatattccgccttggcagccgcattgccgcaccgacggcgggccggttgaccggcgtggtttctaccgaagacccggcagggggcggagtgggaacgtccttagatttgaaggtgacggggtacgcggtcggcgttgattcgacaacaggctgcacgccgaaattgccgccgatacaagatgctaaaagtaagggcaacaagacaatgccgccataattcggtttacacatccctacttttcctctatttgattaataataattatcattatattaatatgtacagataatatcaagccgtttttatagtgaattaacaaaaatcaggacaaggcgacgagccgcagacagtacagatacattccgtcattcccacgaacctacatcccgtcattcccacgaacctgcaccacgtcattcccacgaaagtgggaatccagttcgttcggtttcgcttgttttaagtttcgggtaacttctacttcgtcattcccacgaacctgcatcccgtcattcccacgaaagtgggaatccaggacgcaaaatctcaagaaaccgttttacctgataagtttccgcactgacagacctagattcccgcctgcgcgggaatgacgggatttgagattgcggcatttatcgggagcaacagaagccgctctgccgtcattcccacgaaagtgggaatccagttcgttcggtttcgcttgttttaagtttcgggtaacttccacttcgtcattcccacgaaagtgggaatccagttttttgagtttcagtcatttccgataaattgccttagcattgaatgtctagattcccgcctgcgcgggaatgacggattttaggttgggggcatttattgggaaaagcagaaaccgctccgccgtcattcccacgaaagtgggaatccagttcgttcggtttcgcttgttttaagtttcgggtaacttccacttcgtcattcccgcgaacctacattccgtcattcccacgaaagtgggaatccagttcgttcggtttcgcttgttttaagtttcgggtaacttccacttcgtcattcccacgaacctgcatcccgtcattcccactaaagtgggaatccaggacgcaaaatctcaagaaaccgttttacctgataagtttccgcactgacagacctagattcccgccttatatgatgcgctctatcaaaggggcgcattaattttcttaacattcccctttgacagccaagtgaaaggggcttttttatgtcagcagtaaatgtaatattttcctgttcttattggagaatatttaaaaaatcagattcttgtgttttgtgtttttatcagttcagacatggcgaaccgcataaactcattaatcaagagaatttttcaaagctttatcaggcgttcgattatatagattcggttggttcgaattttccagtgattatcacaacggatggttgtggtcttttttgttgatctttaaaagtttgtcaggatttggctttcggtcgttgaccgtcgtacgcgctttagcgcggaagacgggaaacggctgaaagccccccccttgactaacagggggggagcgaaattaaaaaccaattccaagagtagtgaacgaatgagtgaagttgaatatttctcacactttatatcggacggaaaagggaagcttttagaaattccgcagcgaagaggtaagcaagacggggtttttgttgattggatttcattcacattccatgaagatactttactgaaagtttccggttgccctttattttctgatgctgaatacatgtatgtattaagcagaaagctggaagaaattctaggttttggcataacgcgcaaatgcaaatcaaggggcaacaaattctatgaatccatgtataggttaggttcggatgatgttgattatggagaggtgcatttcggaggtcagcgcaatactgttttagttgagttgaaaggtactggttgcagcgttgcaagtccgggttgggagttgaggctaaagcagtttctcgatgattcgataaggacaagaataacgcgaattgacctagcacttgatttttttgatggagagtacacgccggatcaggcgttgttagatcacgataatggtttttttgataacagcaatcaaaggccgaaatctgaaacgatcggtacggcttggcggaatgaggacgggagcggcaagacattttatgtaggtcgcaagaaaaattctcgttttgttcgtgtttatgagaaaggcaggcagcttggagataaagaaagcaaatgggtaaggttcgagatccagtttaattatggagatatagaaatacccttggatattttaataaatcagggttcgtatttctgtggagcttttccaatttgtagaaaatttaaaaatatgccggttcccgaaaggtttgatcagagaaagaaaaagcttaatttaactttcgagcataaattgcattacgcgaaaaacgcggttggaaaactggtcaatttcatgattgaaatgggttttgataatagcgaaattgtggaatctttaaaggcagattcgggatttcccaaaggattagaacctgaaaaatatgctctggaaatgttaagggacggtttgaaacacggttttattcatgaacagccggatattgatttggaaattgaacttgatgaattgggggttattgcttttaaaaattctgacaaattcgatagggaaaaaaggctttttagtcctgattatgatgtcgagaaagaaaggaaatatcaggaatatttaagtaaagtttatcatcaaaatgtagattatgattatttttaaaggaaatcaaaatgtttaatcaaactcaaactgtaacttatcctgcaacttttttgggagccaaaaaattcaaaggcgaaattgatggctctaatatcgacacttgttccgtattggttgcaacacctttgccggcacagtcgggaaatgctgttggattcacggcagcacaaatgaagttcggggacagtaagaatttctcaaaattagagaatctcaaatacccgtgcgaagttatggtaacggttgaaatgacttcgacaggtaagggcatggttccttcattaattgattttcaggtggcagaaaagccgaaaggttgatttatgaaatttgaagaacgtttcatagttcaagacttggaaacgcatgactttatttatcccgatcctttcggtgatgtggggtttactcaaaatattaaatcagcaggtcaatttgaaagctacgaagatgcgttgaattcaggcataaatgaaataggcggaggattccagatatttcagttcttcgtaaaatcggaataaaagaaaaacaggctcggcgggcggtctgtcaacctttcacaaagcccgcaacaaaggaaaaatatcatgaaaatgaaccttgcaacactaattatcggctgggtggtctgtatgtttctttttcttttcgcaatcctctattttatcggctaaaaacgagattcggaaaagacttcgtccggatgaagcaagtcaagaagtcgtcttattttaaatatcaaaaaaggaaaaaaacgatgaacatcgttaaaaaatacgctgtaaaagcagccttggcagccggtatcttcacaccggccattgttatggcagatacctttgatccatccgcgattggtacgcaagtagcgaatgtaatcatgggtttcgtgtcaatggtttccgccgtgggtatggcggccattaccgtgattcttgcaatccaaggcttcaaaatggcttggagcatgattaaatctgtcaaataaacagagtgaagaaaaaggggcgtataaatgggctatcgtgtcggcataaattgttttgatacaagattgcaggcagacgactatttattgtcgtcccttcctcctactgttacccaggacggaaaaatcatcaggccggaaagggtgggcgataaatggattttgaacggaaagccggttacgttgtcttatccggaatgttccaattttgagcagataaagcaaggttcttatgtcggttcgacggttctaattctgtttgtagtcatttacggtttcaggcttctgattaattttttaaaagacataggcaaggttgggactgattgatgattatagatttctggtttcttctcggtttcttcttggctttgtctgttgcttggctgttttggtaacggttggtagaatcggctttttagagtgttttaaaaggtccgaattatgtttatttctgaatatcatttagttaaatttcaaactgattcacatatttatagagatttaccacaagcgttaatttattatagggaattgattagaaaaggggtttttaaaacttcgttttcatttgatatttttaggaatttctttcatcgttatgatagagattttatagaaattcaattccctgattcttctacattattaattaaattagatgaagcaaaatgttatgtttattatcctagggcgaaattttttaaagattatcctatgctttagtttttttgtatctaaatttgcattggcatcagtaaatgctccgggtaaatttgatagggttgaagtttatgatgatggcagatatttaggtattcgaggttcagatgacaaaagaagaagaatttggaaaggtgtatttgatagagaatcgggaagatatttaacttcagaagctcaagatttaaaagttaggcatgtatctactggagcatcaagtacgggtaaagttagttcggttgtatcttcatcagtttcccgcgctggcgtattggcgggggtcggcaaacttgcccgcttaggcgcgaaattaagcacaagggcagttccttatgtcggaacagcccttttagcccatgacgtatacgaaactttcaaagaagacatacaggcacaaggctaccaatacgaccccgaaaccgacaaatttgtaaaaggctacgaatatagtaattgcctttggtacgaagacaaaagacgtattaatagaacctatggctgctacggcgttgacagttcgattatgcgccttatgtccgatgacagcagattccccgaagtcaaagaattgatggaaagccaaatgtataggctggcacgtccgttttggaattggcataaagaagaactgaataaattaagttctttggattggaataattttgttttaaatagttgcacatttgattggaacggcggagattgtgtggtcaataaaggtgatgatttcagaaatggggctgatttttcccttattcgcaattcaaaatacaaagaagaaatggatgccaaaaagctggaagagattttatcgttgaaagtcgatgccaatcccgacaaatacataaaggcaaccggttatcccggttattccgaaaaagtagaagtcgcacccggaacaaaagtgaatatgggtcccgtcacggacaggaacgggaatcccgttcaggttgtcgcaacattcggcagggattcgcaaggcaacaccacggtggatgttcaagtaatcccgcgtcccgacttgacccccggaagcgcggaagcaccgaacgcacagccgctgcccgaagtatcgcccgccgaaaaccccgcaaacaacccgaaccccaatgagaaccccggcacgagccccaatcccgaacccgaccccgatttgaatcccgatgcaaatcccgatacggacggacagcccggcacaagacccgattcccccgccgttccgggacgcacaaacggcagggacggcaaagacggaaaggacggcaaagatggcggccttttgtgcaaattcttccccgacattctcgcttgcgacaggctgcccgagtccaatccggcagaagatttaaatctgccgtctgaaaccgtcaatgtagagtttcagaaatcaggaatctttcaagattccgcacagtgtcccgcacctgtcactttcacagtgactgtgcttgattcaagcaggcagttcgcgttcagctttgagaacgcatgtaccatagccgaacggctaaggtacatgcttctcgcccttgcttgggcggttgccgcctttttttgtatccgcacagtatctcgtgaagtctagcaggcgcagcaccgccgggcttcagtaacttgtaccaaggcagggggaggacgtccagaaagatttgtaaagacggctttatcgtctttataaatctttttggataccccttgccgccccgccaaaagaacacattctgccgcaagggcaggtggtaaggcgcgcgccttttgcgccgttccccctgcccccgcggcgtcgcaagtgagactgggggtgcgggggctagtccccgcaaagcctttcagcttcggaagccacggccgaaaggcaggcgcagcactgccggtctgagcggaagccaggctacaggcaggcgcagcaccgccgagctaggcggaagccaggctacaggcaggcgaagcaccgccggttgggcggaagccacggccgaaaggcagggcgaagcaccgccaggcttaggcggaagccacggccgaaaggcaggcgaagtaccgccggtctgggcggaagccatggtaaaaggcaggcgaagcaccgccgggcttcagtaacctttgttcaggcagggggaggatgtccgtaaagaatcgtaaaggcggggttttttcgcctttatgattctttttggataccccttgccgccccgccaaaagaacacattctgccgcaagggcaggtggtaaggcgcgcgccttttgcgccgtccccatgcccccgcggcgtcgcaagtgagactagggggtgtgggggactagtcccccgcaaagcgttcagcttcggaaactttggccgaaaggcaggcgaagcagcgcactttgcgacgaatgtcgcaaatagccgagaagcgcggggggattggcgataagcgcgaggggggtgtccccacagcgccgccgcgccgcgaatgcggcgcaaaatctttcagattaagaaacatttgtttaatgaggcaaccgtgccttttaagaaagggatagcaaatgaaattgttggccgcattgattccgcttttgatgagcgtggcaggccgtatattgactgcattaggcttgatggcggtaacctattcaggggtggatagattggtagcccattttcagcaggcgataaccaatagcataacgggcgcgcctcaagcgatgttgcagcttttttatataagcggcggtggaaccgttcttaatatcctgtttggcgcgatcgcctttattctgtcattcaaacaaatgacaaaactagcaacctcaatcgggaagaaaaaataaatggcagagatctgtttgataaccggcacgcccggttcagggaaaacattaaaaatggtttccatgatggcgaatgatgaaatgtttaagcctgatgaaaacggcatacgccgtaaagtatttacgaacataaaaggcttgaaaataccgcacacctacatagaaacggacgcaaaaaagctgccgaaatcgacagatgagcagctttcggcgcatgatatgtacgaatggataaagaagcccgaaaatatcgggtctattgtcattgtagatgaagctcaagacgtatggccggcacgctcggcaggttcaaaaatccctgaaaatgtccaatggctgaatacgcacagacatcagggcattgatatatttgttttgactcaaggtcctaagcttctagatcaaaatcttagaacgcttgtacggaaacattaccacatcgcttcaaacaagatgggtatgcgtacgcttttagaatggaaaatatgcgcggacgatcccgtaaaaatggcatcaagcgcattctccagtatctatacactggataaaaaagtttatgacttgtacgaatcagcggaagttcataccgtaaataaggtcaagcggtcaaagtggttttacactctgccagtaatagtattgctgattcccgtgtttgtcggcctgtcctataaaatgttgagcagttacggaaaaaaacaggaagaacccgcagcacaagaatcggcggcaacagaacagcaggcagtacttccggataaaacagaaggcgagccggtaaataacggcaaccttaccgcagatatgtttgttccgacattgtccgaaaaacccgaaagcaagccgatttataacggtgtaaggcaggtaagaacctttgaatatatagcaggctgtatagaaggcggaagaaccggatgcgcctgctattcgcatcaagggacggcattgaaagaagtgacggagttgatgtgcaaggactatgtaaaaaacggcttgccgtttaacccatacaaagaagaaagccaagggcaggaagttcagcaaagcgcgcagcaacattcggacagggcgcaagttgccacattgggcggaaaaccgtagcagaacctaatgtacgataattgggaagaacgcgggaaaccgtttgaaggaatcggcgggggcgtggtcggatcggcaaactgaagaaaacggcaagagagaaaaaagacccgtaaaccgtttgaatatagacggtttacgggtctttgtttcgcgcaaagcaagggctaaggcagtcaggcagcaaatcccgcaatgtattaaaacagacgcgtagaaatgccggctgcctttatccatcctcgaaattgaatatcatcctagccgtatcaaggctgtataaataaggaaaataccaatgaatataatcgggctggacatctcaaaggacaccatagacgcaacattgcataaaacaaacggaagtatccattacattaaatttaagaataatgatgatggattaaaacagtttagattgtggataaagggaaacagaatcagaaaagtctatatcggcatggaggcaacaggcatctattacgaaaaggcagcagatatgctttcttcctactatactgtttacgttattaatcccttaaaaatcaaggactacggaaaaagcaggtttaaccgtaccaaaaccgacaaagcagattcaaacctgatagcagactacataaaaaggcatcaagatacattgataccgtatcagatacccaaaaacaaagcactgcaaaaactgattaaccttaaaaatcaattacatcaacatcagaagcaaattaaaaaccgtcttcatagcactgaagaagacttcataaggaacatacatcaagacttgatagataccatacaggacaagatggaacaggtaaaaatagccatatccgaacaaatcaaaaaacaaacggacaataaccattaccgcaatcttcaaaccatcccgagcataggcaaagacaccgcatcagttctttatgcgcaactgacagaaaaacattttaaaaccgcaaaccagtttgtatcctatgccggattaaatcccgccatcatacaatcagggacaagcgtaagaggtcggggcagattgagccgatacggaaacagacgattaaaaagtacgctgtatatgcccgccctttgtgcttaccgttttaacgcatttccgaaattaataaataatctgaaaaaagcgggtaagccaaagatggtaatcatcgttgccatcatgcgcaaactggcgaagctcgcctattacattgttaaaaccggccagccttacgatgcggaaagacaccgattgaatcaataaaattcaacaaaattaaacggttacgcgaatatatttgtgtaaccgtgcatttgcatatcgtaaataaacgtaaataaaaataacaatataaatcagtatattgcaactttgttttttattttgtgttgacgggcaacatatcatctgcgcgggaatgacgggatttgagattgcggcatttatcgggagcaacagaagccgctccgccgtcattcccacgaaagtgggaatctagttcgttcggtttcgcttgttttaagtttcgggtaacttccacttcgtcattcccacgaaagtgggaatccagttttttgagtttcagtcattcccgataaattgtcttagcattgaatgtctagattcccgcctgcgcgggaatgacgaatccatccatacggaaacctgcatcccgtcattcccacgaacctacattccgtcattcccacgaaagtgggaatccagttttttgagtttcagtcattcccgataaattgccttagcattgaatgtctagattcccgcctgcgcgggaatgacgggattttaagttggggtcatttattggaaaaagcagaaaccgctccgccgtcattcccacgaaagtgggaatccagttttttgagtttcagtcatttccgataaattgccttagcattgaatgtctagattcccgcctgagcgggaatgacgaatccatccgtacggaaacctgcaccacgtcattcccacgaacctgcatcccgtcattcccacgaaagcgggaatccagttcgttcggtttcgcttgttttaagtttcgggtaacttctacttcgtcattcccgcgcaggcgggaatccagtgcgttgagtttcagctatttagaataaattttgaaactctaatcgcgtcattcccacgaaagtgggaatccagttttttgagtttcagtcatttccgataaattgccttagcattgaatgtctagattcccgcctgcgcgggaatgacgaatccatccatacggaaacctgcaccacgtcattcccacgaaagtgggaatctagttcgttcggtttcgcttgttttaagtttcgggtaacttccacttcgtcattcccacgaaagtgggaatccagttttttgagtttcagtcattcccgataaattgtcttagcattgaatgtctagattcccgcctgcgcgggaatgacgaatccatccatacggaaacctgcatcccgtcattcccacgaaagtgggaatccagctttttgagtttcagtcatttccgataaattgccttagcattgaatgtctagattcccgcctgcgcgggaatgacggattttaggttgggggcatttattgggaaaagcagaaaccgctccgccgtcattcccacgaaagtgggaatccagttcgttcggtttcgcttgttttaagtttcgggtaacttccacttcgtcattcccgcgcaggcgggaatccagtgcgttgagtttcagctatttagaataaattttgaaactctaatcgcgtcattcccacgaaagtgggaatccagctttttgagtttcagtcattcccgataaattgccttagcattgaatgtctagattcccgcctgcgcgggaatgacgaatccatccatacggaaacctgcaccacgtcattcccacgaacctgcatcccgtcattcccacgaaagtgggaatctagttcgttcggtttcgcttgttttaagtttcgggtaacttccacttcgtcattcccgcgcaggcgggaatccagtttcttgagtttcagtcatttccgataaattgccttagcattgaatgtctagattcccgcctgcgcgggaatccagtgcgttgagtttcagctatttagaataaattttgaaactctaatcgcgtcattcccacgaaagtgggaatccagttttttgagtttcagtcattcccgataaattgccttagcattgaatgtctagattcccgcctgcgcgggaatgacggcggagcggtttctgttttttccggtaaatacccacaagctaaaatcccgttattttcacaaaaacagaaaaccaaaaacagaaacctgaaattcgtcattcccacgaacctacatcccgtcattcccacgaaagtgggaatccagttttttgagtttcagtcatttccgataaattgcctcagcattgaatgtctggattcccgcctgcgcgggaatgacggcggagcggtttctattttttccggtaaatacccacaagctaaaatcctgttattttcacaaaaacagaaaaccaaaaacagaaacctgaaattcgtcattcccgcgcaggcgggaatctggttcgttcggtttcgcttgttttaagtttcgggtaacttccacttcgtcattcccgcgcaggcgggaatccagtgcgttgagtttcagctatttagaataaattttgaaactctaatcccgtcattcccacgaaagtgggaatccagttttttgagtttcagtcattcccgataaattgccttagcattgaatgtctagattcccgcctgcgcgggaatgacggctgcagatgcccgactgtctttatagtggattaacaaaaatcaggacaaggcgacgaagccgcagacagtacaaatagtacggaaccgattcacttggtgcttcagcaccttagagaatcgttctctttgagctaaggcgaggcaacgccgtactggtttttgttaatccactatactgtaatcagggatgctcagttcgtcgaaacggcaaaacaggttgaagtcgatgcgggtgatgaggctgtgttcgagttcgggatcggagaggctgtgccattgtccgagcaggacggctttgaacatggacagcaggggataggcaggacggccgcggtggtctctaaggtaacgggttttttgacggttcaggtattgttcgatcagctgccaatcaatcacccggtccaacttcaatagcgggaagcggtcgatgtgtttggcaatcatggcttgggcggtttgctggaagaaggtgctcatgagaaatctcctaaatgtcttggtgggaatttaggggattttggggaattttgcaaaggtctcaacttgagtttcacgccccgcttaacaatattcagttggtaaatattagataaaaccataaaaattaaattgatggcttttataatccccgatttgcgaaaatgccgtctgaaagtcttcattcaggctttcagacggcattttgatcatcaagtaacgctttatcaggcttttttattgttcaacgcagctttgacaaacgcggtgaacaaaggatgccctttgcgcggattggaggtaaactcggggtggaactggcaggcgaagaaccaaggatggttcggcagttcgatggtttcgaccaagcgttcgcgtccggcagatacaccgccgatgaccaaacctgcctgttccagtgtaggaacgtagttgttgttgacttcgtagcggtggcggtggcgttcgcggatatgtccgctgccgtagattttggcggcgaggctgcctgctttcaattcgacttcttgcgcgcccaaacgcatcgtgccgcccaaatcggtggattcgtcgcgggtttcgacgctgccgtcggcagtttgccattcgtcaatcagggcaacgactggcgcggcgcatttgaggtcgaactcggtggaattcgcgcctttcaagcctgccacgtcgcgggcgtattcgatcagcgcaatctgcataccgaggcagatgcccaagtatggcacgttgttttcgcgggcgtagcgcacggcggcgattttgccttccacaccgcgcgaaccgaaaccgccgggaacgaggatggcgtccatgtctttaagcatggaaacgtcgcccttgtttttctcgatgttttcgctgtcgacaaaggtaatctgcacgtcggtttcggtgtgaatgcctgcgtgtttcaaggcttcgatcagcgatttgtaggactcggtcaaatcgacgtatttgccgaccatggcgattttgacggtgtgtttcgggttttggatggcgtggacgatttttttccacgcggtcaaatccgcctgctgcacattaagctgcaactgctcggtaatgatgttgtcgatgccttggtcgtgcagcatttcggggcattcgtagatgctgtccacatcgtagctgccgacaatcgcgcgttcttccacgttgcagaacaaggcgattttgcggcgttcgtccgcaggcattgtcctgtccatacggcaaatcaggatgtcgggttgcaaaccgatgctcaacatttctttaacggtgtgctgggtcggcttggttttgatttcgcctgcggcggcgatgtaggggacgtagctcaagtgggcaaacaaggtgttgttgcgccccaactggcttcgcatctggcggatggcttccaaaaacggcagcgattcgatgtcgccgaccgtgccgccaatttcgacaatcgccacatcgtaacctgccgcgccttcgtggatgcgtcgtttgatttcgtcggtaatgtgcggaatgacttgaaccgtaccgccgaggtagtcgccccgtcgttctttggcgataacgttttcgtacacctgtcccgtgctgaagctgttgcggcgggtcatcgtggaatcgataaagcgttcgtagtgtcccaagtcgaggtcggtttccgcgccgtcgtcggttacgaacacttcgccgtgttggaacgggctcatcgtgccgggatcgacgttgatataaggatcgagcttgagcatggtaacgttcaagccgcgcgattcgaggatggcggcaatagaagcggcggcgatacctttacccagtgaggagacaacgccgccggtgacgaaaatgaatttggtcataatgaaatacccgtattggaatgcgtgattttaacgtgaagcgcgcggttctggcaaacggacggatgccgtctgaacgatggacggctgttttcagacggcatcttttctttatttcccggtactttgccgcaactcgcggcgcaggattttgccgacgttggacttgggcaactcgtcgcggaattcgatatttttcggtactttatatgcggttaattcggtgcggcaaaaagcgataagttcttctttggtcaaagacgggtcttttttgacgacgaatactttgagtgcctcgccggttttttcgtcgggaacgccgatacaggcgacttccatgactttgccgtgatgcgcgatgacttcctcgatttcgttcggataaacattgaatccggaaacaacgacgaggtctttcttacgatcgaccagcttcaaccagcctttttcgtccatgacggcaatatcgccggtttccaagaagccgcgcgcgtctatggctttggcggtttcttcggggcggttccagtagccttgcatcacttgagggccttttacccacaattcgcccggctgcccgacggggacttctttgccgtttgcgtcgcgcagttcgacttcggtggacgagacgggcaaaccgatgctgccgctgtatgattcgatgtttaaggggttgcagcacacgccggggctggcttcggtcagaccgtaggcttcgacgatgggcgtgccggtgatttttttccatttttcggcaacggctttttgggtcgccataccgccgcccaaagtcagccgcaattctgaaaaatcgacttcggcaaaatcaggacggttaaccatcgcgttaaacagcgtgttcacgccgataaatacattaacccgctgttttttcagttctccgataaagcctttcatatcgcgcgggttggtaatcaggatgattttcgagccggcattggcaaaaatcatcagattcacggttaaggcaaaaatatggtacagcggcaaggcggcgataacggtttctttgccctcgcgcaactggtttttaatccattcttttgcctgaagcatattggcgcagatgttgccgtgactcagcaccgcccctttggcaacacctgtcgtgccgcccgtgtattgcaacagcgcggtatcttcgcggtttaatgcgacaggttggaaaacgtgcttcgccccttctttcaatgccgtctgaaaggaaacggtttcccgaatacggtattcgggcaccattttcttgattttccggatgacgaaattgatcagcgaacctttaagcagcccgaacatttcgccgacggaggctacgatgacgtgtttgatctgcgtgcgcggcagcaccagctccagcgtgttggcgaaattttccaaaacgatgatggcggtcgcgccgctgtctttcaactgatgctccagctcgcgcggggtatagagcggattggtgttcaccgctaccaaacctgcctgcaaaatgccgaaaagggcaaccggatattgcagtacattgggcaacattattgccacgcgctctcctcgaggcaatttaaggacgttttgcagataagaagcaaaatctgttgccagtttgccggtttcggcataagtcagcgtcttacccatgttttgaaaagcaggttggtcggcaaatttttccacgctttggcggaatacgtcgctgacggaattgtattgcgtgatgtcgatttcggcactgacgcccttctcgtagctgtctaaccagattttttccataggtatcggtctttaaagtggaattgagcggaacaatgccgtctgaaaaccgtttcagacggcattacctttatcgtgtgatgatgacgggtttgtcggtcgtttggatgataccgccgcccaaacagatatcgccgtcgtacagcacggcggactgacccggcgtaaccgcccattgcggttcgtcaaacaccagctcggcggtttcatcatccaaatagcgcaactcacaaggcgcgtccgccatacggtaacgcgttttgcaggtatagcgtcctgccttcgggcgttcgggcagcgtgaaactcaaatcgttcatcacaaggctgcgggtataaagcagcggatggtcgtgtccttgcacgacaatcagttcgtttttcgtcaaatctttagccgcaacaaaccacggttcgcccgcgccgccaatgcccaaacctttgcgctgtccgagcgtgtagaacatcagcccgacgtgttcgccgacggttttcccttcgggcgtaaccattttaccattgtcggtcggcaggtatttctgcagaaactcgcgaaacgggcgttcgccgatgaaacagatgcccgtgctgtcttttttagcggcggtcggcagtttgaactcggcggcaaggcggcgcacttcgggtttttccaaaccgcccaacggaaaaatcgcgcgctcgagttggaaaggcttgaggcggtagaggaaatagctttggtctttgtttcgatccaaacctttgagcaggtaatgcacgccgttgcgaacttctttgcgcgcatagtggccggtggcgatggtatccgcgccctgccctacggcgtagtccaaaaagcatttgaatttgatttcggcgttgcacaacacatccggattcggcgtgcgccccgcactgtattcctgaagaaaataagcaaagactttgtctttatattgcgcggcgaaattaacgatgtcgatatcgatgccgataatatcggcaacggcgatggcatcgaacgaatcctgtttgatgctgcaatattcgtcgttgtcgtcgtcttcccagttctgcatgaacacaccgcgcacttgataaccctgctgcttgagcagggcggcggttacggaagaatcgacaccgccggagagcccgacgatgatattggaagggtttgctgtcgtattcatgcgtagaatatggttggaaacggcggtttttaaaggcggattttaacacattttaaaggcgggcataaaaatgccgtctgaaagcccgggctttttcagacggcatttcaaacattttcagcagattagtgctgatgcgcttcgccgtggtgatgaccgtggttcattgccggcatcggcgcgattttgacttccagttggacggtttgcgctttggcgtttttaaatttcagggtaacgggaattttatcgccctcttttaattgttttttcaaacccataaacatcacatgatagctgccgggtttgagttcggtaacggatttcgcttccaaaggcacgccgccttcgacttcgcgcatccgcatcacgccgttgtcgttgatgtgggtatgcacttcgacgcggtcggcaacggggctgcttccgccgagcaaaaagtcttgtttggcttcgtcgttgtggattttcatgaacgcgccgcctattttcataccttcgacggtggtgcgcgcccagccgtcctcaacgtggactccggcggcggaaaccgcgcctgccaaacctgccatcatcacggccgccaataattttttcatctttctgctccttataatatcagacggggaatgtgcttaatcttatagcggattaacaaaaaccagtacagcgttgcctcgccttagctcaaagagaacgattctctaaggtgctgaagcaccaagtggatcggttccgtactatttgtactgtctgcggcttcgtcgccttgtcctgatttttgttaatccactatacatacaaatactgcctggaaatttgatgtagattaagtgaataataaataccacatactaatcctaaaggattacaaatcctgctgcaagcgttttacccgaacagggcagacagccaaaccgccgccaacatcagcatcgcgaacaattgtgcggcagaacctgcgtctttggcgagtttggccagctcgtgtttttcggtcgaagtatgatcgacggcagcttcgacggcggtgttgaacagttcgacaatgaccgacacaaaagacgcgataatcaacggcaggcggacggcggtttcggaaacccaaaaaaatgccgcgcacaccagcagtacgttcagccacaaaacctgacggaatgccgcttcgtaacggtaggcggcggcgatgccgtctatcgaatagccgaatgcgttaatgacgcgcctgatgccgcctttgccttttttttctgccgcgtaggaggaaggttccatcggtatcctttcaaaatgttctcaatatagtggattaacaaaaacctgtacggcgttgccccgccttagctcaaagagaacgattctctaaggtgctgaagcaccgagtgaatcggttccgtactatttgtactgtctgcagcttcgccgccttgtcctgatttttgttaatccactatatataccgtctgaaaacggggcggcggggtgtccgtacggtattaagcgtatccctgccggctgagagaaaaccctgcctgcccaatcaaaccaggcggttgtgaagcaaaagcctttcagacggcatcggtttaacgtaccgaccacgcggcaacggcatcggcaaacattgccgccacatcgaaacctttttgtttcataatttcttggaatccggtcgggctggttacgttgacttcggtcaggttgctgccgataacgtccaaaccggccagcaggatgccgcgccgtttgagttcgggggcgagcgtttcggcaatttcgcggtcgcgtccgcccaattcctgcgccacgccgcgcccgcctgccgcaaggttgccgcgtgtttcgccgttttgcgggatacgcgccaaagcataggggacgacttcgccgccgataatcaggatgcgtttgtcaccgtgtacgatttcgggaatgtagcgttgcgccataatggtgcgggaatcaagctgcatcagggtttcgaggatgctgccgatgttggggtctttttcggtcaggcggaaaattcccataccgcccatgccgtcgagcggtttgatgatgatgtcgccgtgttctttcaaaaatgtgcggacatcggcggaacgggtcgttaccagcgtgggcgcgataaagcggctgaagttcaaaatcgccagtttttcattaaagtcgcgcatcgcctgtccgctgttaaagaccttcgcgccctgctgttccgccagcgtcagtaattgggtggcgtagaggtattgcatatcgaacggcggatcggtacgcataatcacggcatcaaatgcttccaatgccgtctgaactttgtcggcagatttgaaccacgcatgatcatcatcgttttttgcacccaaaaattcaaatgccgatgcctgcgccgttaccaaaccgccgtttacagacaattccccgctcaatgtgtgaaacagccgccagccgcgttttgccatttcgcgcatcatcgcgtaggtggtgtctttataggttttgaaacttgccatcgggtcggcgataaagaggactttcatcatatttcctttccggtgtgccgaatgtgccgcatttcgcgggtaaaggagaaattccgcccgaacaatattcagacggcagggatggggttttacttaggctgccaagagtctttcagcgttaccgtgcggttaaacaccggcgtgtctttgccgtggtctttacggtcggttacgaagtagccgatacgctcgaactgccaacggctttctgccggcaaatctttggcggcaggttcggcgtaggcggtgatttccttgacggattccggattgaggaaatcggtgaacggcaggtattcgccgtcttcgccgcgcacggcatcgggacgctcgacggtaaagaggcggtcgtacagacggactttgatttcggcggcgtgttcggcggaaacccaatgaatcacgcctttaactttacggccttctggatttttgcccaaggtgtcgtggtcgatgctgcatttgagttcaaccacattgcctgcttcgtctttgacgacttcatcgcacttgatgacatagccgtggcgcaagcgtacttcgccgccgggaatcaggcgtttgaagcctttgggcggattttcggcaaagtcgtcggcttcaatatagatggtttgggaaataggtacttcgcgctcgcccatttcctcgtggttcggatggaacgcggcacggcggctttgggttctgccggtttcaaagttggtcagggtcactttgagcgggttcaacaccgccatcaggcgtggggcggaattttccaactcttcgcgaatcgcgccttccaacacgctcatatcgacgatgttttcagatttggaaataccggcgcgtttggcaaacaggcgcagcccttcgggcgtgtagccgcgtcggcgcataccggaaatggtcggcatacgcggatcgtcccagccggaaacgtgtttttccacaaccaactgattcaatttccgtttggaggtaatggtgtacaaaagctccaaacgggaaaactcgtattggcgcggacgggtggcatgcggcgcaggaatgttgtccaacacacagtcgtacagcggacggtgtgcttcgaattcgagcgtacacaaggaatgcgtgatgccttcgatggcatcggagatgcaatgcgtgtagtcgtacatcgggtagatacaccatttgtcgccggtgttgtggtgatgggcgcggcggatgcggtagatgacggggtcgcgcatattgatgttgcccgatgccatgtcgattttcaggcgcagggttttgctgccgtcggggaactcgccgtttttcatgcgtgtgaacaggtcgaggttttcttcgacgctgcggtcgcggtaagggctgtttttacccgcttcggtcagcgtaccgcggtattcgcgcatttcttcgggcgtcaaatcatcgacatacgctttgccgtctttaatcaaaccgacggcgtagtcataaagctggtcgaaatagttggaagcgaaacgcggctcgcccgcccaatggaaaccgagccactcgacatcttctttgatggcgttgacgtattcgtcgttttctttttcggggttggtatcgtcaaaacgcaggttgcacaagccgtcgtaaatatacgccaaaccgaagttcaggcagatggatttggcgtgtccgatgtgcaggtagccgttgggttcgggcgggaaacgggtttggacagctgtatgtttgccgctttcgaggtcttcttcgatgatggtgcggataaaatggttgtccgcaaattggtctttattgagcatagttttctttgaacagatggcttcagacggcattggaatgattccgtatgccgtctgaagcggtttgggaatgtgtttattgtacccgacttgcgcgctttgacatagcgttcagacggcatcggcaatcaagcattccacccccgcctctttcagcatcttctgcatcgcggtatcgggcagccggtcggtaaatactttgtcaaacgccgtaatgtcgccgagcctgaccagcgcgttgctgcggaatttactgtggtccacgccgaggaagcggacgcgcgcattggcaatcatcgcctgcatcacgctgacttctttgtagtcgtcgtccaaaagcgaaccgtcgctttccacgccgtgcgtactcatcacggcataatcgactttgaactggttgataaaatcgacggttgccacgccggtaataccgccgtccaaagggcggacgactccggaagtgatgatgaccgtataatccgtccgcgccgaagcaatcgaggcggcgtggatattgttggtaatcaccctcaggctgccgcgccgcctgaccagctccgacaccacggcctccatcgtcgtgccgatactgacaaacagcgacgaaccgtcggggatgtgttccgcaatcagccgggcaatggcgtttttttcgttttgacaccgggtttggcggtcggcgggcaggccctccggcaagtttccgcccgaagatgcgccgccgtgatggcgtttcaggctgccgacctcctccaactcgcggatgtcgcggcgtatcgtctgcggggtaacgtccaatgcggcggcaagctcgtccaccgacataaactgatgccggcggacaaggcttaaaatctctccgtgcctttggattttcggcttcatcgttttctgcctccttgcatcgggatgccgattttaccgcgttcaacccaaagcggaaaacaccaccatcagaaacggggcggcgatattgaccaccacgccgaagctgaccgctaccggcacgacttccaaaccgcccgcaccctgaatcacgggcaatgtaaaatccatactggtcgcaccgccaacccccaccgccgcatctggaaaacgcttcatcagcagcgggataaatgccagtgcaaacagctctcgtgccaaatcgttcagcagcatgatgctgccccataccgcgccgtaagcctcggtcatgaccaaacccgagagggaataccaaccgaagccggaagccatcgccaaacctttcgtccacgacacaccgtctgtcgatgcggcaaacagcagcccgcccgaaagagatgaaagcataaaccagaccgacaaccgaatacccctgcggttgaccaaaacctgccgcaacgatacgccgctgcttttgagctgtacgccgatgaggaacaccagcagcatcagacaatacatgcccgcgctttcagacggcatccaaatatcgcgcatcagtttgccgaatgcaaatccgagcagcacgcatccgagctgccccacactgcccgacacgccgaccgaaacgcccttccctttcccctttatccgccacgggaataactttcccaacactgccaaagcaagcaggttcgccccgaccgtacaaacaaacagccacagaaccgtcaacgccatatcgtccaaccgcgaacccaaatcctccacgcgcgacaacgagacgccgatcagcagcagcacagcatacaccaagaccgatagcaccttatccaaagcgggcaggtaaggcttgggcacacggataaaaaatccggcaaacatcggtatcaataccgaaagcaacgtcatcaggctgtccatctactgctctcctttattgccgcatgatatgtgcggtttaaaaattgccgtctgaaaattgcagatacccgcatccatatttcagacggcatcaggttcgccattaaaaaaccgcctgaaggttcaggcggcttatccgctccggcattcaatcttccaaagtcttttccaaacgctccatacagttgcccaaatggcggcgcaggattttgaccacgcggttgcgcctgcccgccagcagcaggtcgaggatttcgcggtgttcggaatgcgtatgcgtattgatggcgtgtttttcctcgcgatgcacgcccgccacggcgacaatcagggaagaccgcgcgcacagcgtattcataatgtcgaacagcacatcgttgcccaccaggcgcgccagttcgacgtggaaggcattggacaggcggttccagccgacgcggtcgcccctgccggaggcctcttcttcgcgccgtatcatcgcataaagcggcttgaggcgcgtttccaaatccggcaaatctgcgaggatattcaaaatcatcgtctccatttcgatgcgcgcattgaacacatcctgcatttctttcaaatcgggaacgtggacgaacgcgcccctgttgggttgcaaatcgacaatcttgtcgtgcgccaaaagcgacagcgcgccgcggacggtgttgcgcgaacacaccatctgacggcaaagttcggattcggtcagctttttgccgggcagcagcacctgatcggtaatgccgtccaaaatcagggcgtaaacacggaacagctccgaatcgtgccgctcttcgagaatcagggaagacgtggtcggcgcatggataatgtcgtcgttttcaaagttcatgatgttttccgtatttttacgctttcaaattttttaagatgttttaaggcggctgtgtttcaaatcgtgtcagaggaattaaagcattgcacaaatttattttatagtggattaacaaaaatcaggacaaggcgacgaagccgcagacagtacaaatagtacggaaccgattcacttggtgcttcagcaccttagagaatcgttctctttgagccaaggcgaggcaacgccgtactggtttttgttaatccactataattcaataaattaatatatggcttaaaataacgggattctcgcctcccgcccgcccgcagaagcaggcggatatcattttaaaacgcggcatttaaaatttgaccgaaaattgttgacaatccggaatcaagtctgcacaataccccgacaagtccaagtattataaaggctgaataaagaggaaacagcaggcagatatattcgggaggtgcagtccgaatatatctgcttttttatgcgcctccggattgcctgccgcacctttcccttcagacggtatcagccgtttccccataatgccgcccgatgcctatttatctgccccggcaatttcaaaactgtgggtaatctttgccgctttgcccaacataatcgaagccgaacagtatttttcggcagacatctgaacggcgcgctcaatggccgattctttcaaatcatgcccgaatactttgaaatggatgtggatttcggtaaacacgcgcggcgcatcgtccgcccgtttcgccgtaaccgtcgcacggcagtcagtcactttctgacgctgtttttcggcaatcatcaccacatcgatgctcgaacagcccgccacgcccaacagcagcatttccaaagggctgggcccgcgcttagccttaccttctgccgccgacccctccataacgacgctgtgcccgccttccgtcgtgccgacaaaacacatcccgtctatccattttgatgtaacctgcatggtgtcattcctgaaaatagcgttaaaaccgctttgcatatggcgttattgtaaacaatttcaagcggcttatgcagaaatatggacaaaacggcaaaaaaacacttgaaaaccgatttacggtttggctgcctggccgttgatctgcaccgatttgagtttcagcgtataggttttgccgtcgtcggtatagccgatttgtgccggaatattgttcagggacggtgcgaagaaatacattaccgcatcgtcgccgcgccgcacccgatatttgacgacttcggtttccacgccgcctatgctgtattttcctgtacccgccttattcaaaccgccgacggaataaagttttttgccgttggtgattttcagccccggggggagtttcgcgtcatttgccgccaactgccaggcaagcgtgaacaaatccatagccttggggctttgctcggttttgctctcgcccgctttgccgtaagttacgctgccgtcggcgaatttggcttccgcatacagtttgcccctgcgtatgtctctatagtaggtagggtgcagggtattgccgacaaccgtaccgccggactcgaaacggatattgtatagcggcactttaatcgtcgaaacgattttgtaagcattgccgctgcgttcaaatgtcatcgtggcgggaatgccgtagctgccggaatagtgcagcacggcggattggggcagccctgccgcatacgcgcacggcagggcggcggacaaaatggcggcggaaaatatatttttaaaagtcttcatcatttgctcccgcccggtttacgccgtcagaaaacgggcggcatcggcgttttccgaatttctgacgcggtttccctcaataatcaggcggccggcggcaaaatcggcaacggctttcggataaagtttatgctcgacagccaaaacccgtgcggcaatatcgtctgccgtatcgccgtcgagtatcggcacaaccccttgcgatacaatcgggccgcaatccagttcggcagtaacgaaatggatggtgcagccggcaacgcggcagcccgcctccaaagcgcgttcgtgcgtatgaagtccggtaaacgagggaaggatggacgggtgaatgttcatcagcctgccttcgtaacgggcgcaaaactcgggggtcagaatccgcataaaacctgccaaaaccaccaagtcgggttgatatgcgtcgattttctccatcatggcggtatcgaaggcaagccgggatgtaaagtttttatgattcaggctatcggtcgggatgccgcgttcggccgcccattgcaaaccggcagccgtttcgctgttgctcaacacggcggcaatgcggacgttgtgaatggcggcattgacgattgcctgcatattgctgccgcgtccagaaatcaggatgacgatgtttttcataatggtgcgcttttgaaagggatgccgtctgaaccgctgtttggtggtttcagacggcatttgccgtaaaaatgcccgaaaacctgtttcgggcatggattcggacttaatttacttttttgatgtcgacttgagccggctgcttggcgggcgcgttttcgggtgcgccgattttgaccagtttcacatcaaataccaaagtggcgttcggaccgattttgtcgcccgcaccctgttcgcggtaggcaaggttggacgggatgtagaacgtggcttcgccgccttctttcagaagctgtacgccttcggtccaacccggaatcacttggctcaaagggaaggtgaccgggccgccgttggctttgctgctgtcgaataccgtaccgtcaatcaggcggccttcgtattccacggtaacgatgtcgtctttggtcggctgtttgccttcgccctgtttggtgattttgtattgcaggccggaagcagtggtcttcacgccgtctttggcggcattttctttcagaaaggcttcgcctttttctttattggccttcgcgtccgccttgtgtttttctacggctttagcctgttgttcctgaaggaatttcatcatgacttcctgagcctgctcttcggtcattttgatttctttgccgtcatacactgcctgcatggcttcggtaaagactttcaaatcgatttccgcgccctgttccttcatttgcttcagggagcgtccgatgtccacgcccatcgcatagcttgcctgctgcatcgtgctgccgatcgaagaggtgtcgccctgcgcggaagaagcggcggcaggttcggatgcagatgcgggggcggcttcttttttgccgcaggcggaaagtgccaaagcggcggaaagggtcagtgcgctgattttgaaaatggtgttcatgatggatcttcgctgtcgataaggtcggaaaaacgggattatagccgagtttgaatgtttcaacacacaggatgacacataaagcgtcaatcgtgtgttgccctgttttggaagggattgaaccttccaaaataagttttgattctaccgccccgagggacagatgtccaagtggcggggttcaaccgataaggaaattttaatcaaatagaatcaagcctgtttaaattttgtaaatgcggcatttcagacggcattttatgccttgccctccatgccgtgatgttcgatggcaaaaccgcttcggcggtaggcggtaaagcgttcgcgcgcgtcggcgagctcttccaagctgttgccgacgatttccaaaacgcgcgcgggcaagaccggagcggtgttccaaaaaccgtcggacaggttcaaaacggtcatgccttcgggaattcggggcagattgccgccgcaggcaagcaggacggatggttcagacggcatggcttcttccgtttcccaaatttcgtgcggaatgaaactctcggcctcgtattgccaaagcattttgtccaattcctgaagctgcccgaacgaatcggaccacaccagtatcctgccgccgtcccgaatcgcacgggcaatcaggcggcaggtgaaaatcggaacttgggcaacgtgcgtgtaaaaggtggctttcggcatattgtttgaacatttggcaggataatgccgtctgaaaggcttcagacggcattgtgggaaaattaaagattccgcagatagttcagcagcaagggaacgggacggccggtcgcacctttttccgcaccggatttccacgccgtacccgcgatgtcaaggtgtgcccatggatagtcttcggtaaagtaggataggaatgttgcggcggtaatcgtgcccgcgccgggcgtgccgatgtttggaatgtcggcaaagttggatttgagttggtctttgtaggtctcaaagagcggcagttgccatgctttgtcgtccacgttgtagaagcggcaagcaggctgtcgatcaaatcctgattgttgcccatcacgccgctgacatcgtgccccaaggcaacaatacacgcgccggtcagggtggcgacgtcgatgacggctttgggtttgaactgctcggcgtaagtgagcgcgtcgcacaaaatcagacggccttcggcatcggtgttcaacacttcgatggtcagccctttcatacttttcacgacatcgcccggtttgtttgccgcgccggaaggcatattttcacaagtggcgacgacggcaatcaggttaatcggcagttgcagtttgacggcggcgcagaaggtgctgatgacggttgccgctccgcacatatcaaacttcatttcgtccatgttcaggccgggcttgagggagatgccgccggtgtcgaaggtaatgcctttgccgaccaataccacaggcgcggcttctttgtcggctgcaccgaaatagctcagttcgaccaaatagggggcttccgcgctgcctttggcgaccgaccaaaacgaacccatgttttctttgatgtagtctttttcgatgattttggcgtgcgcgcccagtttttcggcttcggctttggcggtgcgcgctaaaaattcgggcgtgcattcgttgggcgcggcgttgcccaagtcgcggcagaggctttgtccgtaaacttgcgcttcggcgacgcgcaaggcttctttgacggcggcttcgtgcgcggtatggaacacggcagtttcaaatttggcgggcttggcttcttttttgtagcggtcgaaacggtaggcggcattgccgaacgcaatcgcaaacgcttcggcaacggctgcagcctgcgcttcttcaaagacgtgaacgtccacattgaccgtttcctgattttgcgcccatttggcggcttcggcggcggccttgttcaatgcggcgcggccggtgcttttcagacagcatacggcaacagcctgcaaaccgttgcctgtcgggatttttgtgtcggcaaaattttgaccttcttcaagcgaagacaaaagggcaaggacggtcgggttgctcagttgcgatgcttcggtgcagacaaataactgtgcgcctgcctgctgttcctgcaagatttcggtttttgtgctaaattccacgtttattctcctgattgagacggttgtcggtagttttcggacggcctttcgctcaaaagaccgtctgaagacggctggcacgattgtaccccatttgaagcaccgtctgaaaccttgcgcggacaatccgcctgcgccgaaccgcttaccgcccccctgaccgcgattctatgatttatcaaagaaacctcatcaaagaactctcttttaccgccgtcggcattttcgtcgtcctcttggcggtattggtctccacgcaggcaatcaacctgctcggccgtgccgccgacgggcgtgtcgccatcgatgccgtgttggcattggtcggcttctgggtcatcggtatgacgccgcttttgctggtgttgaccgcatttatcagtacgttgaccgtgttgacccgctactggcgcgacagcgaaatgtcggtctggctatcctgcggattggcattgaaacaatggatacgcccggtgatgcagtttgccgtgccgtttgccgttttggttgccgtcatgcagctttgggtgataccgtgggcagagctacgcagccgcgaatacgctgaaatcctgaagcagaagcaggaattgtctttggtggaggcaggcgagttcaacagtttgggcaagcgcaacggcagggtttattttgtcgaaaccttcgataccgaatccggcatcatgaaaaacctgttcctgcgcgaacaggacaaaaacggcggcgacaacatcatcttcgccaaagaaggtaacttctcgctgaacgacaacaaacgcacgctcgaattgcgccacggctaccgttacagcggcacgcccggacgcgccgactacaatcaggtttccttccaaaaactcaacctgattatcagcaccacgcccaaactcatcgaccccgtttcccaccgccgtaccattccgaccgcccaactgattggcagcagcaacccgcaacatcaggcggaattgatgtggcgcatctcgctgaccgtcagcgtcctcctactctgcctgcttgccgtgccgctttcctatttcaacccgcgcagcggacatacctacaatatcttgattgccatcggtttgtttttaatttaccaaaacgggctgaccctgctttttgaagccgtggaagacggcaaaatccatttttggctcggactgctgcctatgcacattatcatgtttgccgttgcactcatcctgttgcgcgtccgcagtatgcccagccagcccttctggcaggcggttggcaaaagtctgacattgaaaggcggaaaatgaacctgatttcacgttacatcatccgtcaaatggcggttatggcggtttacgcgctccttgccttcctcgctttgtacagcttttttgaaatcctgtacgaaaccggcaacctcggcaaaggcagttacggcatatgggaaatgctgggctacaccgccctcaaaatgcccgcccgcgcctacgaactgattcccctcgccgtccttatcggcggactggtctccctcagccagcttgccgccggcagcgaactgaccgtcatcaaagccagcggcatgagcaccaaaaagctgctgttgattctgtcgcagttcggttttatttttgctattgccaccgtcgcgctcggcgaatgggttgcgcccacactgagccaaaaagccgaaaacatcaaagccgccgccatcaacggcaaaatcagcaccggcaataccggcctttggctgaaagaaaaaaacagcattatcaatgtgcgcgaaatgttgcccgaccatacgcttttgggcatcaaaatttgggcgcgcaacgataaaaacgaattggcagaggcagtggaagccgattccgccgttttgaacagcgacggcagttggcagttgaaaaacatccgccgcagcacgcttggcgaagacaaagtcgaggtctctattgcggctgaagaaaactggccgatttccgtcaaacgcaacctgatggacgtattgctcgtcaaacccgaccaaatgtccgtcggcgaactgaccacctacatccgccacctccaaaacaacagccaaaacacccgaatctacgccatcgcatggtggcgcaaattggtttaccccgccgcagcctgggtgatggcgctcgtcgcctttgcctttaccccgcaaaccacccgccacggcaatatgggcttaaaactcttcggcggcatctgtctcggattgctgttccaccttgccggacggctcttcgggtttaccagccaactctacggcatcccgcccttcctcgccggcgcactacctaccatagccttcgccttgctcgccgtttggctgatacgcaaacaggaaaaacgttgaaccaatgccgtctgaacctctcttcagacggcatttgttttcattgacacattcccacagacagatagccgttccctattacattacctgtcataacagttccatttttgttaaaactagtctatgatagcggtacaaatattgtttacaatatttaacgcaaatcatttgcaacccgacaaaagaaaaacagaaaaaggaacaaagagatgttagaagcctatcgtaaagccgccgccgagcgcgccgccctcggcattcccgccctccctttgaacgcgcagcaaaccgccgatttggttgagctgctgaaaagcccgcccgcaggcgaaggcgagttcttggtcgaactgcttgcccaccgtgttccgcccggtgtggacgatgccgccaaagtcaaagcctcattcctggctgccgttgccgaaggcagcgcgtccagcccgctgatctcccccgaatatgcgaccgaactcttaggtacaatgctcggcggttacaatattcacgccttaatcgaactcttggacgacgacaaactcgcgtccattgctgccaaaggcttgaaacatacgcttctgatgttcgattccttccacgacgttcaagaaaaagccgaaaaaggcaacaaatacgcgcaagaagttttgcaatcttgggcagatgccgaatggttcgcctcacgcgccaaagttcccgaaaaaatcaccgttaccgttttcaaagttgacggcgaaaccaatacagacgacctctcccccgcgcccgacgcgtggagtcgtcccgatattccgctgcacgcgctggccatgctgaaaaacccgcgcgacggcatcacgcccgacaaaccgggcgaagtcggtccgattaaattgttggaagaactcaaagccaaaggccatccggttgcttacgtcggcgacgtggtcggtactggttcttcacgcaaatccgcgaccaactccgtcatttggcataccggcgaagacattccgttcgtgccgaacaaacgcttcggcggcgtatgtttgggcggcaaaatcgcgccgattttcttcaatacccaagaagattccggcgcgctgccgattgaagtcgatgtatctgctctaaaaatgggcgatgtcgtcgatatcctgccttatgaaggcaaaatcgtgaaaaacggcgagactgttgccgagtttgaattgaaatcacaagtattgctggacgaagtgcaagccggcggccgtatcaacctgattatcggccgaggtctgaccgccaaagcgcgcgaagccctgaaactgcctgcctctactgcattccgcctgccgcaagcgcctgccgaaagcaaagccggtttcaccttggcgcaaaaaatggtcggccgcgcctgcggtctgcccgaaggacaaggcgtgcgcccgggtacttactgcgaaccgcgtatgacgacggtcggctcgcaagacacgaccggcccgatgacccgcgacgagttgaaagacttggcttgtttgggcttctccgccgatatggtgatgcagtctttctgccacaccgccgcctatccgaaacctgtcgatgtaaaaacccataaagaactgcccgcctttatttccacccgtggcggcgtgtcactgcgtccgggcgacggcgtcatccactcgtggctcaaccgcctgctgctgcccgataccgtcggcaccggcggcgacagccatacccgtttccccatcggtatttccttccccgccggctccggcttggttgcctttgccgccgcaacgggcgtaatgccgctcgatatgcccgagtctgtattggtacgcttcagcggcaagctgcaaccgggcgtaaccctgcgcgatttggtgaacgccatcccgctgtacgcaatcaaacaaggtttgctgaccgttgccaaagccggtaagaaaaacatcttctccggccgcatcctcgaaatcgaaggcctgcctgatttgaaagtggaacaagcctttgaattgaccgacgcatccgccgaacgctccgccgccggctgtaccgtgaagctcaacaaagagccgattatcgagtacatgaaatccaacgtcgtgttgatgaaaaacatgattgccaacggctatcaagacccgcgcactttggaacgccgcatcaaagctatggaaaaatggctggcaaatcccgagttgctcgaagcggataaagatgccgaatacgccgccgtgattgaaatcaacatggacgacatcaaagagccgattatcgcctgcccgaacgacccggacgacgtgtgcttcatgtccgaacgctccggcaccaaaatcgacgaagtattcatcggttcgtgtatgaccaacatcggccacttccgcgccgcctccaaacttttggaaggcaaggcagacacccccgtccgcctgtggattgcgccgccgaccaaaatggacgcgaaacaattgtccgacgaaggacactacggcgtactcggacgtgccggcgcgcgtatggaaatgccgggttgctccttatgtatgggtaatcaggcgcaagtacgcgaaggtgcgaccgttatgtccacctccacccgcaacttcccgaaccgtttgggtaaaaacacctttgtttacctcggttcggcggaattggcagcgatttgctccaaactgggtaaaatcccgaccgttgaagaatatcaagccaatatcggcatcatcaacgaacagggcgataaaatctaccgctatatgaacttcaacgaaatcgacagctacaacgaagtagccgagaccgtgaacgtttaatccccgtcatccgtatgaagtaagggattgaccgcaatgccgtctgaacaaccttcagacggcattgcaacattccgctaacccttctttccgcaaacgctgcaaatacggcgttcacgcccccacataaaggaaacgacagtgaacctgaaaaaccgccattttctgaaacttttagacttcacgccggaagaaatcaccgcctacctcgaccttgccgccgaattgaaagccgccaaaaaagcagggcgcgagattcagcggatgaaagggaaaaacatcgccctgatttttgaaaaaacctctactcggacgcgctgcgcgtttgaagtcgccgcgcgcgatcaaggcgcgggagtgacttatttagagccgtccgccagccaaatcgggcataaggaaagcatcaaagacaccgcccgcgtgttgggcaggatgtacgatgccatcgaatatcgcggtttcggtcaggaagttgttgaagaattggcgaaatacgcgggcgtacccgtgttcaacgggctgaccaacgagttccatcccacacaaatgcttgccgacgcactgactatgcgcgaacacagcggcaaacctttgaaccaaaccgcgtttgcctacgtcggcgacgcgcgttacaacatgggcaattccctgctgattttaggggcaaaattggggatggacgtgcgtatcggcgcaccgcaaagcctgtggccgtctgaaggcattattgccgccgcacacgccgccgccaaagaaaccggcgcaaaaattaccctgaccgaaaacgcgcatgaagccgtgaagaatgttgattttattcataccgatgtgtgggtcagcatgggcgagccgaaagaagtctggcaggaacgcatcgatttgctgaaagattaccgcgttacgcccgaactgatggcggcatcgggcaatccgcaagtcaaattcatgcactgcctgcccgccttccacaaccgcgaaaccaaagtcggcgaatggatttacgaaaccttcgggctgaacggtgtggaagttacagaagaaatattcgaaagccccgccagcatcgtgttcgatcaggcggaaaaccgtatgcacacgattaaagcggtaatggtcgcggctctgggcgactgacagaactgtgcctgtttaaattcatccgcaacacagataccgtctgaacacgatgttcagacggtatccatatatagtggattaaatttaaaccagtacggcgttgcctcgccttgccgtactatttgtactgtctgcggcttcgtcgccttgtcctgatttttgttaatccactataaaaaaactgcctacacgatgtgtaggtagtcccgtttgaaaacaatcagtttttgtcttggtcaaccaatttgttggcagtaatccaaggcatcatggcacgcagttgtgcgccgactttttcaacttggtggtcggcattcagacggcggcgggcagtcatagacgcatagttgacattaccctcttggataaacatttttgcgtattcgccggtttgaatgcgtttcagggcattgcgcatggcttctttgctggaagcattgaccacttcagggccggtaacgtattcgccgtactccgcattgttggaaatggagtagttcatattggcaataccgccttcgaaaatcaggtcaacgatcagtttcatttcgtgcagacattcgaagtaagccatttcaggcgcgtaaccggcttcggtcagggtttcaaaacccgccttgatcaactcgaccacgccgccgcacaatacggcttgttcgccgaacagatcggtttcggtttcttcgcggaaagtggtttcaatcacaccgcctttggtgccgccgttggcagccgcataagacagggcgatgtctttggctttgccggaattgtcttggtaaacggcaatcagagaaggcacgccgccgccgcgtttgtattcactgcgtacggtatggcccggacctttgggggcaaccataatcacgtccaagtcggcacgcggaacgatttggttgtagtgcacgttgaagccgtgtgcaaatgccagcgttgcgccttctttcaaattggctgtaacttcggcgtgatagacggcaggcatggtttcgtcaggcagcagcagcataacgacatcggcttctttggtcgcttcagcaacggttttgacgacatgaccggctgcttcggcttttttccaagaagaaccttggcgcagaccaatcaccacgtttacacccgaatctttcaggttggcggcatgggcatgaccttgcgaaccgtaaccgatgatggcaacggttttgcctttgattagggacagatcggcatctttatcgtaatagacttgcatttgatttcctttaaggtaaatggttgtcgaagccttaaaatgttgagcggcttcggacgggttaaacagagtgtgccgcttaatcggcaacttcattcatcaatacgatttccaacgcttcggttttgccgtcgacggactggacgaaggcttggaaatgcgcgctggcgttatgttcgtcaatagctgcttgagatttccaattttccacgaaaacaaaacggttcggtttgccgatttcctgatggagatcgtagctgatgttgccctcttctgcacggctggctttgaccagttctttaaactgtgctgccagtgtttctgtgtattccggtttgacggtaaccagtgcgacaattttaatgttcgacataaatctctcctgccgttcgtttttcagacgacattcaaataccgtgccgtctgaaaggttacggcgttaaattttcaaaatacgctcaccgcgaccgatgccggccgcgcctgtgcgtacggtttccaaaatttgggcgcgtccgaccgtttccaaaaaggaatccagcttgtctgtcgagccggtaatttcaatcgtatagctgcggtcggttacgtcgatgatgctgccccggtagatttcggtcaagcgtaaaaattcgtcgcggtctttgccggcggcacggacttttaccaacatcagttcgcgttcgacaaaacggctttcattcaaatcgaccactttaatcacttcaatcaatttattgagttgcttggtaatttgttcgatgacctgctcgtcgccgtgggtaacgatggtcatccgtgacagggttttgtcttcggtcggcgcaaccgccaaagaatcgatattgtaatcgcgtgcagagaacaaaccgaccacgcggctcatcgcacctgattcgttttcaatcagaacagataagatatgtcgcatttgtctctccttacgcctttccgtccgcacgcatatgcggcggaagtaccatttcgtccaaacctttgccgttgccgaccatgggcatcacattctgtttctggtcggtcaggaagtcgataaacaccagcctgtctttttggttcaatgcttccaacaacgcaccttccacatcagacttcttgtccacgcggataccgatatggccgtatgcctcggcaagtttgacgaaatcgggcaaagaatcgaaataggtttccgactctcgtccgccgtaatatatttcctgccactggcgtaccataccgagataaccgttgttcagcgtaatgacgttaaccggaatccgatattggaaacaggtggacagctcttggatgttcatctggatcgagccgtcgccggtgatacagaatacgtcttgatccggggcggcaagttttgcaccaatcgcataaggcagacccacgcccatcgtacccaaaccgccggaattgagccattggcgcggacgttcgaagggataatattgagccgcaaacatttgatgctgccctacatccgatgtgatgattgccgaattgccggtaatctcggcaagcttctgaatcacatattgtggcttgataatttcgctgccgttgtcaaaccacaagcaatctcgggaacgccattcctctatggttttccaccatttgcccaaagcatcttcagacggcacggactcttgtttttgccacagcgcaaccatctcggacaaaacgtttttcacgtcgccgacaatcggaatgtccaccttcacgcgtttggcgatgctggaaggatcgacatcgatatggataaccttcttcgccttctcgaaaaatttggacggtacggaaaccacacggtcgtcaaaacgcgcacctacggcaagaacgacatccgcattctgcatggcaaggtttgcctcgtaagtaccgtgcataccgagcataccgaggaattggcggtcgccggaaggataagcgcccaagcccatcagcgtacccgtgcacggagcacccgtcattcggacaaatcgggtcagctcttcagaagcattacccaacaccacgccgccgccaaaatagacgaccggacgtttggcagatgccaacatctgcacggcctttttaatctgaccgatatgtccttgaacaaccggttgatacgaacggataaaaatgtcttcctgaggatagctgaatttcgccatcgcctgcgtaacatctttcgggacatcaaccaccacgggccccggtcggccgcttgcggcaatttggaacgcctttttaatggtttccgccaactcattgatgtccgtaaccaggaaattgtgtttgacgcacggacgggtaatacccaccgtatcaacttcttggaacgcatccgtaccaatcagggaattgcctacctgcccgctgatgaccaccatcggaatcgaatccgtataggcagtagcaataccggtcagtgcattggtaacgcccgggccggatgtaaccaatgccacgcccaccttaccgctgacgcgcgcatacgcatctgccgcgtgtactgccgcctgctcatggcgggtaagaatgtgtttgaatttattgagttggaaaagggcatcgtagatttcgataaccgcaccgccgggataaccgaaaacgtactcgacaccttcggctttgagactctgcactatgatttgcgcgcctgataactgcataacgacctcttttatacggtttcaaaccaatagggacaaaccgctttgccacagcacctgtaatgcaattccaccaagcagcgatttagggtacgcgcattgggggaacacggcaacagacggattatccaatcaattggaaaggaacacagagtttgtgaaaaagagtagaaacgataacgcaaaccgacagttcaatcaagaaaaatctttcatcttttaatattttttgaaagcagagaaattattgattgattttaaaagaataaaatcaggagtaccttttttgaaagatggaaattgttgacagtttgtgtaggaggggcagatgtgaaaaacccttcttcgatatcaagaattgtaaaatttacagggtttcatcccaataaagactcgggatattgattgaacttgattttatttttgatatatcaaaaatattcccaaccatacttcctgaaaatggctcattgcaccggactgtattggacggcattgacagaaccaagagggctaacaacgacttaatatattgattgtatagtggattaacaaaaatcaggacaaggcgacgaagctgcagacagtacaaatagtacggaaccgattcacttggtgcttcagcaccttagagaatcgttctctttgagctaaggcgaggcaacgccgtactggtttaaatttaatccactatatttagttttatctatttcattaaacagcaatagacaaaaaaaataaccgctctaaaagcggttgtggtgcccagggtcggactcgaaccgacacaccttgcggcgggggattttgagtcccctgcgtctaccaatttcgccacctgggctggtgaagaagtcgtcattataatggcttttgaaattctgtaaaccttttttttgaaattattttatctgtttttattttatttttgattttaaatagaatttttattattttaatcttactgttctttccgctccaaagattctgtatgattcggcaattcctgccgtgcagacaacgtaaaaaaatactacattaaatctgccaaacgcgttaagatggaaatattcaaattccgtacgaatcaggttttgctatttattcttgggagattgtcatgttttccgtaccgcgttcctttttgccgggcgttttcgtacttgccgcgcttgccgcctgcaaacctcaagacaacagtgcggcgcaagtcgcttcttcaagtgcatccgcgtcggctgcggaaaatgcggcaaagccgcaaacgcgcggtacggatatgcgtaaggaagacatcggcggcgatttcacgctgaccgacggcgaaggcaagcctttcaacctgagcgatttgaaaggcaaggtcgtgattctgtctttcggctttacgcactgtcccgatgtctgcccgacagagcttttgacgtacagcgacacgttgaagcagttgggcgggcaggctaaggacgtgaaagtggtgttcgtcagcatcgatccggaacgcgacacgcctgaaatcatcggcaagtatgccaaacagttcaatccggactttatcggtctgacggcaacgggcggccaaaacctgccggtcatcaagcagcaataccgcgtggtttctgccaaagtcaatcaaaaagacgacagcgaaaactatttggtcgaccactcttccggtgcgtatctcatcgacaaaaacggtgaggttgccattttctcgccttacggaagcgagccggaaacgattgctgccgatgtaaggaccctgctctgataaaaccgtatgccgtctgcaccgtcggcgcctattcagacggcattattgtttcaaccgacaaaggacatccacaccatgcaggataatgctttgaccatcgccttatccaaggggcgcatttttgaggagacgctgccgctgcttgccgctgccggcattgttccgactgaagagcctgaaaaatcgcgcaagctgattatcgggacgaaccatgaaaacatccgccttgtcattgtccgcgcaaccgatgtgccgacttatgtccgctacggcgcggcggacttcggcattgcgggcaaagacgtgctgatcgaacacggcggcacggggctttaccggcctttggatttggagattgccaagtgccgcatgatggttgctgtgcgtaaagggtttgattacgaagcagcttcgcaacccggatgccgtctgaagattgccacaaagtatcctgaaatcgcggcatctcattttgccggcaagggtgtccatgtggacattatcaaactgtacggctcgatggaacttgcgccgctggtcggcttgagcgatgcgattgtggacttggtttcgacgggcaacaccttgaaggcaaacggcttggaagcagtcgaacacatcgtcgacatttccagccgcctggtggtcaacaaggctgctttgaaaacgaaatacgcgctgctggagccgattattcaggcgttcggcggcgcagtgaaggcgaagtaagcatccatttgaataaagatgcgttttcagacgaccctatccgttcccgccgacaggtcgtctgaaaatatcaccggcagtaaactgtataggagaagttaaaatggttgcaaaaataaaaaaattctcagattcaaccctttccgttttgaataacggcgagcgtcggttttatgtctattgtctgaccgacctgaaaaaagacaaaatcctctacatcggcaaaggctgcggtaatcgtatcttcgagcatgaatgggttgctagtcgttcacaagatccagtctccggcgagattatcgatcggaaactcaaagccatctccaaatgcaagaaactcggtcgctatatcatcagctatcatctgactgaagtcgaagcactcgccgccgaatctgccttaattcattttgttaaatctgtcttgggtaaaaaactcaaaaataaaattgccgggcatggtccgggtggtattagcgtagaagaactagatcgccgctttggattctcttctctcccacttaacgagattaaccccgacgggctgattctcgccatcaaaatccacaatgctttcgatttagatactgacgaagaattagactaccttttcgacaaccaagacgatgccaacctcaaatcgcgtacgttgggcaactgggttatcggtaaagatgttgcttcaaaagtgaaatacgttatcggcgttcacaccggtctgcaaaacgctgttgtcagtgcatacgaagtggacggttttgaaacaatggttgaggaaaccaaaaacggtagaaaacaatcccgttaccgtttccgcactacctctcgtagcgaagaggtattagccaaactcggtctgcaacaaaaatgcctgcccgaattgaagtttggtagcgggggagaaaaagcgtatatcagacccaaaacagagacagaaactgaacaagagaatattcagacgacccccaatccaaaaataaaaaaggaaaaaaccaaatcatgaaaaaactcaacacccaatcgcccgatttccaagccggactcaaagccctgctggcttttgaaaccgcgcaaaaccccgaaaccgaacgcatcgtcgccgacatttgcgccgacgtgcaaaagcgcggcgatgcggctttgattgaatacaccaacaaattcgatcagacaaacgctaaaagcatcgatgatttaatactcacgcaagccgatttgaacgcggcgttcgagcgcattccgaacgacgttcagacggcattgcagaccgccgcccgccgtgtcgaaagctaccaccaacgccaaaaaatggaatcgtggagctacaccgatgaagacggcacgctgttgggacaacaaatcacaccgcttgaccgcgtcggcatttacgtccccggcggcaaggcggcgtatccgagttccgtcatcatgaacgccatgcccgcccacgtcgcaggtgtgaaagaaatcatcatggtcgtgccgacaccaaaaggcgaacgcaacgacatcgtacttgccgccgcatacgtcgccggcgtaaccaaagtcttcaccgtcggcggcgcgcaggcggttgccgccctcgcctacggcacggaaaccatcccccaagtcgataaaatcaccggtccgggcaacgccttcgtcgccgccgccaaacgccgcgtgttcggcgtggtcggcatcgacatggtggcggggccgtctgaaatcctggtcatcgccgacggcacgacacctgccgattgggtggcgatggatttgttcagccaggccgaacacgacgaaattgcccaagccatcctcatcggcacgtcgcaagcgtatctcgacgaagtagaagccgctatggaccgcctgatcgaaactatgccgcgccgcgacatcatcgaagcctcgctcggcaacaggggcgcgatgatactcgccaaagacttggacgaagcctgcgaaatcgccaactacatttcccccgaacacttggaactgtcagtcgaaaacccgcaggaatgggcgaaaaaaatccgccacgccggtgcgattttcatgggacgctacaccggcgaaagcctcggcgactactgcgccggtccaaaccatgtgttgcccaccagccgaaccgcccgcttttcctcgcctttggggacatatgatttccaaaaacgctccagcctgattcaggtttcggaacagggcgcgcaaaaattaggcgaaaccgccagcgtgctggcacacggcgaaagcctgaccgcccacgcccgcgcggcagagttccgtatgaaataatgccgaaacggcgtacaggcatattccaaccattaaggaaacacgatgaaatccgtccgctccttcatccgcgacgacatacaagctatgtcggcatatcagattgccgacgttccgcccggctttgccaaactcgattcgatggaaagtcccgtccacccttttgccggacatgaaacgctgttgcaggaatggcaggcacggcttgccgccgcgcccatccatctttaccccaatccctccggcagcggtttacaggaagcattacgttcggcgttcgacattcccgactgcgccgacatcgcgctgggcaacggttcggacgaactgatacagttcatcacgatgctgaccgccaaaccgggcgcggcaatgttggcagccgaacccagtttcgtcatgtaccgccacaacgccgcgctgtacggcatggattatgtcggcgttccactgaacggagatttcaccctcaacctgcccgccgtcctcgaagccgtcaggaaacaccgccctgccctgacctttatcgcctaccccaacaaccccaccggcgtatgcttcacgcgtgccgaaatcgaagccgtcatcgaagcttcagacggcatcgtcgtcgtcgatgaagcctacggcgcattcaacggcgacagcttcctgccgcaggcaggcaggattcccaacctgatagtcttacgcaccctcagcaaaatcggttttgccggactgcgtatcggttatgcggcaggctgccccgaagtcatcggcgaactgcaaaaaatcctgccgccctacaatatgaaccaattgagcctgaccactgccaaactcgccctgcggcactacggcattatctctgccaacatcgacagcctgaaaaacgaacgcgaacggatgttcgccgaattgggcaaaatatgccgtctgaacaccttttcaagtcaggcaaacttcattaccatacgcgtacccgatgccgatttgttgtttgacacgctcaaacaaaaccgcatcttggttaaaaaactgcatggcgcgcacccgcttttggaacactgcctgcgcattaccgtaggcagccccgcacaaaacgatgccgttctcaacatcattcgccaactttactgccaaccaacggatttcctatgaatttgactaaaacacaacgccaactgcacaactttctgaccctcgcccaagaagcaggttcgctgtccaagctcgccaaactctgcggctaccgtacccccgtcgcactctacaaactcaaacaacgccttgaaaagcaggcagaagacccagatgcacgcggcatccgtcccagcctgatggcaaaactcgaaaaacacaccggcaaacccaaaggctggctcgacagaaaacaccgcgaacgcactgtccccgaaaccgccgcagaaagcaccggaactgccgaaacccaaattgccgaaaccgcatctgctgccggctgccgcagcgttaccgtcaaccgcaatacctgcgaaacccaaatcaccgtctccatcaacctcgacggcagcggcaaaagcaggctggataccggcgtacccttcctcgaacacatgatcgatcaaatcgcccgccacggcatgattgacatcgacatcagctgcaaaggcgacctgcacatcgacgaccaccacaccgccgaagacatcggcatcacactcggacaagcaatccggcaggcactcggcgacaaaaaaggcatccgccgttacggacattcctacgtcccgctcgacgaagccctcagccgcgtcgtcatcgacctttccggccgccccggactcgtgtacaacatcgaatttacccgcgcactaatcggacgtttcgatgtcgatttgtttgaagaatttttccacggcatcgtcaaccacagtatgatgaccctgcacatcgacaacctcagcggcaaaaacgcccaccatcaggcggaaaccgtattcaaagccttcgggcgcgccctgcgtatggcagtcgaacacgacccgcgcatggcaggacagaccccctcgaccaaaggcacgctgaccgcataaaaaaccataccgtctgaaacacccgcaggcttttcagacggtatcggaacagataagattacactacactacaaacagaaaaggagtaaacatcatgtccgcaaacgaatacgcacaaatcggctggataggcttagggcaaatgggtctgcctatggtaacgcggctcttggacggcggcatcgaagtcggcgtatacaaccgctcgcccgacaaaactgcccccatctccgccaaaggcgcaaaagtttacggcaacaccgccgaactcgtccgcgactatcccgtcattttcctgatggtttccgactatgccgccgtgtgcgacatcctgaacggagtccgcgacggattggccggcaaaatcatcgtcaacatgagcaccatctccccgaccgaaaacctcgccgtcaaagcacttgtcgaagccgcaggcggacagtttgccgaagcacccgtttccggatcggtcgggcccgccaccaacggcacgctgctgattctgttcggcggcagcgaagccgttttaaacccgctgcaaaaaatattttccctcgtcggcaaaaaaaccttccatttcggcgatgtcggcaaaggttcgggcgcgaaactcgtcttgaactcgctcttgggcattttcggcgaagcgtacagcgaagcgatgctgatggcgcggcagttcggcatcgataccgacaccatcgtcgaagccatcggcgrctcggcaatggactcgcccatgttccaaaccaaaaaatccctgtgggcaaaccgcgaattcccgcccgccttcgccctcaaacacgcctccaaagacctcaacctcgccgtcaaagagcttgaacaggcaggcaacaccctgcccgccgtcgaaaccgttgctgccagctaccgcaaagcagtcgaagccggctacggcgaacaggacgtttccggcgtttacctgaaactggcagaacactgattgccttttccaaacacaatgccgtctgaacatatttcagacggcatttttatcaccccacgcttaaaatcagtcccgattatgactatatagtggattaacaaaaatcaggacaaggcgacgaagccgcagacagtacaaatagtacggaaccgattcacttggtgcttcagcaccttagagaatcgttctctttgagctaaggcgaggcaacgccgtactggtttttgttaatccactataatccgcacaaatttagtcaatatcaagaccaattatgaaccaactcgaccaacttggcacccgtatcaacctgatttgcaatgtcttcgacaaatggatcgggcagcaggatctgaattacaacctctttgccgtactttataccctggcaaccgaaggcagccgcacgcaaaagcatatcggcgaaaagtggagcctgcccaaacagaccgtttcaggcgtatgcaaaacccttgccggacaagggttgattgaatggcaggaaggcgaacaggaccggcgcaaacggttgctgtcgttgaccgaaacaggcaaagcctatgccgcacctttaacagaaagcgcgcaggaattcagcgacaaagtatttgccacattcggcgacaagcgcacaactcggctgtttgccgatttggatgcactggctgaagtgatggaaaaaacaatctcggaaaataaaaaataggggggcaaatatgtggaaaatgttgaaacacatagcccaaacccaccgcaagcgattgattggcacattttccctggtcggactggaaaaccttttgatgctggtgtatccggtgtttggcggccgggcgatcaatgccgtgattgcgggggaggtgtggcaggcgttgctgtacgctttggttgtgcttttgatgtggctggtcggtgcggtgcggcggattgccgatacgcgcacgtttacgcggatttataccgaaatcgccgtgccggtcgtgttggaacagcggcagcgacaagtcccgcattcggcggtaactgcgcgggttgccctgtcgcgtgagtttgtcagcttttttgaagaacacctgccgattgccgcgacatccgtcgtatccatattcggcgcgtgcatcatgctgctggtgctggaattttgggtcggcgtgtcggcggtgggcatacttgcgttgtttttatggcttttgccacgttttgccgccatcagcgaaaacctgtatttccgcctgaacaacagcttggaacgcgacaaccactttatccgaaaaggcgaccggcggcagctgtaccgccattacggactgcttgcgcgcctgcgtgtgctgatttccaaccgcgaagccttcggctatctctgcgtcggcacggcgatgggtattttgttcggctttgcttttgtgatgatgacgctcaaaggctacagcagcgcggggcatgtctattcggtcggcacttatctgtggatgtttgccatgagtttggacgacgtgccgcgattggtcgaacaatattccaatttgaaagacatcggacaacggatagagtggtcggaacggaacatcaaagccggaacttgaaaaatgccgtctgaacacgcttcagacggcatttccatccgttcggcaaactacatcacatccgcccgccggttgacaagtttggcaaacaacttttcaacagaagcttccgcctgcaaaccaatgcgctggatcaggctttgcttctcctgatatttcacttcgataacctgtttgttttcaaacgctttcaacaacaaatcatcactggtcgaaatctcgtcaatcaagttcaacgccaacgcctgccgaccgaaccaatgctcgcccgttgccacttcctcaatatccaattgagggcggttctcgctgacaaactgcttgaacaactgatgcgtttcctccagttcctgtcggaatttctgtttgcccttttccgtattttcacccataaaagtaaccgtgcgcttaaattcgcccgccgtcatcacatccacatcaatatcatgttttttcaacaggcggtggatattcggtacttccgccaccacacccaccgaaccgacaatcgcaaacggagcggaagcaattttatccgccacacacgccatcatataaccgccgctcgccgccaccttatcgacggcgacggtcagcggaatattgcgttcgcgcaaacgcytaagctgcgaagccgccaaaccgtaaccgtgaaccacgccgcccggactttccaatctgagcagaacctcatcttcaggcttggcaatcaaaagcaccgccgtaatctcatgacgcaaggattctacggcgtgtgcatacaaatcgccgtcaaaatccaacacaaaaaggcgggatttttgcgtttcggcagatttctccccaccctccttcaaacgctttttctctgctttggcttccgccttttcctttttcttttcctctttttcctgatgttttgcctcttccccgcttaaaaagaatgcttcaaacgattgccgctgttttttataattttccgaaaaatccgtcagtacgacactgccgctttccgactgtttcttactctgtacgatagccaacacaatcagcgcaattgcgccgaacacggtaagcagttcgagcaggaaaataccgtaattcagtaaaatttctttccacattgattggatttcctcttgttcaggcatgaacatgtcaatattgtccatcaccgtccgacagataaaaaaataaccgcttggagcggcattgtcattttcagcttggtgcccggagccggaatcgaaccggcacgggatgtttagtcccgacggattttaagtccgttgtgtctacctatttcaccacccgggcatttgtgaaaggtggaggcgggggcgcggattttaaccggcctgtatgaagattgcactcctcatagcataaacactctgccaccccgccatagtacgataatggaggcgagagtcggaatcgaaccggcgtagacggatttgcaatccgctgcataaccactttgctatctcgccctaaaactggcttatctaaaaaacttggagcgggaaacgagtctcgaactcgcgacctcaaccttggcaaggttgcgctctaccaactgagctattcccgcgcgttcaaacatatcggtttttggagcgggaaacgagtctcgaactcgcgacctcaaccttggcaaggttgcgctctaccaactgagctattcccgcgttgatatgtttgaaataaaacttggagcgggaaacgagtctcgaactcgcgacctcaaccttggcaaggttgcgctctaccaactgagctattcccgcaatgattgcggaagaatgaaatttttggagcgggaaacgagtctcgaactcgcgacctcaaccttggcaaggttgcgctctaccaactgagctattcccgcccgatttcattctccgatatcgaagagacacaattattatggattctgtttttgccgtcaagctatttttatgtttttttcaggcgatttctttccacgccattttcagataatacagcatcgaccagactgtcagcaaagatgcgataaacatcaatacattgccgatgaatgcgaggttaaatccataaaaatcgggaaaattcagcagcagcaggaagattgccagcatttgcgcggcggttttaaacttaccgacggtggcgacggcaacgctgttccttttgcccatttgcgccatccattcgcgcaatgcggaaatggtaatttccctgccgatgatgatcatggcaaacaaaacataggtccggtcgagtttgaccagtaaaagcaaagagacggcgaccatcagcttgtcggcaacgggatcgaggaaggcgccgaaatccgaggtctgtttccacaaccttgccaaaaatccgtcaaaccagtcggtcaaggcggcaacggcaaaaatgacggcggcggtgagattaatcgtttcctccgcgaaccacggaaaaggcaggtaaaaaagggctgtcaggacaggaatgagcaagaccctcaaccatgtgaggaagatggggagattccaaggcatcggttttctctgtgcagactgtaaagttgtgattataacggttatcctcataacccaaaacgtaaaattgctgcatgggcattcccccgccccgccaatctgttttcacattcttttcaaacgcaggaaaatggcgggcaataaaagcaaaatacccagtttcaggctgaaaacggcaggttgtgccaacacttcgacaaggcggtcttccgtgcgggcaaaatctttattgcttatagacactgccactgttgcggtattccaacagaacgccgtttaaaaaacctttgccgacggtttcgcttaaaacggctctaacctgctccgccctgatggttctgccgatattgccgcctgtgcacaaactgtcgaacccatagcaggaaagccggtaatgctgcccgtctgcatccagtttgattgcccgtccgctgcggttgagggcggtaacggtcaattccgcatattcgaatgttttttcttgttcgtgaaatgccgtcaggtaaggtgcaataaaaacggcggacaacagcagacagcttatggcggcaaaccatacccagcgataatatagtggattaaatttaaaccagtacagcgttgcctcgccttagctcaaagagaacgattctctaaggtgctgaagcaccaagtgaatcggttccgtactatttgtactgtctgcggcttcgtcgccttgtcctgatttaaatttaatccactatatttcacgcttaccccttgtttctcaaatgccgtctgaaataagcggcttaatatattgtttacagtattgggaagcataacagacaaaatgccgtctgaaatattttcagacggcatttcttatccgaaacggattatttttgcgtttcaaccgcttccaatgcacgcagggcataagtgtaagcggcacccgcattcagggcaatggcggttgccaatgcacctgcgatttcgctgtcggtcgcaccggctttggtggcggcggcggcgtgaacactgatgcagctctcacaacgtgtagtaatggcaacggcgatggcaatcagttcgcgtgttttagcatcaagtgcctctgcagctgccgcttgttccaatgcgccgtaggcctgcagcattttaggatgcgccttacccagctcgccgaacgattttttaaccaatgcggtatgttctttccaatctttaaacattttcttttcctttctcttgcgtttaaccctgatacgcgcttgcgtatctgttttcgatgtgcgtattattgcaattattcagttgtgtttctcgtttaatcatctcattttatggttcaaaaagatttatggacattctggacaaactggtcgatttcgcccaattgacgggcagtgtggatgtgcagtgccttttgggcggacaatggtcggtacggcatgaaaccttgcaacgcgaaggattggtacacattgttacatcgggcagcggctatctctgcatcgacggcgaaacttccccgcgtccggtcagtacaggggatattgtatttttcccgcgcggcttgggtcatgtgttgagccacgacggaaaatgcggagaaagtttacaaccggatatgcggcagcacggtgcgtttacggtcaagcagtgcggcaacggacaggatatgagcctgttttgcgcccgtttccgctacgacacccacgccgatttgatgaacgggctgcctgaaaccgtttttctgaacattgcccatccgagtttacagtatgtggtttcaatgctgcaactggaaagcaaaaaacctttgacggggacggtttccatggtcaacgcattgtcgtccgtcctgctggtgcttatcctgcgcgcctatctcgaacaggataaggatgtcgaactctcgggcgtattgaaaggttggcaggacaaacgtttgggacatttaatccaaaaggtgatagacaaaccggaagacgaatggaatgtcgacaaaatggtggcggctgccaatatgtcgcgcgcgcaactgatgcgccgtttcaaaagccgggtcggactcagcccgcacgcctttgtgaaccatatccgcctgcaaaaaggcgcgttgctgctgaaaaaaaacccggattcggttttgtcggtcgcactgtcggtaggctttcagtcggaaacgcacttcggcaaggcgttcaaacggcaatatcacgtttcgccgggtcaataccggaaagaaggcgggcaaaaataaatcggggcttcaaacgcaaatgccgtctgaaaaggctttcatacagcatttgcgtaccgcgtcatttcaagggctgcatcttcatcacttccatcaaaaagttggtaaatgcggggttgttgggtttgacatccatatttttccaacgctgctgccagccgcgcaaggcattctggatatacagcttggactgttccgtattgattgcgccccgctggctgtctatcgccgaacgcaggtagatttcatacatactgtcatcgacggcattgcgtccgaccaggcgttttctgaagttgttcagatattgcgccgcctgaaccttggtcattttaccgatacccacctgatagcccaagcgcgtcgcttcatcgctgattttggcaacatccgtccaatgcgaagaggcaaggcggaaaccttttgcaggtgcttccgttttgacggtattgataggattcacggggatttccgtcaatgtgggcacataaatagactggcagccggaaagaactgccgcaatggaaagagggataaggtattttttcatgcccccattataatcaagtttgccttgagaaaacaaattgttcggcaagaaaaataaaatttcggcatcagaagcaggcaaaaacacattccacaagccttgccgcaaggtttacaatccgaccgtccttatcgcaacgaccgtttatggataccgcaaaaaaagacattttaggatcgggctggatgctggtggcggcggcctgctttaccattatgaacgtattgattaaagaggcatcggcaaaatttgccctcggcagcggcgaattggtcttttggcgcatgctgttttcaaccgttgcgctcggggctgccgccgtattgcgtcgggacaccttccgcacgccccattggaaaaaccacttaaaccgcagtatggtcgggacgggggcgatgctgctgctgttttacgcggtaacgcatctgcctttggccactggcgttaccctgagttacacctcgtcgatttttttggcggtattttccttcctgattttgaaagaacggatttccgtttacacgcaggcggtgctgctccttggttttgccggcgtggtattgctgcttaatccctcgttccgcagcggtcaggaaacggcggcactcgccgggctggcgggcggcgcgatgtccggctgggcgtatttgaaagtgcgcgaactgtctttggcgggcgaacccggctggcgcgtcgtgttttacctttccgtgacaggtgtggcgatgtcgtcggtttgggcgacgctgaccggctggcacaccctgtcctttccatcggcagtttatctgtcgtgcatcggcgtgtccgcgctgattgcccaactgtcgatgacgcgcgcctacaaagtcggcgacaaattcacggttgcctcgctttcctatatgaccgtcgttttttccgctctgtctgccgcattttttctgggcgaagagcttttctggcaggaaatactcggtatgtgcatcatcatcctcagcggtattttgagcagcatccgccccactgccttcaaacagcggctgcaatccctgttccgccaaagataaaaaatgccgtccgaacatccttcagacggcatatcgggctttatttccccgccttcacatcctgccactggcgcaccataaacttcaatgccgccggctggataggcaccatgataaagctgtttttcaaatcctcctcggttgggaaaatcgtattgtcgtttttaaattcgtcttccatcagctcacgcgcaggcttgctcgaaggcgcgtaagtaacgaaattgccgtttttcgccgacacttccgggtcgaggaagtcgttgatgtatttgtgcgcgttggcgacgtttttcgcatctttcggaatcacgaaagaatccacccaaatccccacgccctctttgggcatcatcacgcggattttttccttgccgcccgcttcttcggcacggcgtttggcgatgttcaaatcgccgccgaaaccgattgttacgcaggtatcgccgcgcgccaaatcatcgataaagccggacgaagtaaagcgtttgatattggggcggtttttcttgagtagggcggttgcctccctgatgtcttccgtattgctgctgttcgggtttttacccaaatagttcaacaccataggatagatttccgccgcgctgtccaaatagctgatgccgcattgcttgagtttggacgtgtattcggggtcgaacaccaaatcccactggttgtccggcagcttgtccgtacccaaagcctttttcacgcgttcggtattgatggcgaaggtatttgtcccccaataaaacggcacggcgtattcgtggccgggatcgaccccgtccatcagcctcatcatttcggggttgaggtgtttataattgggaatcagcgacttatcgattttctgatacgcacctgccttaatctgcctgcccacaaacgcattggacggcgcgacaatgtcgtaaccggacttgcctgtcagcaccttgctttccagcgtttcatcgctgtcgtacacatcataagtaaccttgatgccgtttttcttttcaaaatcggcaacggtttccggatcgacatattccgaccagttgtaaattttcaatacgttttggttttccgccggtgccggtttttcggcaggcggtttgtccgaaccgccgcacgctgcaagcagcaaagcagtcaggacggccaggggcagatgtttggtcattatcattccttgcatatcgggttggagaaagcggccattatagccgatattggcaacagggcttcagacggcattcaaaatcccgccacactcttccgaaaaccgccgcttccatagctagaaacagggatttgcggtaagataccgccgttcgttttccctgcttttaccatgacaagacatttgagagacattgaaaaaattatgaaaacctccgaactgcgccaaaaattcctaaaattttttgaaaccaaaggccacaccgtcgtccgctcttccagcctcgtgccgcacgacgacccgaccctgctgtttaccaacgcgggcatgaaccagtttaaagacgtattcttaggtttcgacaaacgcccgtacagccgcgccaccaccgcgcaaaaatgcgtacgcgcaggcggcaaacacaacgacttggaaaacgtcggctacaccgcccgccaccacaccttctttgaaatgatgggcaacttctccttcggcgactacttcaaacgcgacgccatccacttcgcttgggaatttctgacttcccccgaatggctcaacatccctaaagacaaactgttggcgaccgtttacgcggaagacgacgaagcctacaacatctggttgaacgaaatcggtatgccgtccgagcgcatcgtccgcatcggcgacaacaaaggcgcgaaatacgcatccgacaacttctggcaaatgggcgacaccggcccttgcggcccctgctccgaaattttctacgaccacggcgaagaaatctggggcggcattcccggcagtcccgaagaagacggcgaccgctggatcgaaatttggaactgcgtatttatgcagttcaaccgcgacgaacaaggcaatatgaacccgcttcccaaaccttccgtcgataccggtatgggcttggaacgcatagccgccgtcatgcagcatgttcacagcaactacgaaatcgacttgttccaagacctgctcaaagccgttgcccgcgaaaccggcgcgccgttcagaatggaagaacccagcctgaaagtcatcgccgaccacatccgctcctgctcgttcctgattgcagacggcgtcttgccttccaacgaaggccgcggctacgtattgcgccgcattatccgccgcgccgtgcgccacggttacaaactgggtcaaagcaaaccgttcttccacaaactcgttgccgatttggtcaaagagatgggcggtgcctaccctgaattgaaagaaaaacaagcccaaatcgaagaagcattgaaaaacgaagaaagccgttttgcccaaacgctggaaaccggtatggctttgttggaaaacgcgctggtcaaaggcggcaaaacactcggcggcgaaatcatcttcaaactctacgatacctacggtttcccatacgacttgactgccgacatctgccgcgaacgcaatatcgaaccggacgaagcaggcttcgagcgcgaaatggaagcccaacgcgcacgcgcacgcgccgcccaaagcttcaaagccaacgcccaactgccttatgacggtcaagacaccgagtttaaaggttatagcgaacgccaaaccgaatccaaagtcctcgccctctacaaagacggcgagcaagtcaacgaattgaacgaaggcgacagcggcgcagtcgtcatcgactttaccccgttctatgcagaatccggcggccaagtcggcgatgtcggctatatcttctcaggcgaaaaccgctttgaagtacgcgatacccaaaaaatcaaagcggccgtattcggtcaattcggcgtacaaacttcaggccgtctgaaagtcggcgacagcgttaccgccaaagtggacgacgaaatccgcaatgccaatatgcgcaaccacagcgcaacccacttgatgcacaaagccctgcgcgatgtattgggcagacacgtcgaacaaaaaggctctttggttaccgccgaatccacccgtttcgacatttcccatccccaagcggtaactgccgaagaaattgccgaagtagaacgccgcgtcaacgaagccattttggcgaacgttgccgtcaatgcagccattatgagcatggaagacgcgcaaaaaaccggcgcgatgatgctcttcggcgaaaaatacggcgaagaagtgcgcgtactgcaaatgggcggtttctctaccgaattgtgcggcggcacacacgtttcacgcaccggcgacatcggcctcttcaaaatcatcagcgaaggcggtattgccgcaggcgtgcgccgtatcgaagccatcaccggcctgaacgcactcaaatgggcgcaagagcaagagcgtttggtgaaagacattattgccgaaaccaaagcccaaaccgaaaaagacgtactggcaaaaatccaagcaggcgcggcacacgccaaagcattggaaaaagaattggcacgcgccaaagccgaactcgccgtccacgcaggcgccaaactcttggacgatgcaaaagacttgggcgcagccaaactcgttgccgcccaaatcgaagccgacgcagccgccctgcgcgaaatcgttaccgatttaaccggtaaatccgacaacgccgtgattcttttagcggcagtaaacgacggcaaagtctccctgtgcgccggcgtatccaaaccgttgaccggcaaagtgaaagcaggcgatctggttaaatttgcagccgaacaagtcggcggcaaaggcggcggcagaccagatttggcgcaagccggcggcacggatgccgacaaattgcccgccgtgttggatagcgtgaaagactgggtcggcgcgaagctggtttgatgtgggaaaggcagcctgaaaggtttcaggctgccttttgtgcaaagaggccgtctgaaaggtctcgtttgccgtaggttgggtcgcgacccaacaaattttgtgaagtataaaaatgttggtcatgacccaacctacctgcctttttgtacaaagaggctatctgaaaggccttgtttgccgtatggtgggtcgcgacccagcagatttttattagggtatgacccaagctacttgctacgataaaaaaggatttttaaatgagcattagccttattggactacacattaccatagcaatcattttgttttttactacaaattttatgggaaaaaaatcatctatatttggctattaccaactgtcttttagcgaagaaaatcactctccggcatttaatattttttacagagcatttacccctatattatttatcgttattttttcttgggttgttactagtcttgaaattcccatttctcttgaaaagataaactatgtagtaatttattattttataattagattgttatctgtatttgtttttgagaaaacacacatagttaactggtttaatcaactaacaatacccatactatccataacattatcatttatagtatataacaaaatgattttgcccaaaagttttctacttccatcctcacaagaagtagctactactttttgaatagcgcttggtggttacatatataatatattaaataatgaatcagggcatttaaaatcttataaagaaagaagagtaaattatgtaaaacacatgcacaaaaaatttgaaagttattttggtaaaattatagataaaataatcaaagaggatagttataataatgatgattttttaaccgataagaaaaaagcactaatatattcagttttaatttatgagaattttaataggggactagtttatagatattttgaaaaaaattattttgtactggtagaataaaaacatttggaataatgcaagtaacctcagcagagtacctttccaatgaggaaagtataaaaaaaggcggaaatattcttatggaaaaatacaatgaaaaatataatgaatctattgatggcaataaaactctctataaatcatattatgaatcaagaagagagagtattaaaaactacaacccagatgcaaaatacattaatgaaattgaatcaatttacatgatgcttggagaaatctatccaaatgcaccagacttcatgtcaccacattttgagggggactgctctgagggggaataaaatcattatttattctttattagttattagcaggatttgtcgggcataaatgcccgacctacaaattcaattttttcaaacctctgccaaatattttcatctttgcaaggctgtctgaaaacccaaaccccattttcagacggccttttttcgctaaaatccccataccgttcaatccgaaaacacaggagaatcatcatggaagttaccatctccgccatcatcaatggcgaatttgccgaccaatacggcaagcgcggtagtcagtttaatgaaaacgggatgctgatttaattctatttcctttgaaactaccaataacctgcctccatcataaaactaaaagcaagccgtagcctgcattcccacaaaccgcgtgcgttgccatgtcacacaccctacctgcgggcgacgcaaaccttaagagacctttgcaaaattccccaaaatcccctaaattcccaccaagacatttaggggatttctcatgagcaccttctttcaacaaaccgcccaagccatgattgccaaacacatcgaccgcttcccgctattgaagttggaccgggtgattgattggcagctgatcgaacaatacctgaaccgtcaaaaaacccgttaccttagagaccaccgcggccgtcctgcctatcccctgctgtccatgttcaaagccgtcctgctcggacaatggcacagcctctccgatcccgaactcgaacacagcctcattacccgcatcgatttcaacctgttttgccgttttgacgaactgagcatccccgattacagcaccttatgccgctaccgcaaccggctggcgcaagacaataccctgtctgaactgttggaactgattaaccgccaactgaccgaaaaaggtttaaaaatagagaaagcatccgctgccgtcgttgacgccaccattattcagaccgccggcagcaaacagcgtcaggccatagaagttgacgaagaaggacaaatcagcggtcaaaccacaccgagtaaggacagcgatgcccgttggataaagaaaaacggcctctacaaactcggttacaaacaacatacccgtaccgatgcagaaggctatatcgagaaactgcacattacccccgccaatgcccatgagtgcaaacacctgtcgccgttgttggaaggtctgcccaaaggtacgaccgtctatgccgacaaaggctatgacagtgcggaaaaccggcaacatctggaagaacatcagttgcaggacggcattatgcgcaaagcctgccgcaaccgcccgctgtcggaagtgcaaaccaagcgtaaccgatatttgtcgaagacccgttatgtggtcgaacaaagcttcggtacgctgcaccgtaaattccgctatgcccgggcagcctatttcggactgattaaagtgagtgcgcaaagccatctgaaggcgatgtgtttgaacctgttgaaagccgccaacaggctaagtgcgcccgctgccgcctaaaaggcagcccggatgcctgattatcgggtgtccggggaggattaagggggtgtttgggtaaaattaggcggtatttggggcgaaaacagccgaaaacctgtgttgggatttcggttgtcgtgagggaaaggaattttgcaaaggtctccagcagtttgcgcatacatgccgtaacggcaaccttatacggcttaccctcggacagcgggcgttggtggaaatcccgaataagcggttcaaaacgtgtcgctgccacggtagccatatacagtgccttaagcaccgcagaccttccgccaaagcagcggcttttgaatttggcttccccgctcttcctcgggtgcggggcaatgccgaccaaactcgctatccgtttgtgcgacagccgccccaattcaggtagcatcgccatcagcgtagccgtcgttatcgaaccgatgcctttgatttgctccgccacttgggctttgccgtcaaaatgcgtgtgggtgtggtcgtcgatttgtttgtccgattcgtcaatcagccggtcaaaatgggcaatcagttgtttgacgcttccgacttgcgtttcgtgaacctgatgcagacggtttttctcggcagtccgcatatccgccgattggttgcggcggttaaccaaggcttccaacacttcttccgcttctgtgggcgggtggtagggcatggtttgccaatcttctttctgtgccttcatctgtgcgaagaaggcaggcattttggcatctttggcgtcggttttggtcagcgactgcgattgggcaaactgatgcgtctgacgcgggttggcgataatcacggctatgcctgctcggtggatggctttggcggcggggatttcgagacctccggtactttccgtcacgacgagggcgaccttgtgttttttaaggtattcgatagtatgggcgatacctttggggttgttggtttcggttttggttttagacaaagacgaaacggcgatgacgaagtttcgtttggcgatgtcgatatagtgaattaacaaaaatcaggacaaggcggcgagccgcagacagtacggatagtacggaaccgattcacttggtgcttcagcaccttagagaatcgttctcttcgagctaaggcgaggcaacgtcgtactggtttttgttaattcactatatctgtgcgttacgacggcatgccgtctgaagggtgtttatgtctgcatctaagaaatttccgattcctttgagctatttcagcatcgcgctgggcttgtttgccttggggctgtcgtggcgttacggcgcgtctgtcgggctgctgcccgccttggccgccgaatcgctgcttgcggcggcttcggtcgtctggctcttgctggtggcggcatacctgatcaaaatgtttgcgtaccgaaacgattttttgtctgatttacgcgacttggtgcaatgctgcttcatcagcgcgattccgattaccgctatgctggagggactcgcgctgaagccctatcaggcaggcgcggcggcagtcctgatttatgtcggcgttgccggacagttggctttttcgatgtatcgggcggccggtctgtggcgcggcctgcattccttggaggcgacgacgccgattatttatctgcctacggttgcgacaaactttgtcagcgcgtcatctctggcggcgttggggcatcatgattatgcagctttgtttttcggcgcgggtatgttttcctggctgagcttggaagcctccatcttgggcaggctgcgcacggcggcaccggtcggcacggcggcgcgcggcgtggtcggcatccagcttgcgcccgcctttgtcggctgcggcgcgtattttgccgtcggcggtaaagtcgacggttttgcgttggcattaatcggctacggctgcctgcagcttttgttcttgctgcgcctgacccgctggttttgggaaggtggttttacgatgagcttttggggattttcattcggtttcgcggcaatggcaggatgcggtctgcatctggcggcttccggcgtattgtcgggcttggggctgacgcttgccaccgccggatcggcaggcgtggcgctgctgcttgtcggtacgctgcaccggatagcgacggggcgtttcttggtacgcagctgatgcgttttgccgccttgtcaaaaatgccgtctgaaacgctgggattcagacggcattttttatttcacacccttacaggtagaatttttcgatgactttcaaattgtcgtccaatttgtacaccaacggctgaccggtcgggatttccaagcccataatgtcttcgtcggaaatgccctcgatgtgttttgccagcgcgcgcagggagttgccgtgcgccgccaccaagacgcgtttgccgctcaaaatcgcgggggcgatttggtcttcccaaaacggcaatacgcgctccagcgttactttcaggttttcgccgtcgggtacgacatcggcaggcagatgggcatagcggcggtctttgtgtgcggaaaactcatcgtctttgtccaaaagcggcggcagggtgtcgtagctgcgccgccagatgcggacttgctcgtcgccgtattgttcggcggtttgttttttgtccaggccttgcagttggccgtagtggcgttcgttcagccgccacgttttgatttgcggtacgaacagttggtcggattcttccaaaacgatgttgcaggtcttaatcgcgcgggtcaggacggatgtgaaggcgatgtcgaactcatagccgttttctttcagtttcttgccggcggcggcagcctcggcaagcccctgctcgctcagcttcacgtcgcgccagcctgtaaacaggtttttcgcgttccattcgctttgtccgtggcggataaataccagttccatatcgtctccaatgtgtgaaagtgggaaagccttatttataacatattttcacatttcccgtatttgattcagattcagacacgcgcccactatggtttgccgttttgatttacaataatgtcctttgctttacattccgcatacacaatgaatacgcaagcgcacgccccacataccgattccaatacgctgatgctcggccgatacgccgaacgcgcctatctcgaatacgccatgagcgtggtcaaaggccgcgcgctgcctgaagtttcagacggccagaagcccgtgcagcggcgcattttgtttgccatgcgcgatatgggtttgacggcgggggcgaagccggtgaaatcggcgcgcgtggtcggcgagattttgggtaaataccacccgcacggcgacagttccgcctatgaggcgatggtgcggatggcgcaggattttaccttgcgctatcccttaatcgacggcatcggcaacttcggctcgcgcgacggcgacggggcggcggcgatgcgttacaccgaagcgcggctgacgccgattgcggaattgctgttgtccgaaatcaatcaggggacggtggattttgtgccgaactacgacggcgcgtttgacgaaccgctgcacctgcccgcccgcctgcctatggtgttgctcaacggcgcgtcaggcattgcggtgggcatggcgaccgagattccgccgcacaatttgaacgaagtgacgcaggcggcgattgcgttgttgaaaaagccgacgctggaaaccgccgacctgatgcaatatattcctgcccccgattttgccggcggcggtcaaatcatcacgccggcggacgaattgcgccggatttatgaaaccggcaagggcagcgtgcgcgtgcgtgcgcgttatgaaatcgaaaaattggcgcgcggacagtggcgcgtcatcgtaaccgagctgccgccgaacgccaattccgccaaaatccttgccgaaatcgaagagcaaaccaacccgaaaccgaaagcgggtaagaaacagctcaaccaagaccagctcaataccaaaaagctgatgctggatttaatcgaccgcgtgcgcgacgagtccgacggcgaacatcccgtgcgactggtattcgagccgaaatccagccgcatcgataccgataccttcatcaacacgctgatggcgcaaacttcgctggaaggcaatgtgtcgatgaacttggtgatgatgggtttggacaaccgccccgcgcagaaaaacctgaaaacgattttgcaggaatggctggatttccgcaccgtaaccgtaacacgccgtctgaaattccgtttgaaccaagtggaaaaacggctgcacatcctcgaaggccgtctgaaagtctttctgcacatcgacgaagtgattaaagtcatccgcgaatcagacgacccgaaagccgatttgatggcggcgttcgggctgaccgaaatccaagccgaagacattttggaaatccgcctgcgccagttggcgcgtttggagggtttcaaactcgaaaaagaattgaacgagttgcgcgaggaacaaggccgtctgaacatccttttgagcgacgaaaacgaaaaacgcaagctgattgtcaaagagatgcaggcggatatgaaacaatacggcgacgcgcgacgcacgctggtggaagaggccggacgcgccgtgctgacgcagaccaccgccgacgaacccatcacgctgatcctgtcggaaaaaggctggatacgcagccgcgccggacacaatctcgatttgagccaaaccgcgttcaaagaaggcgactgcctcaaacaaaccctcgaaggcagaacggttttacccgtcgtcatcctcgattcatcgggcagaacctacacgctcgatgccgccgaaatccccggagggcgcggcgacggcgtaccggtttcctccttaatcgagctgcaaaacggcgcgaaacccgttgcgatgttgacaggattgccggaacaacattatttattatcaagcagcagcggctatggcttcatcaccaagctgggcgatatggtcgggcgcgtgaaagcgggcaaagtggtgatgaccgcagacagcggcgaaaccgttttgccgccggttgccgtctatgcctcctcgttcatcaaccccgactgcaaaatcattgccgccaccagtcaaaaccgcgccctcgccttccccatcggcgaattgaaaattatggcgaaaggcaaagggctgcaaatcatcggattaaacgccggcgaatcgatgacgcataccgccgtttcttccgagctggaaatcctgattgaaagcgaaggcaggcgcggcgcggcgcacaaagaccgcatccccatctccctgcttgaggcaaaacgcggcaaaaaaggcagactattgcccatatcgggcagcctgaaacagctttcttcccctaaataaacccggttccgcacatattatggtgatttccaacccccgcgaacttgaaaaactcaaagaccggattcccaatctgatcaacatcatccgcgtcgccatcgtttttccgctgatgattatgcacatcctcgggctggaaaccggcagccgtgcgaacctgcacgcttcgtggacggcgtgggcgttttatgtttggctcgccattgcctgctggctgattttcttttccattatccatccgcattggcaatggcagtcgctgaaaatgccgcgtttcagcgcggtagcggacatcacgatgatcggcgtgctgacctacctgttcggcggcatcgattccggcttcggcatcctgatcctgcccttcgtcgtctgctcctgcctgctcagctacgggcgctaccccctgctctattccagctacgccgccatcctgctgatattcaacgccattgccgacggcgatatcggcaaatacccgctcatatcggatgcccgaaccgcctcggcaaccttcatccttgtcgccgcctcctatctttccgccatcttcacctcactgtcggtcaaatacatcgaccgtgccggaaaactcgcctacgacagccatatcgcctaccaccgcatcaaaggcttgagccaaaccgtactcgaacgcgttcaggaagctgtcgtcgtcatcaatgccgaagggctggcggtgctgttcaaccggaaggcgaaagaccttttccccgcgctcgaaatcggacggcgcgccggtctgtccgattctgccgccgaactgtgggatcaagcctctccgcacactttcgaatacgtcctcggcacacccggcctgaacgccggcatccgcgccgttccggtcaacaaagggtcggacaagctgctcatcctctacatccgcccgcaaagcgaaattcaggcagaagccctgtccgtcaaacttgccgcgctcggacaactgaccgccaacctcgcccacgaaatccgcaacccgatgtccgccatccgccacgccaacgacctgctgcgcgaaaatatggaagcgggggcggcagatccgttcaacgccaaattgtgcaaaatcatcgacggcaacatctgccgcatcgacaaaatgctcgaagacatttcctcgctcaacaagcgcaacaaaaccgaacgcgaaaccatcggcctgataccgttttgggaagaattcaaacaagagttcctgctcggccatcccgatgccgccgactgcatccgtccggacattcaaggcggcagcccgaccgcctatttcgatcccgcccacctgcggcaaattatgtggaacctcgccaacaacgcgtggcggcacagccgcaaacagcccggctcgatttccgtcaccatccgccccgcgcaaaaaaacaccgtctgtatcctctttgccgaccgcccgaagtgcaggaacacctgttcgaacccttttacaccacggcggaaaacggcaccggcctcgggctgtatgtcgcccgcgaactggcgcacgccaatttcggcgatttgacctacctaccggaagccaaatgtttcgaactcacattaccggaaaaaaccaatgactgaactgcaacaccccgtcctcgtcgtcgatgacgaaaccgacattctcgacctgatggaaatgaccctgatgaaaatgggcttgcgcgtccataccgcgtcaggcgttgccgaagccaaaaacaagctcgacagccaacgctattcgctcgtcctgaccgatatgcgtatgccggacggctcggggctggaagtcgtccaacacatcaacagccgcctgctcgatacgccggttgccgtcatcaccgccttcggcaacgccgatcaggcacaggaagcgttgcgttgcggcgcgttcgaccccgataccatgcagatacaggactatctcgaccaaatcgaacgcgacatcatcgaacaaaccctcaaacaaaccgaaggcaaccgcacgcaggccgccaaacgcttgggcatcagcttccgttccatgcgctaccgtatggaacgcctcaacatcggctgacgacaaaacggcatccgcaccatctccgcccacccgaaaaaatgccgtctgaaacggcacgggaaagcgggttcgccccacgcccgaacggacacaaaacaccatgaccgacatccttattgacaacaccgccaccgaaaccgtccgcaccctgatacgggcattcccccttgtgcccgtttcccaaccgcccgaacaaggcagttacctccttgccgaacacgataccgtcagcctcaggcttgtcggggaaaaaagcagcgtcatcgtcgattttgcctccggcgcggcacaataccggcgcacaaaaggcgggggcgaactcatcgccaaagccgtcaaccacaccgcgcaccccaccgtttgggacgcaaccgcaggattggggcgcgacagcttcgtcctcgcctcgctcgggctggccgttaccgccttcgagcaacatcccgccgtcgcctgcctgctttcagacggcatccgccgcgccctcctcaatcccgaaacgcaaaacaccgccgcgcacatcaacctccatttcggcaacgccgccgaacaaatgcccgcacttgtccaaacacaaggcaaacccgacatcgtctatctcgaccccatgtatcccgaacgccgcaaaagtgccgccgttaaaaaagaaatgacctacttccaccggctcgtcggcgaagcgcaagatgaagcggcactcctgcataccgcacgccaaacagcaaaaaaacgcgtcgtcgtcaaacgcccccgcctcggcgaacaccttgccggacaagaccctgcctaccaatacacaggcaaaagcacccgcttcgacgtttacctgccctacgggacggacaagggataacgcccataaaacaagacaccgaaaaatttgccgttcttatgcaaacgagaaaccggtttttgcgtttcgactgttttggataagtcatcacaccttaaagtttgtcattcccacagaagtgggaatccgattcattcagttttatagtggtttaaatttaaaccactatagttgttttcgagtttcaggcaacttccaaaccgtcattcccacggaagtgggaatctagaaatgaaaggcaacaggaatttatcgtaaatgactgaaaccgaacggactagattcccgcctacgcgggaatgacggggcgggcagatgccgtctgaaattccgtcattcccgtgaaaacgggaatctagaacttctgatttttcagacgacttttgaacattgccgccacccaatgatctggattcccacctgcgcgggaatgacgaggtttcaggttgctgtttttaagttgctgtttcgggttgctgttttttatggaaatgacaaggttttagattgcgagaatttatccgctcctccgtcattcccacggaagtgggaatccagaaatgaaaagcaacaggaatttatcataaatgaccgaaaccgaacggactagatttccgactgcgcgggaatgacggggcgggaggatgccgtctgaaattccgtcattcccgtgaaaacgggaatctagaacttctgatttttcagacgacttttgaacattgccgctacccaatgatttggattcccgcctgcgcgggaatgacgatgtaaaattatccgggattcaaaaagacaggctttcacatccgtgggaatgactgcggaaagatgatttttatagtggattaacaaaaatcaggacaaggcgacgaagccgcagacagtacaaatagtacggcaaggcgaggcaacgccgtactggtttttgttaatccactatattttgtcataaaaatccgcaccttaatcagttggcggttaaatcaaacttttagggtgcagattactttttatgatttcagacagcattttgacaggcggcagcctatttcggcaataccaaaaacttaatcagcagttctttgaatacaaaaccgaacacgcccaagcccaaaaccaaaaacaaaatggcgatgccgaatttgcctgctttggactccttgcccaaattccaaacgataaaacccaaaaaaataatcaagccggtcaggcagattttcaacgcccaatcggcaaaaaccgcttcatccatatttttttcctattgttgatgtgtatgccatataagataagggtttcagacggcatctgctgtccaatgccgtctgaaacacgcaatcagcgtgcgagtgcctgtttcaaatcgtcaatcaaatcgccaacatattccaaaccgaccgacaggcgcaccaatccggggcggatgttggcggcgagtttttcttcgggctgcatcctgccgtgcgtggttgtccacgggtgggtaatggtcgagcgcacgtcaccgaggttggcggtgcgggaaaagagttccacgccgtccacaactttccacgccgcttcttgatcggcaacttcaaagccgatgacgatgccgccgccgttttgctgtttgcggataagcgccgcctgaggatggtcggacaatccggtgtagtacacggcttgaacctgcggctgcgcttgcagccattgtgcgattttcagggcgttgtcgaactgtttttccatacgcagcgacagggtttccacgccgctcaacaactgccacgcattaaacggcgacatcgccagcccgcaagagttgcaatacatggcgacctgcgccaacaactcttccgaacccgccaacacgccgcccatcacacgcccgtgtccgtctatggctttggtcgcggaggaaacggaaatatccgcaccgtgtttcaaaggctgcgagccgacgggcgacagcaggctgttgtccaccaccaagagcgcgccgatgccgtgcgccaattccgccaaggcttccaagtcggccacttcgcctaaggggttggacggcgtttccaaaaacagcagtttggtattggctttgacggcggctttccattcgtttatatcagtcggcgacacgtggctcacttcgatgccgaatttggcaacgatgttattgataaagccgacggtcgtgccgaacaggctgcggctggaaatcacatggtcgcccgcctgcaaaaaggtgaaaaacgccgcctgaatcgcagacatacccgccgaagtggcgaccgcgcgttccgcaccttccaaagcggcgatgcgtttttcaaaggcggctgtggtcgggttggcggtacgggtataagtgaaccctttgattttttttgaaaacaaatcggcagcgtgttgggcgttgtcccacatgaagctgctggtcagaaacaatgcctgattgtgttcgcggtattcggtttgttctttgccgccgcgtatggcgagcgtttgcggatggagttttttgctcatcggtgattcctcggttttgtccgttcggcaacggagcgtgcgcccgttgtttaatttgttaatattttgcgcctgttctatgatgctttcaagtcggatgagaatgcaaatgccgtctgaaacggctttcagacggcatggcaatcagcgtttgtattttaactcgtacttgatgtcgttgaggattttgcggacatcgtgttccaacacgtcttcgactaccgcccccgcctgctcgtgcagcatctgctggagctgataggtgaaaaccgccatctgcttttgcaccgccgttcggatgatgccgttgacggtatcggtcagatgcgggcgcaggcgtttgatcagccgttcggtcagctcctgttcggacaggcagaacacttcgcgccggttgacggctttcgggttcaggatattgatttggacgggcatcaacgtttcttccgcatcgttttccccgttttccgaaaccgccggctcattcgtgccggattctgcctcgtcggcgttttccccgctttcaatctgtccggtttcaaattcgacactgtcttttttggtatcaaaccggattctccgccgcgattcgatgtgtttttccgaaaccgacatttgcagggaagcctgcgcgttgagccagttttcctgaaggacgatcatcgggtcggtttcgacttcctcgccgcaatcggcaacggcggcattgtgttcctcctgccattttttcagatacgccttcaacacacgggctcggctctcatcgtccagtttcggcacaggcgcgtccgttccggtttcagaggggcgggacagcggcgcgtaagtcggcactgccttcatacggcgcgtctgacgcaggttttccaaacgtttttcccaattcggctctttattcgcatccattttcggcttccggttcttaatctttgcaagcagacaaacccgcgcccaaagcgcggtttgatataatggcgcattttaacagattcgcgaggatacatcatgggcagcatcgaacagcgtttggaatatctggaagaggcgaacgacgtgctgcgtatgcagaaccacgtcctgtccaccgcattcaaagccttaatccgcgcccttcccgccgaaaccgccgaaatcgcggtcgagtcgattcagcttgcttttgaggacgccttggcagaattgagctatgaggacagcccgcatacggatttgttccacgacgttacttatgcgtttttccgtgaaaaagaacgttaattttatgttaaactgattttttaggctttttgattaccgaaaggaattttgatgaatatgaaaaaatggattgccgccgcccttgcctgttccgcgctcgcgctgtctgcctgcggcggtcagggcaaagataccgccgcgcctgccgccaaccccgacaaagtgtaccgcgtggcttccaacgccgagtttgccccctttgaatctttagactcgaaaggcaatgtcgaaggtttcgatgtggatttgatgaacgcgatggcgaaggcgggcaattttaaaatcgaattcaaacaccagccgtgggacagccttttccccgccttaaacaacggcgatgcggacgttgtgatgtcgggcgtaaccattaccgacgaccgcaaacagtctatggacttcagcgacccgtattttgaaatcacccaagtcgtcctcgttccgaaaggcaaaaaagtatcttcttccgaagatttgaaaaacatgaacaaagtcggcgtggtaaccggctacacgggcgatttctccgtatccaaactcttgggcaacgacaatccgaaaatcgcgcgctttgaaaacgttcccctgattatcaaagaactggaaaacggcggcttggattccgtggtcagcgacagcgcggtcatcgccaattatgtgaaaaacaatccggccaaagggatggacttcgttaccctgcccgacttcaccaccgaacactacggcatcgcggtacgcaaaggcgacgaagcaaccgtcaaaatgctgaacgatgcgttggaaaaagtacgcgaaagcggcgaatacgacaagatttacgccaaatattttgcaaaagaagacggacaggccgcaaaataagcccgcccgtccgaacacaatgccgtctgaagccctttcagacggcattgttcatcaatcggcctacaatgaactgcctgctgatttctccctaccgcaaagcaacaggcaaagattacaaatatcaaaatccgagtaaaacagtattttattaaaacaaattgataatcaagagattagaattatgtattgtctttaccgtacaaacgctggcactatttcaacctgataaaaaacagccttcaaaaaggttgtttaaaacagcagcagacacttaccgccacaaccttgaaaaggaacacaatcatgaccgtcatcaaacaggaagactttatccaaagcatttgcgatgccttccaattcatcagctactatcatcccaaagactacatcgacgcgctttataaggcgtggcagaaggaagaaaatcctgccgccaaagacgcgatgacgcagattttggtcaacagccgtatgtgtgcggaaaacaaccgccccatctgccaagacacaggtatcgcaaccgtcttcctcaaagtcggtatgaacgtccaatgggatgcggacatgagcgtggaagagatggttaacgaaggcgtacgccgcgcctacacttgggaaggcaatacgctgcgcgcttccgtcctcgccgatccggccggcaaacgccaaaacaccaaagacaacacccccgccgtcatccatatgagcatcgtgccgggcggtaaagtcgaagtaacctgcgcggcaaaaggcggcggctctgaaaacaaatccaaactcgccatgctcaatccttccgacaacatcgtcgattgggtattgaaaaccatcccgaccatgggcgcgggctggtgtcctcccggcatcttgggtatcggcatcggcggcacgcccgaaaaagccgtgctgatggcaaaagagtccctgatgagccacatcgacattcaagaattgcaggaaaaggccgcgtccggcgcggaattgtccaccaccgaagccctgcgcctcgaactctttgaaaaagtcaacgcgctgggcatcggcgcacaaggcttgggcggactgaccaccgtgttggacgtgaaaatcctcgattatccgacccacgccgcctccaaaccgattgccatgattccgaactgcgccgccacccgccacgtcgaatttgaattggacggctcaggccctgtcgaactcacgccgccgcgcgtcgaagactggcccgatttgacttacagccccgacaacggcaaacgcgtcgatgtcgacaagctgaccaaagaagaagtggcaagctggaaaaccggcgacgtattgctgttgaacggcaaaatcctcaccggccgcgatgccgcacacaaacgcctcgtcgatatgctcaacaaaggcgaagaattgcccgtcgatttcaccaaccgcctgatttactacgtcggccccgtcgatccggtcggcgatgaagtcgtcggtccggcaggtccgaccacagccacccgcatggacaaattcacccgccaaatgctcgaacaaaccgacctcttgggcatgatcggcaaatccgagcgcggcgtggccacctgcgaagccatcgccgacaacaaagccgtgtacctcatggcagtcggcggcgcggcgtatctcgtggcaaaagccatcaaatcttccaaagtcttggcgttccccgaattgggcatggaagccatttacgaatttgaagtcaaagacatgcccgtaaccgtcgccgtagatagcaaaggcgaatccatccacgccaccgccccgcgcaaatggcaggcgaaaatcggcatcatccccgtcgaatcttgaggcgccatgccgtctgaacacaaaatctgccttcagacggcatttccgcccccggttgcggtacaatccaccatttcatcactcggcgacccacaccgtgaaaatcctcattttaggcaacggacaggtaggttctaccgtcgcacaaaaccttgccgccatacccaacaacgacgtaaccgttatcgacatcgacgaaaaagcattgcaggaaacaggcagccgcctcgatgtccaaaccgttttcggcaacggcgcatcccccttcacattagaacgcgccggcgcggaagatgccgacttgctgctcgcgctctcccgcagcgacgaaaccaacatcgtcgcctgcaaagttgccgccgacctgttcaacatccccggccgcatcgcgcgcgtccgttccagcgaatacctcgaatacctcagccccaagctcgaaaacaacgaaaacggcagcctttccatattcggcataaccgaaaccatcagccccgaacagctcgttaccgaacagcttgccggcctgatagactgcccgggcgcattgcaggttttacgttttgcagacgaccgcgtgcggatggtcatcatacaggcgcggcgcggcggactgcttgtcggacgcagcattgccgacatcgcccaagatttgcccgacggggccgactgccaaatctgcgccgtttaccgcaacaaccgcctcatcgtccccgcgccgcaaaccgtcatcatcgaaggcgacgaaatcctatttgccgccgccgccgaaaacatcggcgcggtcatacccgaattgcgccccaaagaaaccagcacccgccgcatcatgattgccggcggcggcaacatcggctaccgtctcgccaagcagctcgaacacgcatacaacgtcaaaatcatcgaatgccggccgcgccgtgccgaatggatagccgaaaacctcgacaacaccctcgtcctgcaaggttcggcaaccgacgaaaccctgctcgacaacgaatacatcgacgaaatcgacgtattctgcgccctgaccaacgacgacgaaagcaacattatgtccgcccttttggcgaaaaacctcggcgcgaagcgcgtcatcggcatcgtcaaccgctcaagctacgtcgatttgctcgaaggcaacaaaatcgacatcgtcgtctccccccacctcatcaccatcggctcgatactcgcccacatccggcgcggcgacatcgttgccgtccaccccatccggcgcggcacggcggaagccatcgaagtcgtcgcacacggcgacaaaaaaacttccgccatcatcggcaggcgcatcagcggcatcaaatggcccgaaggctgccacattgccgccgtcgtccgcgccggaaccggcgaaaccattatgggacaccataccgaaaccgtcatccaagacggcgaccacatcatctttttcgtctcgcgccggcgcatcctgaacgaactggaaaaactcatccaggtcaaaatgggctttttcggataaaccgccccattccggacatattgccgccaagcggtatggaagcggaaataatggtaggtgggcttcagacggcatccgccctccccgtcattcccgcgtaagcgggcatccagaccttgggatagcggcaatattcaaaggttataaaagacccgtcattcccgcgcaggcgggaatccagaccttgggatagcggcaatattcaaaggttatctgaaaatttagaggttctagattcccgctttcgcgggaatgacgaaaagttgcgggaatccagaacgtcgggcaacggcaatattcaaaagccgtctgaaaatttaaaagttctagattcccgctttcgcgggaatgacgaagtttcagacggcatcgcccgcctgttttgatatagcggcacccccccgacaaaaaaacaatccggaacgcatctgaccgttccggcttgttttcaggcgaatccgccgcatcagaacatactgcgcacgcccatattgacctgccaagtctagcgcatcgtgtgcatcgaagacctttgcgcctcaaaataaagctgccttccgttgtcggcattaccacgcaaaaaaatgaattgcttgatattccaatgttttttatatgtttttatattgtgatgcgatcagacaaacgcccccctgacatttgtttagacggcatcgtattgctaaatttctataagtatgtataatgtccgtttccacgcgcccatcgtctagaggcctaggacactgccctttcacggcggcaaccggggttcgaatccccgtgggcgtgccaattcaaaaacctgcttgtttcaagcaggttttttattatgagtcgtcattcccgcaatttttcgtcattcccgcaaaagcgggaatctagagcgtagggttgaagaaaccgttttatccgataagtttccgtgccgacaggtctggattcccgcctgcgcgggaaggacggcagagggtggacgatgccgtctgaagcctgacaaagcatttgatgccgtctgaaacttcgtcattcccgcaaaagcgggaatctagagcgtagggttgaagaaaccgttttatccgataagtttccgtgccgacaggtctggattcccgctttcgtaggaatgacggaattttaggtttctgtttttgtggaaatgacgaataaagcgtgccggtttatgctcgccgcaacacgcggttcagacggcattgctctcttttttcattatcagtgggtgtagcaactgtatttttcaccccgtcgggcaaaaatacagttgctacgatgcaccccgccgccctgccctgtgccttgtcctgcaatacggcatataatgcaccacaaacccccgcgctgcggttttcagacggcatcgccgtgcttttttacaggcattagccctttttatcggacgcaatattaaggaggaacaaatgaaaagctcttttgtgcaaacgcttaccatcgccggttcggattcgggcggcggtgcgggcattcaggcggatttgaaaacatttcagatgcgcggcgtgttcggaacgtgcgtcatcaccgccgttaccgcgcaaaataccttgggcgtgtcggcggttcatctcgtcccgaccgaaaccatcaccgcacaaatccaagcaatcagggaagacttcgacatccgcgcctacaaaatcggtatgctcggcacggcggaaatcatcgaatgcgttgccgacaagctgaaacactgcagctttggcaggcgcgtactcgaccctgtgatgattgccaaaggcggtgcgccgctgttgcaggattccgccgttgcggcactgacgcgcctgctgcttcccgatacggatgtattgacccccaacctgcccgaagcggaagctctgaccggcgtgcatattgaaaaccgtaaagatgcggaacgtgcggcaaaaatcctgcttgattacggtgtcaaaaatgtcgttatcaaaggcggacatttgaacggcagcacaagcggacgctgcacggattggctgtttacacaaaatgaaacgctggaattcgacagcccgcgctttccgaccgcccacacgcacggcacgggctgcacgttttccgcctgcatcaccgccgagttggcaaaaggctcggacgtttgcgaagccgtacagactgccaaggcctacatcacggcggcaatctcaaaccctttggaaatcggcgcaggacacggcccggtcaatcattgggcgtatcgggactaaccgtaaaaatgccgtctgaaacaaaatgttcagacggcatttttgaggattattcaggctttttcgccagcatcgttacaaatttaaaccgtatcggattgccgttttcgtctttggcatgcatagaacccaattcttctttatattcgaccagttcccaatcccgataataatccttcagctcgccctctttaaatttaaaagggaacggcatcggacaggggaaatccgccgtatccattgccgatacaatcaagttgtacccgcccgccgccgtatgcgcctgcatatcggcaatcacgtcgggtacgcgctgcggcatcaggaacatcagcaccactgttgccacaatataatcaaactcgccctgcaaggcggcggcgttcaaatcatattccagcgtgcggacgttcaaaccctccgcctctgccagctccgccacgtttgccaaggcggcgggattgtgatcgactgcagtaacttcaaaccccttcaaaccgagaaacagcgcgttgcgcccctgtccgcagcccatatccaacgccctgcccgccggtacggtatcccgtgccgccgcgaccgcagaatgcgtggcactcatcccgtattttttgtgaaaatagtctgccgccgcgcaatacagcgacaaacggatttcggcatcgtccgttttcggtttgacagaaaacacctgctgcggcgcaaacacacaatcgccgccgtctgccgaccaaacttctgccgacccgtccggtgcacgaacttcgacatcgccctgcaacacattcaggcagacccactccccttcctcagacgaatagcccgacaacaaaacttccggcaggttttccactttccatacaggcatctgtccgaaacaaaacaactcgccactttgacccactatccgctccttcatattcaaaaataaagttgcacattatatgcctattttaatccgccgcaatctttcagacggcacggcgcgcaaaccgcttataatcacgccggacaccacacaaaggcacaataatgaaccaaaccgtttacctttacaccgacggcgcgtgcaaaggcaatcccggcgcgggcggctggggcgtgttaatgcgctacggtagccacgaaaaagaacttttcggcggcgaagcgcaaaccaccaacaaccgcatggaactgactgccgtcatcgaaggactgaaatcgctcaaacgccgctgcaccgtcatcatctgcaccgactcgcaatacgtcaaaaatggcatggaaaactggatacacggttggaagcgcaacggctggaaaaccgcctccaaacagcccgtcaaaaacgacgacttgtggaaagaactcgacgctctagtcggacggcatcaagtcagttggacttgggtgaaaggacacgcgggacacgccgaaaacgaacgcgccgacgatttggcaaaccgtggcgcagcgcagttttcctgactgccgctccggcaaaaatgccgtctgaaaccgctaatgggcttcagacggcatcgtcctccaccgtcattcccgcgcaagcgggaatccaaaccgtcgggcaacggcaatattcaaagattatctgaaagtttgaagttctagattcccgttttcacgggaatgacgaaaagttgcaagaatgacggagtttcaggcggcatccgaccgccccgtcattcccgcgaaagcgggaatctaaaaacccaacgctgcaagatttatcagaaacaactgaaaccgaacggactggattcccgcctgcgcgggaatgacgggattttagtaaccgtagcaaccgcctgcgcgacggctaaggggcttcagcaaccgtagcaactgcctgtgtgggaatgacggacaatgggcttcagacggcatctcttgcctgccgctaaaacagtttgccgcacaactgttcaaacgcgtccgatatgtttcaacacacaggacgacacataaagcacctccctatgtgtcgtcctgatttggaaggggttacaccccctcccaaataaagtctgatcctgccgccctaaagggcggggtttcaaccgaaaaggaaatacgatgaagtggtacaattagcggcaatgcggacagacaaattaaactatagtggattaaatttaaaccagtacggcgttgcctcgccttagctcaaagagaacgattctctaaggtgctgaagcaccaagtgaatcggttctgtactatttgtactgtctgcggcttcgttgccttgtcctgatttttgttaatccgctatatcagaaattaccctaccgttttttaaacactttcaggaataaggaaaaatgaccgcccaaccctgccccatctgcacggcgcaaaatgaagacgttttgctgcaaacccccaacctccgcgtcatcgccgtccataacgacagcggttcgcctgcattctgccgcgtcatttggcgtaagcatattgccgaaatgaccgacctttcggcagcggaacgcggcgaattgatggaaatggtgtacaaagtcgaagccgctatgcgccaagtgttccggccggcaaaaatcaacctcgccagcttgggcaatgtcgtgccgcacctgcattggcatattatcgcccgctttgaaaacgatgcgtctttccccgcgccgatttgggcaaaccccgtccggaaacacggtatgaccctgccgcaagattggacggaacagcttaaaaagctgctttaagcccgccgatgccgtctgaaaccgtatgaaagggaaattatgaccgaaccgacctcccgccgccgttttctgaaaacctgcaccgccgctgccggcgcggggctgcttcaggcttgcggcacatccgccacatccgttccgccccttccctcttcccattccgttgtgaaagcccgaaccgtgcctctccaaacgccacgccgtcaaagttcggacggcaaccttctgcgcgttgtcgcttcgtcaggatttgccgaagacaccaaccgcgtcaacacagccttaacccgcctttacaatgtcggttttaccgtaaccaaccaacaggcgggcagccgccgtttccaacggtttgccggcacggacacgcaacgtgccgccgatttccaagaggtcgcttccggccgcgtcgccacgcctaaagtgctgatgggtttgcgcggcggttacggtgcggcgcggattctgccgcatatcgattttgcttcgctcggcgcaaggatgcgcgaacacggcacgctctttttcggattcagcgacgtatgcgccgtccagctggcattgttggcaaaaggcaatatgatgagttttgccggcccgatggcttatagcgattttggcaaacccgcccccggtgcgtttacgatggatgcctttatcaagggtgcaacccaaaaccgcctgaccgttgatgttccttatatccaacgcgccgatgtcgaaaccgaaggcatattgtggggcggcaacttaagcgtcctcgcctcgctcgccggcacgccttatatgcccgacatcgacggcggcattttgttcctcgaagatgtcggcgaacagccctaccgcatcgaacgtatgctcaatacgctgtatctttcgggtattttgaagaaacagcgcgccatcgtgttcggcaatttccgtatggaaaaaattcgagatgtctatgatccgtcttatgatttttctgccgttgccaaccatgtttcgcgcacggcgaaaatccccgtgctgacgggcttcccgttcggacacattgccgacaaaatcactttccctctaggcgcgcacgcccgaatccgtatgaacggaaacagcggttattcggtcgcgtttgaaggctaccccacactcgatgcgtccgccctgactttggataccctgctcccaccgccggatttgcccatcttccccgaaagcggtgttgccgatatttcggaataaacccgcaaacggacaaatgccgtctgaagccttcagacggcatttcccaagacggcggcagattacagcaatgcccgaatatcggcttcgatttcttcgggcgtaacactaggcgcaaaacgctcgaccacttcgccgtcgcggttgacgaggaatttggtaaagttccatttgatgtcgccttcgtcgcgcttctctcccaaagctgcgagcttcaacacgaaatctttaaacagatgattgcctttatcttgcggtttgacggatttcaggtaggcatacaagggcgcggtatttgctccattgacttcgattttgtcgaaaatcttaaacttcgtgccaaacttcatcatacacacttgggcaatttctccgctgctttcgggagcctgttcgcggaactggttgcacggaaaatccaaaatctccaagccttctgcggtatattgtgcatacagcttctgcaaagcctcgtattgcggggtcagaccgcaacgcgttgccgtgttgacaatcagcagaaccttgccgcgatagcctgacaaatcaaccgcattgccttctgcatctttcatttgaaaatcgtaaatacccatttttatccttatctgatgtaaaccgatgccatctgaaacgtgcttcagacggcatgaaagcagcaattgtatagccgattaaaataaaaaatccacatccttttccattcccgtcccaatccgcaataaaaaactgcacccgaaaacgggtgcagttgctcatttcataccgcaaaacttatttgtcgcggccgaatacgattttagtggcttggatggcgacacagattgcaccgccgataaagaccaagtcagctgccgtacgtacccaacgcaaggtatcgaggatttccatttgcaggaactcttcgctgcgggcataccacagaccgtgcgtgatggaggcgtatgcctgaatcgcgccgacaggcagcaggctgatggcaatcataccggccaagccgccgttgagcagccagaagccccaagtcatcagtttgtcgtcaaactgcgcgttcggtttcaaataacgggcaaccagcaatacgaagcccaatgccaagaaaccgtacacaccaaacaaggcggcgtgcgcgtgaacggcagaagtgttcaaaccttggatatagaacagggaaatcggcggattgatcaggaagccgaatacgccggcaccgatcatattccaaaaggcgactgccacgaagcacatcagcggccaacgcaggcgtttcgcccagtcggacaggtgttggtaagaccagtgttcgtatgcttcacggcccagcaacaccagcggcacgacttccaaagcggagaagcaggcaccgattgccatagaggcggaggtagagccggagaagtacaggtggtgcagcgtgcccggaacgccgcccaacataaagatggcggcagcggccaaagtggaggcagtggcggtactgcggcggacaaagcccatattgtagaagacaaaggcaaaggcggcagtggcaaatacttcgaagaagccttctacccacaggtgaaccacccaccaacgccagtattccataacggcaatcggggatttttcgccatagaacaggcctggtgcgtagaatacgcccacaccgaccatagaagctacgaagatagccaacaggtttttgtccacgcctttttctttaaaggcggaaaccgtgcaacgcaacatcaggaacagccataacagcagaccgaccatcaaaaggagttgccagaaacgtcccaaatcgaggtattcgtaaccttggtgtccgaaccagaagttaaattccgggggaaggatgtgcgtcaacgcgaagaagttgcccgcgtaagaaccgccgaccacgatgaagagggcgatatagaggaagtttacgccggcacgttggaacttgggatctttaccgccgttgacaatcggcgcgaggaacaaacctgccgtcaaaaagccggttgcaatccagaagatggcggattggatgtgccaagtacgggtcagggcgtaggggaaccagtcggacatttcaaagcccaacgcctcgtcaatgccgtagaaaccctggccttcgacggtgtagtgcgcggtcagtccgcccagcaatacttgtaccacaaacagggcgaccgtcaggaagacgtatttgcccaatgctttttgcgaaggggtcagttggattttggaaatcgggtcttcagacggcacttccacttcctcgtgtttggtcaggaaggaataaccccacatcagcaaaccgatgcccatcagcagaagaacaacgctggtgaatgaccacatatagttttcagtggtcggtacgttgttgatcaaaggttcgtgcggccagttgttggtgtaagtaaaattctcgtcaggacggttggtcgaagcagaccaagaagtccagaagaagaagttgaacagtttttcacgcgcttcttggcttggcaatgtattgtttttcattgcaaagtgttcgcgagtggtttggaacttaggatcgtcgctgtacacaccgtggtagtaaggcaggatgctttcgatggctttcacgcgcgtatcgctgatgacgacgctgccgtcttccttcacgcggctttgattgcggtattcgtcggccaggcgtgttttcaagacggcttgttcctcgggggaaacctcgtcgaattttttgccgtaagtctgttgcgcggtcaaatccaaccaggcaaccaactcacgatgcagccagtccgccgtccagtccggagcctgatatgcaccgtgacccaaaatcgaaccgacttccataccgccggtagtctgccatgcagactgacctgccaaaatatcgtctttcgtcatcaagaccttgccggatgcggaaacgacctgttcggggtaaggcggggcttttttgtaaacctcgctgcccatatagccaagaatggtaaagcataccgccagaacggcaaacagcaagtaccaaagcttcttgtactgtcccattttgagagctccttttaatatagtggattaaaattcacaaaatatgaatgttaaagattgtagcacggtttaccgcgcaaataaacatttgttcaaagaaactcacatataaaacaaatacatatatgataataactatcattattctttagtcggcaactaccctgcctttgcctgatttgccgaagcccttaagcaaatcagcctatttattgtaatttttagtagctataaagtattagaagtatcattttaagttcatattttatgaattatttgacttaaatcaaaatgcccccaatggggcaaacgcataatcacaccaagttcttaaccaatccctctacttttcttacaaaaggaaaatattatgaaacgccaagccttagctgcaatgattgcttccttattcgcattagccgcctgcggcggcgaacctgccgcgcaagcccctgccgaaacccctgccgctgccgccgaagccgcaagctccgccgcacaaaccgccgccgaaacaccgtccggcgaactgcccgttatcgatgcggttaccacccacgctcccgaagtgcctcctgcaatcgaccgcgactaccccgccaaagtccgcgtaaaaatggaaaccgtcgaaaaaaccatgaccatggaagacggtgtggaataccgctactggacatttgacggcgacgttccgggccgtatgatccgcgtacgcgaaggcgatacggttgaagtggaattttccaacaatccttcttctaccgttccgcacaacgtcgacttccacgcggctaccggccagggcggcggcgcggccgcaacctttaccgctccgggccgtacttccacattcagcttcaaagccctgcaaccgggtctgtacatctaccactgcgccgtcgcaccggtcggtatgcacatcgccaacggtatgtacggtctgattttggtcgagcctaaagaaggcctgccgaaagtggataaagagttctacatcgtccaaggcgacttctacaccaaaggcaaaaaaggcgcgcaaggtctgcaaccgttcgatatggacaaagccgttgccgaacagcctgaatacgtcgtattcaacggtcacgtaggtgctatcgccggcgataacgcgctgaaagccaaagcaggcgaaactgtacgtatgtacgttggtaacggcggtccgaacttggtatcttccttccacgtcatcggcgaaatcttcgacaaagtttatgttgaaggcggcaaactgattaacgaaaacgtacaaagcaccatcgttcctgccggcggctctgccatcgtcgaattcaaagtcgacatcccgggcagctacactttggttgaccactctatcttccgcgcattcaacaaaggcgcactgggtcaattgaaagtagaaggtgcagaaaaccctgaaatcatgactcaaaaattgagtgataccgcttacgccggtaacggtgcagctcctgctgcttccgctcccgcagcttctgccccggcagcctctgcatccgaaaaaagcgtttattaaattggatacccgtcattagcgggacgaaccactgccgctgtacttcattacgcacggcggtggttttttaacaaccaatctttcctttcggaagattgattttaaccgcctgtcaggaggctttatgaagtatgtccggttatttttcctcggcgcggcactcgccggcactcaagcggcggctgccgaaatggttcaaatcgaaggcggcagctaccgcccgctttatctgaaaaaagataccggcctgattaaagtcaaaccgttcaaactggataaatatcccgttaccaatgccgagtttgccgaatttgtcaacagccacccccaatggcaaaaaggcaggatcggttccaaacaggcagaacccgcttacctgaagcattggatgaaaaacggcagccgcagctatgcgccgaaggcgggcgaattaaaacaaccggtaaccaatgtttcctggtttgccgccaacgcctattgcgccgcacaaggcaaacgcctgccgaccattgacgaatgggaatttgccggacttgcttccgccacgcagaaaaacggctcaaacgaacccggctacaaccgcactattctcgattggtatgccgacggcggacggaaaggcctgcacgatgtcggcaaaggccgcccgaactactggggcgtttatgatatgcacgggctgatttgggaatggacggaagatttcaacagcagcctgctttcttccggcaatgccaacgcgcaaatgttttgcagcggcgcgtctatcgggtcgagcgactcgtccaactatgccgccttcctccgctacggcatccgtaccagcctgcaatccaaatatgtcttgcacaacttgggcttccgttgcacaagccgataaccccttcaattatagtggattaacaaaaaccagtacggcgttgcctcgccttgccgtactggtttttgttaatccactatattccgccatctctaagatttacagcgatacacgggtaatttaaggaatgcccgaaccgtcattcccgccactttccgtcattcccgccactttccgtcattcccgccactttccgtcattcccgcaacttttcgtcattcccacgaacctacatcccgtcattcccacgaaagcgggaatccagtccgttcagtttcggtcatttccgataaattcctgctgcttttcatttctagattcccactttcgtgggaatgacggcggaagggttttggttttttccgataaattcttgaggcattgaaattctagattcccgcctgcgcgggaatgacgattcataagtttcccgaaattccaacataaccgaaacctgacaataaccgcagcaactgaaacgtcattcccaccacttttcgtcattcccaccacttttcgtcattcccacaaggacagaaaaccaaaatcagaaacctaaaatcccgtcattcccgcgcagatgatatgttgcccgtcaacacaaaataaaaaacaaagttgcaatatactgatttatattgttatttttatttacgtttatttacgatatgcaaatgcacggttacacaaatatattcgcgtaaccgtttaattttgttgaattttattgattcaatcggtgtctttccgcatcgtaaggctggccggttttaacaatgtaataggcgagcttcgccagtttgcgcatgatggcaacgatgattaccatctttggcttacccgcttttttcagattatttattaatttcggaaatgcgttaaaacggtaagcacaaagggcgggcatatacagcgtactttttaatcgtctgtttccgtatcggctcaatctgccccgacctcttacgcttgtccctgattgtatgatggcgggatttaatccggcataggatacaaactggtttgcggttttaaaatgtttttctgtcagttgcgcataaagaactgatgcggtgtctttgcctatgctcgggatggtttgaagattgcggtaatggttattgtccgtttgttttttgatttgttcggatatggctatttttacctgttccatcttgtcctgtatggtatctatcaagtcttgatgtatgttccttatgaagtcttcttcagtgctatgaagacggtttttaatttgcttctgatgttgatgtaattgatttttaaggttaatcagtttttgcagtgctttgtttttgggtatctgatacggtatcaatgtatcttgatgcctttttatgtagtctgctatcaggtttgaatctgctttgtcggttttggtacggttaaacctgctttttccgtagtccttgatttttaagggattaataacgtaaacagtatagtaggaagaaagcatatctgctgccttttcgtaatagatgcctgttgcctccatgccgatatagacttttctgattctgtttccctttatccacaatctaaactgttttaatccatcatcattattcttaaatttaatgtaatggatacttccgtttgttttatgcaatgttgcgtctatggtgtcctttgagatgtccagcccgattatattcattggtattttccttatttatacagccttgatacggctaggatgatattcaatttcgaggatggataaaggcagccggcatttctacgcgtctgttttaatacattgcgggatttgctgcctgactgccttagcccttgctttgcgcgaaacaaagacccgtaaaccgtctatattcaaacggtttacgggtcttttttctctcttgccgttttcttcagtttgccgatccgaccacgcccccgccgattccttcaaacggtttcccgcgttcttcccaattatcgtacattaggttctgctacggttttccgcccaatgtggcaacttgcgccctgtccgaatgttgctgcgcgctttgctgaacttcctgcccttggctttcttctttgtatgggttaaacggcaagccgttttttacatagtccttgcacatcaactccgtcacttctttcaatgccgtcccttgatgcgaatagcaggcgcatccggttcttccgccttctatacagcctgctatatattcaaaggttcttacctgccttacaccgttataaatcggcttgctttcgggtttttcggacaatgtcggaacaaacatatctgcggtaaggttgccgttatttaccggctcgccttctgttttatccggaagtactgcctgctgttctgttgccgccgattcttgtgctgcgggttcttcctgtttttttccgtaactgctcaacattttataggacaggccgacaaacacgggaatcagcaatactattactggcagagtgtaaaaccactttgaccgcttgaccttatttacggtatgaacttccgctgattcgtacaagtcataaacttttttatccagtgtatagatactggagaatgcgcttgatgccatttttacgggatcgtccgcgcatattttccattctaaaagcgtacgcatacccatcttgtttgaagcgatgtggtaatgtttccgtacaagcgttctaagattttgatctagaagcttaggaccttgagtcaaaacaaatatatcaatgccctgatgtctgtgcgtattcagccattggacattttcagggatttttgaacctgccgagcgtgccggccatacgtcttgagcttcatctacaatgacaatagacccgatattttcgggcttctttatccattcgtacatatcatgcgccgaaagctgctcatctgtcgatttcggcagcttttttgcgtccgtttctatgtaggtgtgcggtattttcaagccttttatgttcgtaaatactttacggcgtatgccgttttcatcaggcttaaacatttcatcattcgccatcatggaaaccatttttaatgttttccctgaaccgggcgtgccggttatcaaacagatctctgccatttattttttcttcccgattgaggttgctagttttgtcatttgtttgaatgacagaataaaggcgatcgcgccaaacaggatattaagaacggttccaccgccgcttatataaaaaagctgcaacatcgcttgaggcgcgcccgttatgctattggttatcgcctgctgaaaatgggctaccaatctatccacccctgaataggttaccgccatcaagcctaatgcagtcaatatacggcctgccacgctcatcaaaagcggaatcaatgcggccaacaatttcatttgctatccctttcttaaaaggcacggttgcctcattaaacaaatgtttcttaatctgaaagattttgcgccgcattcgcggcgcggcggcgctgtggggacacccccctcgcgcttatcgccaatccccccgcgcttctcggctatttgcgacattcgtcgcaaagtgcgctgcttcgcctgcctttcggccaaagtttccgaagctgaacgctttgcgggggactagtcccccacaccccctagtctcacttgcgacgccgcgggggcatggggacggcgcaaaaggcgcgcgccttaccacctgcccttgcggcagaatgtgttcttttggcggggcggcaaggggtatccaaaaagatttataaagacgataaagccgtctttacaaatctttctggacgtcctccccctgccttggtacaagttactgaagcccggcggtgctgcgcctgctagacttcacgagatactgtgcggatacaaaaaaaggcggcaaccgcccaagcaagggcgagaagcatgtaccttagccgttcggctatggtacatgcgttctcaaagctgaacgcgaactgcctgcttgaatcaagcacagtcactgtgaaagtgacaggtgcgggacactgtgcggaatcttgaaagattcctgatttctgaaactctacattgacggtttcagacggcagatttaaatcttctgccggattggactcgggcagcctgtcgcaagcgagaatgtcggggaagaatttgcacaaaaggccgccatctttgccgtcctttccgtctttgccgtccctgccgtttgtgcgtcccggaacggcgggggaatcgggtcttgtgccgggctgtccgtccgtatcgggatttgcatcgggattcaaatcggggtcgggttcgggattggggctcgtgccggggttctcattggggttcgggttgtttgcggggttttcggcgggcgatacttcgggcagcggctgtgcgttcggtgcttccgcgcttccgggggtcaagtcgggacgcgggattacttgaacatccaccgtggtgttgccttgcgaatccctgccgaatgttgcgacaacctgaacgggattcccgttcctgtccgtgacgggacccatattcacttttgttccgggtgcgacttctactttttcggaataaccgggataaccggttgcctttatgtatttgtcgggattggcatcgactttcaacgataaaatctcttccagctttttggcatccatttcttctttgtattttgaattgcgaataagggaaaaatcagccccatttctgaaatcatcacctttattgaccaaacaatctccgccattccaattaaatgtgcaacgatttaaaacaaaattattccaatccaaagaacttaatttattcagttcttctttatgccaattccaaaacggacgtgccagcctatacatttggctttccatcaattctttgacttcggggaatctgctgtcatcggacataaggcgcataatcgaactgtcaacgccgtagcagccataggttctattaatacgtcttttgtcttcgtaccaaaggcaattactatattcgtagccttttacaaatttgtcggtttcggggtcgtattggtagccttgtgcctgtatgtcttctttgaaagtttcgtatacgtcatgggctaaaagggctgttccgacataaggaactgcccttgtgcttaatttcgcgcctaagcgggcaagtttgccgactcctgacaagacggcggcgcgggaaactgatgcggtaaatttaacggggactttttcaagagagcgtgcacctgttggcacgtgttctattattgaaggttcgataattcgacctgaaaaacgctgaccatcaacacgaaaatcggtaactacagattttttatgatcaatatccaatctaacatctgaatttccaataggatacttaaaacgttcagcataagaattaaccgaaaacatccccaacattaggattaaaatcaaacgttttaatttcaattccacgactataatcatcctgtaattctaaaatttttatatacgcaacagactcatcagaaaaataaattttccaaatattattagaaatccttctatttaaaaaacattggatttcttcatgaattataaatttattaacttttgaataatccaaaagctcactagcgaaagtatatgccattgttttaccataatacttgcttgacggctgatatttataaagtgccaactgcgcctgcgtgataaacggtttgttcattgttctgcctttcaaaggttgttttgaaagcctgattttaaaacacgtcatttaaatatcaaagcgacagacaaagccaagaagaaaccgagaagaaaccaaaaatcaataaccatcaatcaatcccaaccttgcccatgtcttttaaaaaattaatcaaaagcctgaagccgtaaatgactacgaacagaattaaaaccgtcgaaccgacataagaaccctgtttgatctgctcaaaattggaacatttcggataggacaacattaccggctttccgttcaagacccatttttcgcccaccctttccggcctgatgatttttccgtcctgggtaacagtaggaggaagggacgacaataaatagtcgtctgcatgcaatcttgtatcaaaacaatttatgccgacacgatagcccatttatacgcccctttttcttcactctgtttatttgacagatttaatcatgctccaagccattttgaagccttggattgcaagaatcacggtaatggccgccatacccacggcggaaaccattgacacgaaacccatgattacattcgctacttgcgtaccaatcgcggatggatcaaaggtatctgccataacaatggccggtgtgaagataccggctgccaaggctgcttttacagcgtattttttaacgatgttcatcgtttttttccttttttgatatttaaaataagacgacttcttgacttgcttcatccggacgaagtcttttccgaatctcgtttttagccgataaaatagaggattgcgaaaagaaaaagaaacatacagaccacccagccgataattagtgttgcaaggttcattttcatgatatttttcctttgttgcgggctttgtgaaaggttgacagaccgcccgccgagcctgtttttcttttattccgattttacgaagaactgaaatatctggaatcctccgcctatttcatttatgcctgaattcaacgcatcttcgtagctttcaaattgacctgctgatttaatattttgagtaaaccccacatcaccgaaaggatcgggataaataaagtcatgcgtttccaagtcttgaactatgaaacgttcttcaaatttcataaatcaacctttcggcttttctgccacctgaaaatcaattaatgaaggaaccatgcccttacctgtcgaagtcatttcaaccgttaccataacttcgcacgggtatttgagattctctaattttgagaaattcttactgtccccgaacttcatttgtgctgccgtgaatccaacagcatttcccgactgtgccggcaaaggtgttgcaaccaatacggaacaagtgtcgatattagagccatcaatttcgcctttgaattttttagctcctaaaaaagttgcgggataagttacagtttgagtttgattaaacatattaatttttcctttttaggttaattttgatttgcatgaagatcatacattctgtcgagataaagctgatattgcctctcactttccacatcgtgatgtggatcgaaaagccttttatccggatcgaatttatctgattgcttaaatttgataattccgagttcttccaattcaacctctaaatctacatccggttgttcgtggataaagccgaatttcaaagattccttcaatccggccaacgaatatttttcaggttctagccctttgggataccccaaatctgccttcagatatctgacaatttcatcactatcaaaacccatatcaaacatgaaattaatcagtttgccgaccgcgttttttgcgtatctcaatttatgctgaaaagttaaattagccacttttttacggtaatcgaacctttccggattcggcatatttttaaatttctgacaaatcgggaaagcgcctgaaaagtaagaaccttgatttatcagaatatccaaaggtatttccatatctccatgattaaactgaatttcgaaccttacccacttgctttctttatcgcctagctgcctgcctttctcataaacacgcacaaaacgagaatttttcttgcgacctacataaaatgtcttgccgctcccgtcctctctccgccaagccgttccaaccatttcagatttcggcctcatgttactgttatcgaaaaaaccgttatcgtgatccaaaagtgcctgttccggcgtgtactccccatcaaaaaaatcaagtgccaaatctacccgcgttatcctcggcctcaatgaatcttccaaaaactgcttaagcctcaattcccaacctggatttgcaatgttgcaacctacacctttcaattcgattaaaaccgtatttcgctgacctccgtaatggacttcgccgtagtcaacttcttccgatcccaacctaaacatcgaatcgtaaaatttattgcccttcgatttgcatctgctcgtgatgccaaaccctaatatttcctccaattttttgcttaaaacaaacatatattcggcatcggaaactaaggggcatccggaaactttcagcaaggaatcttcgtgcagtgtgaatgacaaccaatctataaaaacgccgtcctgcctgcccctacgttgcggaatttctaataacttcccattgccgttagatatgaaatgggaaaaatattctgcttcactcattttgttcagtacctttagggatttgttttatttcgctccccccctgttagtcaggggggggctttcagccgtttcccgtctgccgcgctaaagcgcgtccaacggtcaacgaccgaaagcccaatcctgacaaactgttaaagatcaagaagaaagaccacaaccgtctgttgtgataattaccggaaaattcgagccaaccgaatctatataatcgaacgcctgataaagctttgaaaaattttcttgttcagcgagtttatgcggttcaccatgcctgaactgatagaaacataaaacgcaataatctgattttttaaatattctccaataggaacaagaaaatattacatttgctactgacataaaaaagcccctttcacttggctgtcaaaggggaatgttaagaaaagtaatgcgcccctttgatagagcgcatcatataaggcgggaatccagtccgttcagtttcggtcgtttccgataaattcctgctgcttttcatttctagattcccactttcgtgggaatgacggcggaagggttttggttttttccgataaattcttgaggcattgaaattccagattcccgcctgcgcgggaatgatgaattcatccgcacggaaacctgcaccacgtcattcccacgaacctacatcccgtcattcccacgaaagtgggaatctagaatctcaaactttcagataatctttgaatattgctgttgttctaaagtctagattcccgcctgcgcgggaatgacgaatccatccgcacggaaacctgcaccacgtcattcctacgaacctacatcccgtcattcccacgaaagcgggaatccagtccgttcggtttcggtcgtttccgataaattcctgctgcttttcatttctagattcccactttcgtgggaatgacggcggaagggttttggttttttccgataaattcttgagacattgaaattctagattcccgcctgagcgggaatgacgattcataagtttcccgaaattccaacataaccgaaacctgacagtaaccgtagcaactgaaccgtcattcccacgaaagtgggaatctagaatctcagactttcagataatctttgaatattgctgttgttctaaggtctagattcccgcctgcgcgggaatgacggctgcagatgcccgacggtctttatagcggattaacaaaaatcaggacaagacgacgaagccgcaggcagtacaaatagtacggaaccgattcacttggtgcttcagcaccttagagaatcgttctctttgagctaaggcgaggcaacgccgtactggtttttgttaatccgctataacagcaaccttgtcgccgtcattcccgcaaaagcgggaatccagtccgttcagtttcggtcatttccgataaattcctgttgcttttcatttctagattcccactttcgtgggaatgacggcggaagggttttggttttttccgataaattcttgaggcattgaaattctagattcccgcctgagcgggaatccagtccgttcagttccggtcatttccgataaattcctgctgcttttcatttctagattcccactttcgtgggaatgacggcggaagggttttggttttttccgataaattcttgaggcattgaaattccagattcccgcctgcgcgggaatgacggctgcagatgcccgacggtccttatagtggattaacaaaaatcaggacaaggcggcgaagccgcagacagtacagatagtacggaaccgattcacttggtgcttcagcaccttagagaatcgttctcttttttgttcatccgctatattgtgttgaaacatcgccacaaacctgatatagtccgctcctgcaacatcattgaaaatctttctttttaatcagttaaaaccgaatacggagtcgaaaatgaatccagcccccaaaaaaccttctcttctcttctcttctcttctcttctcttctcttctcttctcttctcttctcttccgcagcgcaggcggcaagtgaagacggcagccgcagcccgtattatgtgcaggcggatttagcttatgccgccgaacgtattacccacgattatccgaaagcaaccggtacagacaaagacaaaataagcacagtaagcgattatttcagaaacatccgtgcgcattccatccacccccgagtgtcagtcggctacgatttcggcggctggaggatagcggcagattatgccagttacagaaaatggagcaacaataaatattccgtcaacacaaaagtgttgaaagaaaaccagggcaacaggataaaactgaagacggaaaatcagggaaacggtacgttccacgcctcttcttctctcggcttatccgccatttacgatttcaaactcaacgataaattcgataaattcaaaccctatatcggtgcgcgcgtcgcctacggacacgttaaacatcaggttcattcggtggaaaccaaaaccacgatttataccactgcaccaacgggagacgctacagtgggaggcactatcccagagagaccgagtagcaaacctgcctatcacgaaagcaacagcatcagcagcttggggcttggtgtcatcgctggtgtcggtttcgacatcacgcccaagctgaccttggacaccggataccgctaccacaactggggacgcttggaaaacacccgcttcaaaacccacgaagtctcattgggcatgcgctaccacttctgattccccgataccgatgccgtctgaaccttcagacggcatgagacctttgcctgcgtacttggtacgctggtcgcctccgaacatggcgcgacacccgacatttccgccgaacgcatcgggcgtttcatgaatccggtttaaaacgcatggaaaaatgccgtctgaaagcctttcagacggcattgtgcttgagattccgtttaccaatggctgacaaacgcttccaaatcggtattcttgggcttatgcacttcctctgtcggcgtgccgaccatcatcagcccgatgattttatccttatccgcacaaccgaaagcctcccgcaacagggggctattgacccacatccccgtaatccagacattgtcgaatccctgagccgttgccgccagttgcagcgcatacgccgcacaacccgccgtcagcatctgctcccattccggtttcggcttaggcacatcgcggttcggcgcaaacgttaccccgataaccatcggcgccatattgcccactttttccgcctttttcatcgcatcgtcgccgaaattcaattcggcaaccgtttgcttcaacacatcgcgaaaacgttgcaatcctacctcgccttgaatcacggtaaaacggaaggggcgcatattgccgtgatcgggaacttgggttgccgcctgaaatatttgttccaactccgccgcatcgggggcggggtgcttcagctttttggaagatcggcggttcgtcaataattttaaagcatccatatcgttatactccggtcatcggtcgggtgttcggacacatatgccgtccgaaggcttcagacggcatatccggcatcagcgcggacggcggcaggctgccaatatatccatttccttccgataggtttggctattggaaatgtccatcagccccaataccgtgctgaaatagtggtcgtgcgaatattcgttttccgccgctttttgtttgaggcattggaaatctatgcccccgtgttggcggaaggctttggaaaaccacataaccatcgggatatgcgtctgcccggaaggcgcgatggcgtaaggcgcggcgtgcaggtacatcccgttttcgcccaaactttcgccgtggtcggaaacataatgcaccacgctttccaaatcgtcgcggttttcaagtttgcggataaccttgtcgataaactggtccacatacaaaaccgtattgtcgtaagtgttgaccagcgtggcgcgggtgcatttgttgatttcgttggtgtcgcaggtcggcgtgaatttgcgttcggcttcggtatagcgttcgtaatacgtcggcccgtggctgccgatggtatgcaggattaaaaccgcgtctttatcgtttttgttgaggacttcgtcgaacttagtcagcaggatattgtcgaggcactcgccgttgcggcagtattcgggcaggttgagcgaggtaacgtcggtattcggcactttgccgcacacgcccttgcagccggaatcgttttccaaccaagtaacttccacgccggcgcgctgcacgatgtccagcaggttgtcttggtgttcggctttgatttcgtcataatccgtgcggtcgaaggttgagaacatacacggcagggagtgcgcggtcgatgtgccgcagcttctgacctgcgggaaattgacaatttcatcgccgcgcgcggcaagcagcggcgtagtttggcggctgtaaccgttcaaaccccagttggcggcacgcgtggtctcgcccacgaccagcaccacgaaacggcgcaggctgccggccgggcggttttgcacgaccgccatatccaattgcgtataaggaatattggaacgcttccaatctttgtatttcgacacgcccgcgccgatgaaattagacggcacaatcagatgggttactgatttattgttgcggaaaaacgaggcgtaatcctgatattgcaacattgcgatgcccaacgcgcacaaaaaggaaacggcggcaagcacaaggcgcgtcaaaagctccttataccaaacgcggtatttaaccttgacggcgatatacgccagcgcgggcaatacgcccaaacatacaatccacagcacatagcccggcgtaatcaggcgcgcgctttcggcagccgtagtttgcaagacattattcaacatcgacttgttgaaatagatattgaaaaatatttcttggtaagacaccgccgcactgataaccaatatcaacggaatcaataccttatgcacgaaaggcagggcaatgacgtgaaaaacgaaattacttaaaaaaaacagcaccaccggcatcgtatagaggaagatatccgccccggtgccgttaaaaggatgaagctcgacaactttggcaaaaaaggcgtaattcaataccagcgaggaatacagggaaaggaaggcaatcagcgcggaagagccgagcttcggcctcaggttcggttttatcatttggaatgtgtcggataagggttggaaaaggcatccggcatttggaatccggattattgaaaaagattcttaattataaggcaacggagcaaagcagggcaagaaaacggcggctgtgcggggggttccgcccgccattcaaacgtccggcagacataaaaacatcgtaagcaagattcgaaccggtctgcaaccgcccctgccagaaaaacgggcaaagcatttcatattggaaaaacccagccgcgccgccgacgggacagtccggcacaaacagcatcacgctcggattgaaaaggacggatagccgccggcagcacaatcttaccacctccaaaacgccgccggagaacgccgaaacagccgatgccgtctgaagccgcttcagacaacatcgggacatcaaccgtaacgccgttggaaatcgcgcataaaatctgccaaagcccgcacgccttcaagcggcatcgcattataaatgctggcacgcataccgccgacggttttatagcccttaagcaggcacaagccctgcaattcggcttccagcacaaaacggcggtcaagctcctcatcccccgtttggaacacgacattcattttagaacgcgcattcggacggatacggttgatataaaaaccatcgctgccgtctatcgtctcatacaaggtttgcgccttcagccgattgaccgcttcaatttttttcacaccgccctgcgcctgtagccagcggaacaccagccccgacatataaatcgcgtaagttgacggcgtgttgtacataccgtcgcggttgatgtgcgaacggtagttgaacacatcgggaatatcgttcggacaacgctcgagcaaatcctcacgcacaatcaccaccgtaactcctgccggcccgatgtttttctgtgcgcctgcgtaaatcagtccgtagtcggcaacatcaaactcgcgcgacaaaatctcgctggacatatcgcacaccagcggcggcatgccttctgaaaggcacggcacttcacggtattgcagcccgttgaccgtttcattgacggcaaaatggacaaacgccgaatcgggtgcaacatcccacgtttccacaggcggcaggtcgagatagtcgaactgctcgccgccatgcgccgccaaacggatttccgtatcggtcaaacggctcatctgttcataagcgatacggctccagttgcccgttaccaccgcgtcggcagtgcggaaaccgtgtgccagattcatggctgccatattaaattgggttgttgctccgccctgcagaaacaatatcttatagttgtcaggcactttcaaaagctgcctcaaatcctgttccgcatgatgcaggatgctcaaaaacatttccgaacggtggctcattgccatcacaggaaaacccgtaccgttgtagtccaacatttcctgccgcgccgtttccaacacggcttcgggcaatacggcagggccggcggaaaaattgtaaatcggataaagagacatgatgcagccttgattctgaacaataacccgcccgattttaggcttgcagcaggctttgtgcaaggatggaaaatacctgtcctccgcccgattccatgccgcccgaacacggaaaataatatcaatatattgatttacaaacataaaaatcatgcacgcgacaaatagatacatttgttttgtcaacaatattcacgatttcccattacaaacctcccttacacccgcttttttccgtcccaaaaacacaaaataaatcaacactttcatttctccgcaaaagcggttataatcacgccgatttttcaactttgacgaaaaatggccacggggccatttttttattatgtacatagggagcagcatggatatccaaaccatcctcgaaaaaaccctgcccggcctgggctacgaactggtcgatttcgaactgaccgcgcaaggaacattgcgcgtgttcatcgacaaagaaagcggcattaccgtcgaagactgcgcaaccgtcagcaaccacttgagccgcgtcttcatggttgaagacatcgactacaaaaacctggaaatttccagccccggactcgaccgccccttgaaaaaagccgccgacttcgtgcgctttgccggtcagaatgccaaaatcaaaacccgcctgccgatagacggtcagaaaaactttatcggtaaaatcgaaggctgcgaaaacgataccgttaccgtatccttcgacggcaaaaccgtacaaatcgaattgggcaacatcgacaaagcccgtctgcgccccgaattcaaattctaaaacacaacaatattggagatgttcaaaatgagtcgtgaaatgttacagctggcagaagcactggcaagcgaaaaaaacgttgatgcggaagtcgtcttccaagcactggaattcgccctgtctaccgccgccaagaaaaaggcagaccgcgaacacatggacgtgcgcgtccaaatcaaccgcgacaccggcgaataccaaaccttccgccgctggctgattgtcgccgatgaagactatacctatcccgatgtcgaaaaaaccatcgaggaaatccaagaggaaattcccggcactaccatccaaatcggcgaatactacgaagagcagctgcccaacgaaggcttcggccgccaagccgcgcaaaccgccaaacaaatcatcctgcaacgcatccgcgatgccgagcgcgagcagaatctgaacgagtttctcgccgtcaaagaagacatcgtgtccggcacggtcaaacgcgtcgaacgccacggcatcatcgtcgaagtcgttgccggcaaactggacgcgctgattccgcgcgaccaaatgattccgcgcgaaaacttccgcagcggcgaccgcatccgcgccctcttcctgcgcgtcgaagaaatcggcaacaccggccgcaaacaagtcattctgagccgtacttccggcgatttcctcgtcaaactgtacgccaatgaagtacctgaaattgcagacggcatgcttgaaatccgcgctgtcgcccgcgacccgggacaacgtgccaaagtcgccgtcaaagccaacgaccagcgcatcgatccgcaaggcacctgtatcggcgttcgcggttcgcgtgtcaatgccgtcagcaacgaattgtccggcgagcgcatcgatgtcgtcctctggtcgcccgaacccgcgcaattcgtgatgagcgcgctctcacccgccgaagtcagccgcatcgtcatcgacgaagacaaacacgccgtcgatgtcatcgttgccgaagaccagctcgcgctcgccatcgggcgcggcggtcaaaacgtgcgccttgcttccgacctgaccggctggcagctcaacatcatgacttccgccgaggcagacgaacgcaatgcggcagaagatgccgccatccgccgcctgtttatggatcacttgaacgtggacgaagaaaccgccgacgtactggttcaggaaggttttgcaaccttggaagaagtcgcctatgttcctgccgccgaactgcttgccattgaaggatttgacgaagaaatcgtcgatatgctccgcaaccgcgcccgcgatgccatcctgaccatggcgattgccgccgaagaaaaactgggcgaagtgtccgacgatatgcgcaacctcgaaggcatagatgccgatatgctccgcagccttgccgaagcaggcattaccacccgcgacgacttggcagagcttgctgtggacgaactgattgaaatcaccggtgtaaacgaagaaaccgcaaaagccgtcatcctgaccgcacgcgaacactggtttaccgaagacaaataaagggggtacagatgagtaacacaaccgtagaacaatttgccgccgagctgaaacgccccgtcgaagacctgttgaaacagttgaaagaagccggcgtcagcaaaaacagcggcagcgattccctgacgctggacgacaaacagcttctgaacgcctacctgaccaagaaaaacggcagcaacagcagcaccatcagcatccgccgcaccaaaaccgaagtcagcaccgttgacggcgtaaaagtcgaaacacgcaaacgcggacgcactgtcaagattccttctgccgaagaattggcagcacaggtaaaagccgcccaaacccaagccgcacctgtccggccggagcagacggcagaagacgcggcaaaagcccgagccgaagctgccgcacgcgcagaagcccgtgccaaggcagaagcggaagcggcaaaactgaaagcggcaaaagcaggcaacaaagccaaacctgccgcgcagaaacccaccgaagcaaaagccgaaaccgcacccgttgcggcggaaaccaaacccgccgaagaaagcaaagcggaaaaagcccaagccgacaaaatgccgtctgaaaaacccgccgagcccaaagaaaaagccgccaagccgaaacacgagcgaaacggcaaaggcaaagatgccaaaaaaccggcgaaacctgccgcacctgccgtgccgcaacccgtggtcagcgcggaagaacaggcgcaacgcgacgaagaagcacgccgtgccgccgcacttcgcgcccaccaggaagccctgttgaaagagaaacaggaacgccaggcacgccgcgaagccatgaaacaacaggcagaacaacaggcaaaagccgcacaggaagccaaaaccggcagacagcgtcccgccaaacctgccgaaaaaccgcaggcagccgcgccagccgtcgaaaataaacctgtcaatccggcaaaagcgaaaaaagaagaccgccgcaaccgcgatgacgaaggtcaaggccgaaacgccaaaggcaaaggcggaaaaggcggacgcgaccgcaacaatgcacgcaatggcgacgacgagcgcgtacgcggcggcaaaaaaggcaaaaaactcaaactcgagccgaaccaacacgccttccaagcaccgaccgaacccgtcgttcatgaagttttggttcccgaaaccattaccgttgccgatttggcgcacaaaatggcggtcaaaggcgtggaagtggtcaaagccctgatgaagatgggcatgatggttaccatcaaccaatccatcgaccaagacaccgccctgattgtggtggaagaactcggccacatcggcaaacctgccgcagccgacgaccctgaagcattcttggacgagggcgcggaagcagtggaagccgaagcattgccgcgtccgcccgtcgttaccgtgatgggccacgtcgaccacggcaaaacctcgctgctggactacatccgccgtaccaaagtggtacagggcgaagcgggcggcattacgcagcacatcggcgcgtaccacgttgaaacccctcgcggcgtgattaccttcttggacaccccgggccacgaagcctttaccgctatgcgcgcacgcggtgcgaaagcaaccgacatcgtgattctcgtggtcgccgccgacgacggcgtgatgccgcaaaccatcgaagcgattgcccacgccaaagctgcgggtgtaccgatggtggttgccgtcaacaaaatcgataaagaagccgccaacccagagcgtatccgccaagagctgaccgcacacgaagttgtgcctgacgaatggggcggcgatgtacagtttatcgacgtttccgctaaaaaaggcctgaacatcgatgcattgctcgaagccgtcttgctcgaagctgaagttttggaactgaccgcacctgtcgatgcgcccgccaaaggcatcatcgtcgaggcgcgcttggacaaaggccgcggcgcggttgccacattgctggttcaaagcggcacgctgaaaaaaggcgatatgctgctggccggtacggcattcggcaaaatccgcgcgatggtcgatgaaaacggcaaatccattaccgaagccggtccgtccatccccgtcgaaatcctcggcttgtccgacgtaccgaatgcgggtgaagacgcgatggtattggcggacgagaaaaaagcgcgcgaaatcgccctcttccgccaaggcaaataccgcgacgtgcgccttgccaaacagcaggcggcgaagctggaaaatatgttcaacaatatgggcgaaacccaggcccaatctttgtcggtcatcatcaaggcagacgtgcagggctcttacgaggctttggcgggcagcctgaaaaaactgtccacagacgaagtgaaagtgaacgtgttgcacagcggcgtgggcggcattaccgaatcggatgtcaaccttgccatcgcttcgggcgcattcattatcggctttaacgtgcgtgcagatgcctcttcgcgcaaacttgccgaaaatgaaaacgtggaaatccgctactacaacatcatctacgatgccatcaacgacgtgaaggcggcgatgagcggtatgctttccccggaagagaaagaacaggttaccggtacggtcgaaatccgtcaggtcatctccgtttccaaagtcggcaacattgcaggctgtatggttaccgacggcgtggtcaaacgcgattcccatgtccgcctcatccgcaacaacgtggttatccacacgggcgaactggcttcgttgaaacgctataaagacgatgtaaaagaagtccgcatgggcttcgagtgcggtctgatgctcaaaggctacaacgaaatcatggaaggcgaccaactggaatgcttcgacatcgtcgaagttgcccgcagcctgtaattcctttgcaaataaaatgccgtctgaagcgttcagacggcatacgaaacgggttctgtatcatacagaacccgttttttgtcgcaaatcggcttcagacagccctcttgccttatcccgatttgaatctgacttgccatacaaacaggcttcagacggcattatttgcccgctaaacgtatcccaagcttctccgcatattccctgcgttcggcgcggctggtttccgggcggtgcgtattgagcgacgaccatttccaatgactgcgggctttgttgagttcgggcgggagtctggcggcatcccacgggactttgcggctgtgcagctcgatatccgactgtgccgcgtgtccgcgcgtttgcaggacgtggagcaaatcgagggcgcgggcggcgagcagggtcagggtttcagggtcggtgtgcagggtttggcggccagcgagtttgtcggaaatggtgcgggtattgggcaggatgccgcccaaaaagccgccgattgccgtacccaatccgagcgagccgccgagtgtggcgatgtccagccccaagccgatgagcgcgccggttgccgcgcccgtgccggtgcggatgccgtattgtttgagcaattcgctgtcgaacgggtcttggcggaaggcttgcggcatccagtcgccgccgtcgatttcgctgtggtagaaacggtagagggcaaacagccgctgctgcatctgccgttcgagttggcgtatttccgcctgcatggtttgcagcacggtggcggtatcctcgttttcgtccacttcctgcctgaaggcggcggcatcaattaaaaagtcggcgatttcgcggcgcgcttcgccgtccagccgctgccattcgcgccggcgcatggctgtcaggcggtcaagtgtgctgcgttcgggcaacatggtggcgaggttttcccacaggcgcagttcgccttcaaaatcaaaggcgacggtgtcgaaccctgcgaaaacgtgcaggtttctcctcgccagcatggttgtccacgattcgggaagctgtccgccggtaaagttgaacacgggcataaccggtttggcacaccatgaaaggatggtcaactcgtccctgtatttgtcgaggacgggttcgcgcgcgtcgatgacgtacattgccatatcgctttgcaagacttgccgtaagactttggcttcctgattgaaatcatggtgcgcaccgtggctgccgagaaactgttgcagccgttcgatgccgtctgaacgattgtccgtatggttttccagccattccagcacgccgcccgcgtcttcgagtccgggcgtgtcgtacaggaaaaccagcgtgtctgcgccgtcgctgatggcggcttcttcgacatgacgcgtggtcgatggggcgtttttgacttcgccgaaaccgctgtcgcgcaaaagggtacgcaggagcgaggttttgccggtgttggtgtgtccgacgacggcgagggaaaggggttgtttgttcatgatgtttttgaagaatggattttcagacggtcttttttcagaatggcggcttaacagaacatttcaagtgagtttattggtctttcaaacgcccttcctgcgccgccctgtcaggctcaagccacgccgcgccgcattcggccagcgcgttacgccaatgttccagcttttccgaaaggtcgtctgaaagcccctgttccgccaaaagctgcaccaccgcgccgccctgcgccgcttccgagagtcggacaatctgccgcaacacgccgcggtccggcacagtttgggcgcgcacgccgataagcagttgcgccggtttctgcttcagctctgtctccagcgcggcaacctgttcccgattggtggcaacgcccttatccagccattcctgcgccagcctgccctcgaaccattcgccgtcctgccactcggtctccagcatgaccgcccatttcggcgcatcgttcaagatgattttcggtgaaacggcggacacggtttcccgacgcgtatccgcatcggtgattttgttctgccagcggcggatgaccgcctgataatagggcttttccaaatccaatccgttttcgcttgttttcaaaaggattttacacactacccaagccagcaggcgcggcaggatgccgtagcaggcgatactgccgaccagcagccccgaccaagcccgcgcatcggcaatattgccgttcagacggccttcgatgaccgcccgcgcatcggggacagggaaaccgagtttcgacggcagccatgccaacatttccaccgcgcgtaccgaagcggcattgctcaacagcgtgctttcccagttgaacgtatattgccgcaccaaaagcagcaacaataccgacaccagcattccgagcagcgtgcagagccacaggctgtgcgacgttgcgcctattttccaacgtaccgaaggttgccgccactcgtccgcatacagccgcaacaccgcctgatttacagggtctttgccccgaaaccacgtcgccggactgctgaaaaaacgccccactttcacacgcaggaacaacattgccaaccatactgccagcatcagcgtattcatgcccaacacgcccgccaaaaccaaaaagaaattcagaccctgattgtccattagaagataagtgactgaaaaaccggtaaaaaatgcaaacgtcgccgccaccacccacaaccagaacgaccccgcacgcacacgttccaacgtctcccgcagcatacggttcctgtcaatcatctccgcccgacggatgattttttcctccgtactgccgtccacgcggcgcaaagcctccgtcgcctgtacgggatcgccgctgaaaataaaaccgccttcgtccaaaatacggaccagctcaaccagttttcgggatggattcaacataaaatgccgtctgaaaataaaaaacagattttaacacacgcattttcaagaatattcacagtgtaggcaaagagtaaatctcacacagaagcaaaagtatcggcgtaaactgactgcctctactttcccgaaagattgtgcgatgtatacaggcgaacgcttcaatacttacagccatttgagcggtttgattctggcggcggcaggtttggcgctgatgctgctgaaaaccataggacacggggacggctaccgtatcttcagcgtatcggtttacggcatcagccttcttctgctctatttgagttcctcgctgtaccacggaattgcagccggaaaactgaaaagcattttgaaaaaaaccgaccactgcatgatttatgtgctgattgccggaagctacacaccgtttgcactggtttctttgagaaacgggccgggctggacggtattttcactgtcctggctgctggcggctgcaggaatcgcacaagaactcaccatcggacggaaaagcgaaaaacgtctgctgtctattgtgatttatgtcgtcatgggttggatggtcttggcggtaatgaaatccctgacagcctcactcccgtcggcaggactggcttggctggcggcaggcggtatgctgtacagtgtcggcatttactggtttgtaaacgatgaaaaaatccgacacgggcacggaatctggcatctgttcgtattgggcggcagcatcacccaatttgtcagcgtgtacggttacgtaatctgaatgccgtctgaaaagcaaaacctcccgttcctgaagattgggaggttttctgtttgccggacatcagcccttgtcgtggaactcgtggaattcatactgataggacaaatcccgacccgcttttttctgtgccaaataatcatcataaatggcgcggatttccttacgcaacaaaaacagggctatcaggttggggataaccataaaaccgttgaacatatccgacagactccaaaccaaatcgactttgccgagcgtacccaaaacaatggcaagcagaaccaatgcgcgatagatgcccaagtgtcttcccctgaaaagaaaacggatattggactcgccgaaataataccaaccgatgatggtggtgaaggcaaagaaggtcagacacacggcaagcaattgcgaaccgaagcccggaaatgccttgttaaaggcaaattgagtaaccgccgcgccctgttcgcccgaaaggttggcatcggtcagcaggataatcaatgccgtagccgtacataccaaaatcgtatcgataaacacaccgacaaatgccgccataccttgctgcacagggtgcttcacatccgcagtcgcgtgggcgtgcggagtcgaacccatacctgcttcgttggaaaacagaccgcgcgccacgccgaaacgtatcgcttcgcgcataccgatacccgcagcaccgcccaaaacggcttcgggattgaaggcggcggtaaagatgtggttgaacatcggcacaatatggtcggaaaattcaaacaggataacgacggcgcacaaaatataaacaaccgccataaacggcacgacaaattgggcgatattggcaatacggttcacgccgccaatcacaaccatgcccgcaaggacggcaagcacaataccgactgccaaagaaggcacatcaaatgcaatggtaacggcagaagcaatggagtttgcctgtgtcgcattaccgataaagcccaatgcgataatcaacgcaatggaaaagaaaccggacaaaaaacgcgccgcgcccctgccgattttcggagtcagaccgtgggtgatgtagaacgccggcccgccgatgtatttgccgtggctgacgacgcggtatttctgcgccagcagtgcctccgcaaaaatcgtggacatccccaaaacggcagaaacccacatccaaaaaatcgcgcccggcccgcctgcggtgatggcggtcgccacgccggcaacgttgcccgtaccgatttgcgcagatatggcaaccgccaacgcctgaaactgcgataaagacttgtcgtctttatcgcctttggcaaacaagccgccgaatacggatttgaatcccgcgcccagcttggtaatctgcggcgcaccaagatacagcgtaaaaaacaggccgatacccaaaagcgcgtaaatcagcaggtagtcccaaaggaaccgattgactgtacccaccagaacagacaatatattttccataaaataaaccttatcttacaattaaaatgactgccttccaaaagacattccaataaggaaacacggcgagcagaccgtatttgccgcaacagatgccttaaattgtcaacaatcggggagaagctgcgccatcataccgtaaaatatcgttaattaaaacatttctttatttttaagcggaaagcggaggaaatcgctttcagacagcatagacaacggcacggcataaaacaggatattttgggtacttgcaacttatgttaaaatgccgaccgtaaaaaatctgacaaaaacagattaattatttgaaataagaaaggaaatttatggcaggccatagcaagtgggcaaatatccagcataaaaaagcccgtcaggatgccaaacgcggcaaaatctttacccgtttaatcaaagaaatcaccgttgcggcgcgtatgggcggcggcgaccccggttcaaatccgcgcctgcgcctggctttggaaaaagcagccgaaaacaatatgcccaaagacaatgtgcaacgcgccatcgacaaaggcacgggcaacttggaaggcgtggaatacatcgagttgcgctacgaaggctacggcatcggcggcgcggctttgatggtggactgcctgaccgacaacaaaacccgcaccgttgcggacgtacgccacgcgtttaccaaaaacggcggcaacttgggtaccgacggctgcgtggcgttcaacttcgtgcatcagggctatttggtattcgaacccggcgttgacgaagacgcgctgatggaagcggctttggaagccggtgcggaagacgtggttaccaacgacgacggttccatcgaagtcattaccgcgccaaacgattgggcgggcgtaaaatccgctttggaggcggcaggttacaaatccgttgacggcgacgttacgatgcgcgcccaaaacgaaaccgaactctccggcgacgatgccgtcaaaatgcaaaaactgattgacgcgctggaagacttggacgacgtgcaagacgtttacacttccgccgtattgaatctggactgatacgcagcacagcagacatacaataaaatgccgtctgaacctttcagacggcattgatttatttagcccttgcccacgcccaccaaaccgtcaggacaaccgccagaaaatacgccacgctccaaacaggcaaagcaattcccagcagataatccggttcagcacaatttccgaacccgcgcacgacaggctcgaaccaatcaaacaaaggccagcctttcaagcggaacgtccacggcgcgccgcacgaaggagcggttcccggcggcagcgactgcaaccacaactgatatgccgcaacagaaatacccgtaacggccggaatgctgataaagacagcaccgaacaaaccgcctgcccttcttcttggtctgcacatcaggacaattgccgtacacaatgcggttgccaaaacgcataaccgctgactgatacacaaaacgcaaggctccatacccaaaacatactgtgccgccaaagaaccggcaaatgcacagaccgaaacggcaaacagcagccaaacggcttttctaaataacggggtcattttctcaacacaccaatcaaaataccgatatgccgattttgctggatatatcccgagatggcaagggacaaaacggcgatttgcccgcacaatgcccacaaaaaaatacatccggaggatttgaatttcagcaaatttagcgaatcaaaagtttatttcaatgaaatcatatgatttttttgaataagcggattgatgggtttttgaaggaatttgttaccggatagccatcgggcaagttttttgcaaaatttgaatcggtcgggtaaattttcaaaaaataattgacagcggataagaaacggcggataattcccgccgtcgagttgcttgatgcagcttgatttttctcctctatttctcctttgtagacttggcacacattcaactggatgtgtgcatttttttatctccgctttttttgaaatttaattacttttattgtttgaaattccattctttaagaaatttaacaagaaaaacgcttgctttttgaccggaaaagctgcataattcattccgttagctggttcgagtagtcagttaatagtttctcctctatttctcctttgtagacttggcacacattcaactggatgtgtgcatttttttatctgaagcaacaagcctctgtgcgtgatgttgttatgtttcatttaggtgtcaaaccgcatatccggtctgaaatattcaatccaaatccaaaaccggattttctttgacctcctccatcacaacataactcctactctccgaagcggcaggcagttgcaataggatattgcctagcatatcccgataggcagacatatcgggcaaacgtactttaatcagatagtcgtattcgcccgacaccaagtggcattccataatttgcggaattttcagcacttcttttttgaaatcttcgaaaatattgcccgatttggattgcagcttcagctcgacaaaaaccaataaaggtttgcccaacagatggggattgagatgggcgtgataaccggaaatataatgttcccgctccaaacggcgcaccctctctgtaacgggcgtggtggacaagcctaccttctcggcaagctccgtcatcgggatgcgggcattctgttgaaggatcttaaggatgcggaaatcgattttatctagttctttcatttagattgccttgtatttattattgattttaacaaatagagtatatagtggattaacaaaaaccagtacggcgttgcctcgccttgccgtactatttgtactgtctgcggcttcgtcgccttgtcctgatttttgttaatccactatatatttgagaaagcgattatatcaggaaaagcaaaccgccttcctacctgaaaactgctgcttcggcttgaagacacaaggttctttaatattttaaaagccttgccgttggattataatcccccaaccgatttcttaattttgctaataaacacttgcttggtaaggaatgaatttatgcgccctttgaacgtgcagatcaggttgggcaaccttaggcacaattatcggattttgaaggaaatgcacggaggcaaactgttggcggtagtgaaggccgacgcatacggacacggtgcggtcagatgtgctttcgcgctggcagacttggcagacggctttgccgtggcgacaatcgatgaaggaatcaggctgcgggagagcggcattacccatccgattgtccttttggaaggcgtatttgaagcatcggaatacgaagcggtcgaacaatactcgctttggccggcagtcggaaaccaatggcagcttgaggctttgctgatccgccattggaaaaaaaccgtcaaagtctggttgaaaatggattcggggatgcaccgtaccggttttttccctcatgattacgcttcggcatatgcggcattgaagcagtcggaatatgtggacagtattgtcaaattctcgcatttctcctgtgcggacgaacccgaaagcggtatgacggaaatacagatggaagcattcgatttgggtacggaagggctggaaggcgaagaaagccttgccaactccgccgctattttgaatgttcccgaagcacgcagggactgggggcgcgccggtctggcgttatacggcatttccccgttcggaggaggcgatgacaggctgaagcccgtgatgaggctttcaacccgtattttcggcgaacgcgttttacagccgcactcccctatcggttatggcgcaacattttataccagcaaatctacgcgcgtcggcctgattgcctgcggttatgcggacggttatccgcgccgcgccccaagcaattcccccgtcgctgtcgacggcaaattgacccgggtcatcggcagggtctctatggatatgatgaccatcgagctggatgcttcgcaagaaggtttgggacacgaggtcgaactgtggggcgatacggtcaacatcaataccgttgccgaagcggccggaaccatcccttacgaattgatgtgcaatatcaaacgtgcaaaattcacttatatcgagtaatcaagtccaaacgaaaatgccgtctgaagcctttcagacggcatttccccatcaaaaccgcaatcagtttttcatcgattgaaccggagccggaattctgccgcctcggttgacgaatacttcgcacgaaccttctttgaccggcatcacaggcgcgtagcccaacaagccgccgaactcgacgctgtcgccgacggttttaccggttaccggaataatgcgcacggcagtggttttgctgttgatcatgccgatggcggcttcgtcggcaatgatgccggaaatggtgtgcgcgggcgtgtcgccgggaacggcaatcatatccaagccgaccgaacaaacggcggtcatggcttcgagtttgtccagcgtcagcacgcctgcttcggcggcggcaatcataccttcgtcttcggaaacggggataaacgcgccactcaaacccccgaccgcgctggaagccatcatgccgccttttttcacggcatcgttcagcaatgccaaagctgctgttgtgccgtgcgtaccgcagacgctcaagcccatttcttcaagaatgcgtgccactgagtcgccgacggcgggggtcggcgccagcgacaagtcgagaataccaaacgggatattcagcatttttgaggcttcgcggccgatgagttcgcccacgcgggtaattttgaaagcagttttcttcactacttccgcaacttcggtcaatgtcgttgcatctgaattttccaacgcggcttttacgacacctgggccggatacgccgacattgataacggcatccgcttcgcccgaaccatgaaacgcgcccgccataaacgggttgtcttccaccgcgttgcagaacacgacaattttagcgcagccgaaaccttcgggcgtgatttccgccgtgcgtttgacggtttcgcccgccagcttgaccgcatccatattgataccggcacgcgtactgccgatattgatggagctgcacacaatatcggtagtcttcatcgcttcgggaatggagcggattaacacctcatccgaaggcgacatccctttttgcaccaacgcggaaaaaccgccgataaaagacacaccgatggctttggcagctttatccaaagtttgcgccacgctgacgtaagaatcagcatgggtggccgccgcgatttgggcaatcggcgtaacggaaatgcgctgattcacaatcggtacgccgtatttggcagacagatattttgccgtagtgaccaagtctttgccgactgtggtaattttattgtaaatattttggttcaacacattgatatcgctgctgatgcagtcgtgcaaatcaatgccgatggtaatggtgcggacatcaaaattctggtcggcaaccattttgacggtttctaaaatttcgccggattggatactcatcacattcctccaactcaaatgcggtgcatcgcttggaagatttcttcgttttgcatacggatatcaagcgcgagttttttgctctcttccgcaaacaaatccaaaacctcttgacgcgatttgctgcattttgaagtgtccaccaagataatcatagtaaaaaaatcgtccatcagctgttggctgatgttgagaatattgatttggttttccgccaaaattttggaaacatcgtacacgatgccgacgcggtctttaccgatgacggtgatgactgaattgttcacaggcttactccttgcagatatccgttaaagtccgaaattataccaccgttggattttgaagaaatattgtcaacaatatatacatacaaaatgccgtctgaaactatttcagacagcatcaagattcagggttcgattaaataaccatccttatcccactgggttttcctgaccaacttgtcatcctgataaacagcttcgctctttttagaaccatcttcataccactccaaaaccaccccgttgcgttgatggtggcggatagacagttccgagagtaatcggccgctttcatcccaagtcagaattttggcaggctcatcgttgaccataaccatttccgtcttgatactgccgtcggcataccattgcttccatacgccgtttgccttattttgcttaaactggatttcgctttccttgccgccgttacggtaatagcggtatcccgtaccctcactcaagccatttttataaggcataacggcagattttttaccgttcggataccagttgacccactccccgtccggcttacccttgctgaagccccccgccatttttttctgaccattaaaatgccacaaaatcaacataccgttttgcagggtaggcacaaaagatttgatttgcgttgaagcaacgatataaggttcagaatatttcttcatcgacggataataaaaatcctgcgcgtgcgcaatacccgccaccacactatattgcctgatataagcggcagaagacatcgtcgccgtcagctttccgttctgattaaaataaacagaataggtctgcgccggcaaagcggccgaaaaacccaacaggacagttgaaaatacaatccgagataattttttcattgcaatagcgatataaaaacaaggctgtgttttagtaatctgttgatttcaattatttgcaagggaaaagacaattattttccggttaggaataaacctattctattgaatatattgaagccaagtacgcctatcaacactatattaaaacactgccaaaaacaattaacttataaacaatatggtaaggatttctctgccaagcatcaaacccgagacaacgtatcgtaaaaatgccgtctgaaaacaaatcgtcttcagacggcatttccccttcaactcactcttcacccaataactgctcgcgcgtcaagaggaaaacaaaaccgtcgcccccgctggtttccaaccaagtaaaaggcaactccggatacgctgcttccaatacatccctgttatgcccgatttccaccagcaatacacctttgggattcagaaactttgccgcattcagaagaatctgcctggtggcatccaacccgtccgccccgctgcccaatgccaattccggttcgtgcaaatactcttcaggcaataactcaaccgattccgcatccacataaggaggattggaaacaatcaaatcataagtgccttccaatccttcaaacaaatccgtatgaataagccggatgcgttcttccaaaccataatcttcgacattaatccctgccacttccaaagcatccaagctcacatcaaccgcatcaatttgggcatcaggataatgatgcgccatctgaatggcaaggcaaccgcttccggtgcaaagatccaaagcattatgcaccaactcatcgtattctatccaaggacgaagtccgtcacccaacaattcataaataaaagaacgaggtatgattacgcgctcatccacatagaaatcaaactctccctgccatgcctggtgtgtcaaataagcggctggaatgtgttcgacagcacgacgctcaataaccgccagcacttcctctttttcagcttccaagagttttgcatcaagatatggggcaagcatatccaaaggcaaattcaaagtatgcagaatcaaataagctgcttcatcatgcgcattatctgttccatgaccaaaaaagagccctgcctcattaaaacggctgactgcaaaacgtaaaatatcgcggatagtcgtcaattcttgtgctgcctgattaaacataatatgaaccattctgcgtatagatacttttaattataacagaaacaacaagcaaaccttttcatatcgccaaataaccacccaatctacccatacaactacataaatgcccgcgcgaaaaccatcgcccgaacggaaacgacaatggccgacggtatgggcaatctgattggctgggaaaaaacggggcttgttgtcggtaagcagtggataaccgcaaaagacgacaaggtgtccgatgtctgcaatgccaacggcgagatgggcgtaatcgggctttacgagcctttctcacacggcgcattgacgatacccggtcatccgaactgccgatgcgaggttgtttccgtatcgggtggcgaattgggggaatttgccgaaaaaaaggagcttcgtaaagcggctatgcagtatgcgcgggataactttatcggcaaaagctatgtcaataaaaacagcgggcatgaactgaaggtaacttggcaaggtgtgaaacacgctgcgtcaaaggcaaatcaggcggaattatccatcatgacaaaacttgatgacttattgcgctacgcaaaatatgagggttcttattcggataggaaaggtcatcctaatattattgcagcacataagtatcgtgccgttgccaaggttgggaatgagtctttaaatatcggtgtgattgtaagggaatttccagacgaccataaacattacgaccatttcatcttgaaggatgaataaagcccttttgcagtgtcgttctggagcggatagcgttaaggcaagtacacttccagccttgaaaaagggctttaaattcagcatgccatttatacaggcaggagtaaacccatgacaaagttatacgcagaaatcgccaagatggagacgcaggacgacgacacggtcaaggtttggggttacgcttcaagcgaggaaatcgattcggacggcgaagtcatcgcggcggcagctatgaaggcggcgattcccgattatatgaagtttggcgcggggcgcgagatgcacggctcaaacgctgcgggaacggcaattgaaatcaacgtggaagatgacggcagaacctttttcgtggcgcatatcgtcgatcccgttgccgtgacgaaggtcaaaacaggcgtttacaagggcttttccatcggcggcagcgttaccgcccacgatgagttgaacaagtcgcaaatcacgggtttgaagctgacggaaatcagcttggttgaccgacccgccaatcccgatgcggtgtctacctgctttaaggcggacaaaggtgcggaagcggtaaacaacgatacagaacataatgctacatattttagccatttcccttccaaacaaaaaagcaccgacggcggccgatgccctttcctttacaggttcccctattttttatccgcgggcagcaccggtttggctggggcttttggtgcgggcgcgccgaccgaagcctggtccttcagcttcgccagcaccgcagggccgatgccctttaccttggtcaaatcgtctacagacttgaacgcaccgttttgcgcacggtattccgcaatggccttcgccttcgccgggcctatgcccggcagcgcctccaactcctgctgcgaagccgcattgatgtttaccgccgcaagggagaaggcgcaggagaacagcatacagaacagcacgaacattttcttcatggtttttcctttaagggttgcaaacaataaaccgcatcttgcgacgataaaacgagtcattctaaaatgaatatcccaaagtttcaagccgttcctccgcaaacccgaccggacaccgtacggatgccgtcccgccatcaccgacattttttccgggcaaagcaaacattttttccgggcaaagcaaaaacccccgaataatcgggggttttctgaatgggtgtttggcagtgacctactttcgcatggaagaaccacactatcatcggcgctgagtcgtttcacggtcctgttcgggatgggaaggcgtgggaccaactcgctatggccgccaaacttaaactgttacaaatcggtaaagccttaatcaatatattcggtaatgactgaatcagtcagtaagcttttatctcttgaagttcttcaaatgatagagtcaagcctcacgagcaattagtatgggttagcttcacgcgttaccgcgcttccacaccccacctatcaacgtcctggtctcgaacgactctttagtgcggttaaaccgcaagggaagtctcatcttcaggcgagtttcgcgcttagatgctttcagcgcttatctcttccgaacttagctacccggctatgcaactggcgttacaaccggtacaccagaggttcgtccactccggtcctctcgtactaggagcagcccccgtcaaacttccaacgcccactgcagatagggaccaaactgtctcacgacgttttaaacccagctcacgtaccactttaaatggcgaacagccatacccttgggaccgactacagccccaggatgtgatgagccgacatcgaggtgccaaactccgccgtcgatatgaactcttgggcggaatcagcctgttatccccggagtaccttttatccgttgagcgatggcccttccatacagaaccaccggatcactatgtcctgctttcgcacctgctcgacttgtcggtctcgcagttaagctaccttttgccattgcactatcagtccgatttccgaccggacctaggtaaccttcgaactcctccgttacgctttgggaggagaccgccccagtcaaactgcctaccatgcacggtccccgacccggatgacgggtctgggttagaacctcaaagacaccagggtggtatttcaaggacggctccacagagactggcgtctctgcttctaagcctcccacctatcctacacaagtgacttcaaagtccaatgcaaagctacagtaaaggttcacggggtctttccgtctagcagcgggtagattgcatcttcacaaccacttcaacttcgctgagtctcaggaggagacagtgtggccatcgttacgccattcgtgcgggtcggaacttacccgacaaggaatttcgctaccttaggaccgttatagttacggccgccgtttactggggcttcgatccgatgctctcacatcttcaattaaccttccagcaccgggcaggcgtcacaccctatacgtccactttcgtgttagcagagtgctgtgtttttaataaacagtcgcagccacctattctctgcgaccctccggggcttacggagcaagtccttaaccttagagggcataccttctcccgaagttacggtatcaatttgccgagttccttctcctgagttctctcaagcgccttagaattctcatcctgcccacctgtgtcggtttgcggtacggttcgattcaaactgaagcttagtggcttttcctggaagcgtggtatcggttgcttcgtgtccgtagacactcgtcgtcacttctcggtgttaagaagacccggatttgcctaagtcttccacctaccggcttaaacaagctattccaacagcttgccaacctaaccttctccgtccccacatcgcatttgaatcaagtacaggaatattaacctgtttcccatcgactacgcatttctgcctcgccttaggggccgactcaccctacgccgatgaacgttgcgcaggaaaccttgggctttcggcgagcgggcttttcacccgctttatcgctactcatgtcaacattcgcacttctgatacctccagcacactttacaatgcaccttcatcagcctacagaacgctcccctaccatgccggtaaaccggcatccgcagcttcggttatagatttgagccccgttacatcttccgcgcaggacgactcgaccagtgagctattacgctttctttaaatgatggctgcttctaagccaacatcctggctgtctgggccttcccacttcgtttaccacttaatctatcatttgggaccttagctggcggtctgggttgtttccctcttgacaacggacgttagcacccgctgtctgtctcccgaggaaccacttgatggtattcttagtttgccatgggttggtaagttgcaataaccccctagccataacagtgctttacccccatcagtgtcttgctcgaggcactacctaaatagttttcggggagaaccagctatctccgagtttgtttagcctttcacccctatccacagctcatccccgcattttgcaacatgcgtgggttcggtcctccagtacctgttacggcaccttcaacctggccatggatagatcactcggtttcgggtctacacccagcaactcatcgccctattaagactcggtttccctacgcctcccctattcggttaagctcgctactgaatgtaagtcgttgacccattatacaaaaggtacgcagtcacaccactagggcgctcccactgtttgtatgcatcaggtttcaggttctgtttcactcccctcccggggttcttttcgcctttccctcacggtactggttcactatcggtcgatgatgagtatttagccttggaggatggtccccccatattcagacaggatttcacgtgccccgccctacttttcgtacgcttagtaccgctgttgagatttcgaatacgggactgtcacccactatggtcaagcttcccagcttgttcttctatctcgacagttattacgtacaggctcctccgcgttcgctcgccactacttgcggaatctcggttgatttcttttcctccgggtacttagatggttcagttctccgggttcgcttctctaagtctatgtattcaacttaggatactgcacagaatgcagtgggtttccccattcggacatcgcgggatcattgctttattgccagctcccccgcgcttttcgcaggcttacacgtccttcgtcgcctatcatcgccaaggcatccacctgatgcacttattcacttgactctatcatttcaagaacttctttgactttgcctaacattccgttgactagaacatcagacttgaatttcctactttgataaagcttactgctttgttgtgtcttaatcctgccttttgtgtttcaggattaagtcgatacaatcatcacccaaatactgtgtttgttttcttttctcttgcgagagatttttatcctttgcaaagaataaaaaatcaaaacaaacgctttgtctttgtttgttgatttcggctttccaatttgttaaagatcgatgcgttcgatattgctatctactgtgcaaatcaaaacgagctgattattatatcagcattttgttcttggtcaagtgtgacgtcgccctgaatggattctgttccattcttccgttttgatttgtacagtattggtggaggcaaacgggatcgaaccgatgaccccctgcttgcaaagcaggtgctctaccaactgagctatgcccccgttcttggtgggtctgggaggacttgaacctccgaccccacgcttatcaagcgtgtgctctaaccagctgagctacaaacccggattctcttcttaagcgaatcttgccttcactcaagcttcttccgcatctttttcagtttaccgataagtgtgaatgcctaaagcctcttctttctctagaaaggaggtgatccagccgcaggttcccctacggctaccttgttacgacttcaccccagtcatgaagcataccgtggtaagcggactccttgtggttatcctacctacttctggtatcccccactcccatggtgtgacgggcggtgtgtacaagacccgggaacgtattcaccgcagtatgctgacctgcgattactagcgattccgacttcatgcactcgagttgcagagtgcaatccggactacgatcggttttgtgagattggctccgcctcgcggcttggctaccctctgtaccgaccattgtatgacgtgtgaagccctggtcataagggccatgaggacttgacgtcatccccaccttcctccggcttgtcaccggcagtctcattagagtgcccaactgaatgatggcaactaatgacaagggttgcgctcgttgcgggacttaacccaacatctcacgacacgagctgacgacagccatgcagcacctgtgttacggctcccgaaggcactcctccgtctccggaggattccgtacatgtcaagaccaggtaaggttcttcgcgttgcatcgaattaatccacatcatccaccgcttgtgcgggtccccgtcaattcctttgagttttaatcttgcgaccgtactccccaggcggtcaatttcacgcgttagctacgctaccaagcaatcaggttgcccaacagctaattgacatcgtttagggcgtggactaccagggtatctaatcctgtttgctacccacgctttcgggcatgaacgtcagtgttgtcccaggaggctgccttcgccatcggtattcctccacatctctacgcatttcactgctacacgtggaattctacctccctctgacacactcgagtcacccagttcagaacgcagttcccgggttgagcccggggatttcacatcctgcttaagtaaccgtctgcgcccgctttacgcccagtaattccgattaacgctcgcaccctacgtattaccgcggctgctggcacgtagttagccggtgcttattcttcaggtaccgtcatcagccgctgatattagcaacagccttttcttccctgacaaaagtcctttacaacccgaaggccttcttcagacacgcggcatggctggatcaggcttgcgcccattgtccaaaattccccactgctgcctcccgtaggagtctgggccgtgtctcagtcccagtgtggcggatcatcctctcagacccgctactgatcgtcgccttggtaggcctttaccccaccaactagctaatcagatatcggccgctcgaatagcgcaaggcccgaaggtcccctgctttctctctcaagacgtatgcggtattagctgatctttcgatcagttatcccccactactcggtacgttccgatatgttactcacccgttcgccactcgccacccgagaagcaagcttctctgtgctgccgtccgacttgcatgtgtaaagcatgccgccagcgttcaatctgagccaggatcaaactcttatgttcaatctctaactttttaacttctggtctgcttcaaagaaaccaacaggacaatgttcaaaacattatcttgtctgtctttcaaacagtgtgagactcaaggcactcacacttatcggtaatctgttttgttaaagagcgttgcgaattataaagtattccttccgcctgtcaagatatctctcgatatccccaacattctgtgctatacttttcagttcgtccgccacttctgcagcagcgaagaaccgaactatacgcccacagggaaaaacggtcaatgctttcagcgggatttttttggggaaattcgtcatgtcgctgtcggataaggttttttatttctgctaaatactgcgccgcctccaacaatcctttcctctccctcctccggctggtgcgcctttgtgaatatgctgtctgaaactcggggactcagacggcattttgtatccaaacggtatctaatgtatccgtactttgttatagaatggctgctgttttttcttcgtaattagaaattgtcaaaatgggcaaacatattcttttaggtgtaacgggcagtattgcggcgtataagtcttgcgagttggtgcgactgctgaaaaaacaggggcattcggttacggtggttatgagccgctcggcaactgaatttgtttctccgctgacttttcaggctttaagcggcaatcctgtcctgaccgacacgcacggcggcaacggttcaaacggtatggaacatatcaacctgacccggaatgcggatgtttttctgattgcgccggcaagtatgaataccgtggcaaaaatctgtaacggcgtggcagataacctactgaccagtctggcagccgcacggaaatgtccgcttgccatcgcgcccgcgatgaatgtggaaatgtggctcaaccctgccaaccaacggaatatcgcacaactggtttcagacggcattactgtctatatgccgggcttgggcgaacaggcttgcggagaaaatggtatgggaaggatgccggaacctgccgaattgctggatctgcttccggatttatggacaccgaaaattttaaagggcaaaaaagtcttgattaccgcaggtgcgacatttgaagccattgaccctgtccgaggcatcacaaatatctccagcgggaaaatgggcgtggctttggcgcgggcgtgccgtgccgccggtgcagaagtcagcctgattcacggacagcttcaaaccgcgctgcctttcggcatatccgatacggttcaagccgtcagtgccgaaaatatgcatcgcgcagtgcatcgtttaatcgacaaacaagatgcttttatttctgttgccgccgtctcagactatagggttaagaataggagtactcaaaaattcaaaaaagataaaaatgccaaaccgttatccatcgaattggatgagaaccccgatattttggcttctattgcctcattaccgaacccgccgttctgcatcggttttgccgctgaaacggagaatgtaatgacatatgcgcgggaaaaacgtattaagaaaaagctaccgatgatcgttgccaatgatgtttcaatcgcaatgggcaaaccgaccaaccggattaccattatcggggacgacggggaactgtcttttcccgaaacaagtaaagatgaagcggcaatgcggattgttgaaaggcttgccgtatatttgagcaaataagcaattgaacggataaaccataaaacgggttgcctgttaatcaaaaggcaacccgttttacctgcttcaacttctgatgactttgcggatatatggaatactatgcagattttgaataatctgattcaattgattcagattcttgactttcaataagaatttgaattcgacaaaaccttccgttcccgactgggatttagacggtgtttcgaccgactcaatgtctgcaccggaatcggaaatcgcttgcgccattaatgccaacaggccgtggctgtcttccgattggacttgaagcccgacacggtagttctgcccgttcatattttcccagtctgcatccagctgctgttcgggatcggacttcaacaacgtcgggcaggtatccctatggataatcatgccttttcccttaaccaacagcaaacggatggaatcgccgggaacagggtggcagcactctgcaaaatgaatatgcccgctttcctgcccatcgactttaatggaactgagcctgacctcgctgccgaaatgctcccctgccaactcggcaatgtgcatggcgacataaacaggcagggtatgccccatccctacgttgtacagcacttcttcaaacgatgtctgcttgtcgttgagatcggcaagatatttttccttgatgccgtctgaaagcaggacatctttgggcagcaaactggacagggctttttgtaagaggctctctcccaaaacgaccgcatcgtgccggttaaggtttttaatatattggcgtatggcgctgcgcgccctgcctgacacggcgaaattcaaccacgcgggattgggtttggcgtgttcggatgtgataatttcaacagaatcaccggttttgagcttcgtacgcaacggcatcatgatattgttgatacgtgcggcaacggttttgtgcccgatatcggtatgcaccgcataagcaaaatcgacaggcgttgcccctttgggcaaagttaggatttttccttttggcgtaaggatgtagatttcgttcggaaacaaatcgactttgacgtgttcgagaaactcaatggcattggcactgcttgcctgcaaatctaagatatttttcagccaccggtttgtgtgaagcaccgcctgatcgaccgtcttagaatatgatttatagctccaatgtccggcgattccaccttcggcaacagcatccatttccttggtacgtatctgaacttcaatcggcaagccgtaagggccgaccaaagtcgtatgcagactttgatacccgttgcttttcggaatggcgatatagtctttgaaccgcccgggcttgggctgatagagggtgtgcaatgcgccgagtgcggcataacaggctggaatgctgttgacaatgacgcggaaaccgtaaatatccataacctcggcaaagcgcagctttttcgccatcattttctgatggatgccgtacaggtttttttccctgcctttgattttggcctctatattcgcgcctaccagccgctggccgaatgcgcgcaagactttgccgacaacgtcctgccggttcttccggctcttgtccatcgctttttttaaagtctcgtagcggttgggatgcaggttttggaacgataaatcctgaagctcttgatatgcgttattcaaacctatacggttggcaatctgtgcatagatttcaagggtttcccttgcaatccggcggcgtttgtccgggcgcatcgaaccgagcgtccgcatattgtgcaggcggtcggcaagtttgacgacaatcacgcgcacatctttggtcattgccaaaatcagtttgcggaaactctccgcctgatgctccgcatgatcttcaaatttgagtttttcaagcttggacagaccgtccaccatctcggcaatcgtattgccgaacaccgccgccatttccccttttgtcacgcccgtatcttccaatacgtcgtgcatcacgcctgcacaaagaccctgtatgtccatatgccaaagggcgagctgcgtcgcaacggcaatcggatgcgtgatgtagggctccccgcttttgcgggtttgcccgtcgtgggcgcgaaacgcataggcgacagctttttcaagctccgcctgttcctcgggcttgaggtaggaggcggtatggaaaagcagggcacgcgcttcggcggtcagggggtcgtaaggggcggaaggttggggggcgggcatttcagacggctttcggtatgtatgtgtttttcatttcaaaccgtcggactgcacggcggcaaagtgttccggcgtgcgtttccggcagaatttatttattgcgcgtcaacagttctgtaccgatatgtccggcggcgatttcccttaaggcggtaacggtcggtttgttattgcggacatcgtccacaagcggcgtgttgccgttctcaagctggcgggcgcggcgagccgctaccaatgtcaggtcaaaatggttggaaatttttccggtacagtcttcggtggtaatacgtgccatattatttgctttctttcaaaaatatttaaattgggaaaccgggtattttcgccgttttctaggaattttccaacaaatctgcaataaaccccagttgccgcgaccttttcagacggcaggcattcacaatatggcgcaaatcctcctccgctcgcgccaagtcgtcattgaccacgacaaagtcaaacaatacggactgctcgatttcatgccttgccttcgacagcctcctttggataacttcccgactgtccgtcccgcgtccgttgaggcgcgcggcaagtacgtcgaaagaaggcggcaggataaagatgccgacggcttcgggcagcgcgtcgcgaacctgcgccgcgccctgaacgtcgatttccaaaatcacgtcatagcctgccgccgccaacgcattcacaccctccgcgcctgtgccgtaatagttgccaaatacgtcggcgtattccaaaaaagcttcctgcgcgataagcgactcaaactcttctttggaaacaaagtgataatgtacgccgtttgcttcgccttcacgcggcgggcgcgtcgtgtgcgacacggaaacgcgcaaaccgttatggtttgccaacagccgcgacaccagcgtggttttgcccgtgccggaagcggccgaaatgataaagatgttgccttttcgataagcggacatattttttacctgtatattttccagccgattgtatcacaatggacacccagtttcctatttgccgatgcccatattttgccgctattgttttgattgatttggcaagcgacaggctgacggctacaatatggcgttaaaaacatcaaacttggaacacgcaatgctggttcatcccgaagctatgagtgtcggcgcgcttgccgacaaaatccgcaaaatcgaaaactggccgcaaaaaggcatcttattccacgacatcacgcccgtccttcaaagcgcggaatacttccgccttttggttgatttattggtttaccgctatatggatcagaaaatcgacatcgttgccggtttggacgcgcgcggcttcattatcggcgcggcactcgcctaccagctcaacgtcggtttcgtccccatccgcaaaaaaggcaagctgccttttgaaaccgtatcgcaaagctacgcgctcgaatacggggaagctgcggtggaaatccacaccgatgccgtcaaactcggttcgcgcgtgctgctggtcgatgatttgattgccacgggcggcacgatgcttgccggactggaactgatccgcaaactcggcggagaaattgtcgaagccgccgccattttggaatttaccgaccttcaaggcggcaagaatatccgtgcaagcggcgcgcccttatttaccctgcttcaaaacgaaggctgtatgaagggctgaaaaccgaccctgccgtctgaaaccggcagggttgttatgatgcgttcaaatcacgcccaaatcttgcaagcccctcaacacgccgtcttcatcaacgctggggcaaacatatttcgccgcttctttcgccgcctgttccccgttgcccattgccacgccgaacccgacttctgacagcatttccacatcgttcaaaccgtcgccgaacgccatcacgtctgccatttcccatcccaatgcttcaaccacgcttctgatgccgtccgttttcgacgcacccgcaggcagcagatcgaccgcttcctcgtgccagcgcaccgttttcaagccttcccgttccacaatatccgaccaaagcggcatttcgttttcctccgcaaacaccagcatctgatacaccggtttgcttgaaaaataatccttatcggcaaaaaaatcgctggcgatatgcttcaaggcgcggcacacgcattccgacagcgcggacacagcgatcccctctccgccgacaaacgcataatccatgcccaagccatccaaatgcgcgcaaaccctgcccatcaaaccggcatccatcggtacttcgcgcacggtttttccgtgcagcagcgcaaactgtccgtttatcgttaccacggcatccattcccgcttccgccatcatatccctgaccttttcgggaatcgtcgccaaagaccgccccgttgccaacgccgtcaatatacctttgccgcgcaaagccgccaccgccgttttcacggaagggcgcaaagtatccgtatattttcggtacagcgtatcgtcaatgtcgaaaaacacgattttaggattcatcacattctctctcgcattcaaactaccgcattatatcccaagcaggcaaatacttgataaatccttataaatttcccgtcaaaattgaccgaaaatacaaaaaggcggataatccgcccatcctcaaacccttttcagacggcatttgcagcaatgccgtctgaaacatttttacaaagcatacaaatcatgtttcaacacacaggacgacacataaagcgtcgccctatatgttgccctgattcggaaggggttacgcccctcccaaataaagtctgattctactgccctaaagggcggggtttcaaccgaaaaggaaacacgatgaaagcacccgaactcttattgcccgccggcggattggaaagaatgcgcgccgcctacgactacggcgcagacgccgtttacgccggcagcccgcgttactcactgcgcgcccgcaacaacgaatttgccaaacttgatgttttagaacaaggcattaaagaagcgcacgagcgcaacaaaaaattctttttaaccgtcaacaccctgccgcacaattccaaactcaaaaccttcgttgccgacatggagccgctgattgccatgaaacccgacgcgctgattatggcggatccgggtttgattatgaccgtgcgcgaaaaatggccggaaatgccgatccatctgtccgtacaggcgaacaccaccaactattggggcgtgaaattctggcaaaacatcggcgtcgaacgcattattctgtcgcgcgaattgagtatggaagaaatcgccgaaatccgccaagaatgccccgacatcgaactcgaagtcttcatccacggcgcattgtgcatcgcttattcaggccgttgcctattgtcgggctatttcaaccaccgcgaccccaaccaaggcacctgcaccaactcctgccgttgggattacaaggttcacaatgccacggaaagcgatgcaggcgatgcccagcttctgcaaggtttcaactttgaaaaagcccaagaagaagccaaccaaaactttgaaggcatcaacggtcaaaaacgccatccctacgccgacaaagttttcctgattgaagaatccaaccgcccgggcgaaatgatgccgattatggaagacgaacacggcacctacatcatgaattccaaagaccttcgcggtatcgaagtcgtcgaaaaactcgccaaaatcggcgtggacagcctcaaagtcgaaggccgtaccaaatcgctctattatgttgcacgcgtcgcccagtcctaccgcaaagcgattgatgatgccgtcgcaggccgtccgtttgattacagcctgttgagcgaactcgaaggcctcgccaaccgcggctacaccagcggcttcctcgaacgccaccaaactcaggattatcaaaactacctgaccggccattccaccgccaaacaaagccaatacgtcggacacgttaccgaaatcgatgaaaacggctgggcaacagtggaagtcaaaaaccgctttgccgtcagcgattcactcgaaatcatccacccgagcggcaaccaaaccatcaaattggaacaaatgacccgcaaaggccagcctgtcgatgttgccccgggcaacggcattcaggtcaaaatccccaatatgcagggtaaagaaaaagccctcatcgcacgcgtgttgaacccctaagccattatgccgtctgaaacatttttcagacggcatttttaatccccttgccttattgtgcggcagattcagatcgggacacacctatagtccacgacagaagtctggcttttaagcgaagacaataaccgaaaagaccgcctcggcggtctttcttgtgtacacagtttttgtatttgtcagcttgatgcgttgacaactctaattccatattgcggaatatattcatcgacagtcatcagttcaaagccttccgcttgggtttgtgcaatcaacatcctatcgaaagggtctttgtgtatctccggaaggcttccagcctgttttgcatgaaacagacctataggcaacatttcaaaatcctcttcttgaagcacatcaaaaaactcttccggtaatttcaacaaccccttgttctgcttgatggaaatttcccaaatacttgctgcactgacaaagatcgcatttctcggattttctatcagtttgcgtgcagatatccccagtttcttgtcatccaacaaccaccacagcaacgcatgggtatcaagcagaatctttctcacagagccgactcctcaaaaaataaagctgccgtttcattgtcatcctcaagaatacgtgaaatatccgtattttccatatgactgaattttttcaaccttcctgcatttcgtgccggtttttcaataccgattagttggacgcaaggcttacctgccttcgcaataataacgatttcccctgcttctgctctttgaatcaattgactcaaattggtttttgcctgatgaatatttgcttgaaacataacacttctcatgattagctaacttgactaatatacatcattaccaagattttgggaatctcattacatatatttgattatatccgccgttttattcacaccttgctatttatagtggattaacaaaaaccagtacggcgttgcctcgccttagctcaaagagaacgattctctaaggtgctgaagcaccaagtgaatcggttccgtactatctgtactgtctgcggcttcgtcgccttgtcctgatttttgttaatccactataaaacggctttgcggtatcccagtttgacaccggttacttcctgattggtaagcatcattattttcccataaatcaaacgtctgacacggcattataaacacaatgcggcatctgccgccacccttgcggacgcggcgttaccggcttccacagctacttcgacaagcagccgctgcaaggcggacaatacgactgtcaggcaggctcgttccacgtccgcgtggtcatgcgcgccaacgtcgtccgttaacatatcggcaaccaaaaaatgccgtctgaaacatttttcagacggcatttttaatcctgcaacattaccccctgcctgagttcggatactgtatcaatataaaaccccatcacacagatttacggtaaaaagccgtccgaatgaattcttgaacacaattcggacggctttaattttcaacaaggcgattaattcaataataccagattaaaacttccattccagcgatacggcgtaattgcggcctggggcgcggtagcggtctaagcctttgccatcgcggtcgaccgcattggtggtgctgtagctatataaaccgcgcagggaatcccaagtggtgtatttgcggttgaacaggttgtacacgcctgcacgcaaagtcaggtttttagccggtttgtagaagccgtacatatcaaacacataagccgacttgttcagccacgggtaatcttttacctttttctgcaaaggcgtaccccagcccttgttttcataaacggtgtattgcgcgtctttgacctttttcgcgcctagataggtcaggcgggagaatacgccccatttttcgctcggactttcatagtcgataccggcaatcactttcagcggctgtgtggacagcaggctgttgtcgcccgacagtttgcttttcgcataacccagcgagccgaacagtttccaaccctcaggaacaaaagacgctactttgtccacattcagacggcctgtcagctcgataccgcggattctggccttgtcgatatttttcatctgccaatccagtttttctttgtaggggtcgctgcatataccgtagtaagcattttcctcagtacagccgggagtgccgctggtggtcagcttctgctcttcagacaggaaattgcggtaattgctttgatacaggttggcatccagcatgcctttttcgctgcggccttgcagagacagggtgtgggtggtgctgcgctcggctttcaggttgggattgggcagccaattacccgaaccgtggttgtaagtgaaatacacttcggacgcattggggacacggtagccggaagtaatgtcgtaaccgacacgccaagcctgattcagttgcgccgccaagccgacaaaaccgctccagcctttataagtgttggctgcaggtggtgttttgtcacaagcatgacactcggcattcaattcctgaggcgtcattttggtgtggtcgtaacggatacctgcgcggctactgaacacgtcgttccattgaatttggtcagacagtgagaaaccgtagttggtggttttcaccggatgctggatactgctggtggttcgaacaacacggccgctgaagtaataatcgtcgcggtttaggttttcaaaatcacggcggctgacgaaagttttaaacgacaggcggtgtcgcccccccccgagttgcaacggatggctgtccaaacgcaaagtaaaacgtttgaatcgggtgtccatgctgcggttgtatatttcgtccaaatccttctgattatagttgcgcgtccaggtggaataatccatcgggaacgagcctttgttgttaaccgccgccactttggttttctgataatcgaagtccgccttcaaagacgacaaccaatttgaatcaggcatccattcgtaaaagaggttggcattgcgccgtctgtttacgtcatcggcttcgcgccaggaagaagcggtcaggttataagactcttcaaccgtgtaattatgtccctgctggccgttaagcgatgcgccgatgcggtggttatcgttaatttggtaagcaatcttacccaaaaagctgtggtatttgtgtttggacgaatcagggataccgcgtgccgaaccacggatattcgcgccactgccttccccttccacagcatagcctcggtttcccgcactttcggtttcatgaccgcgacgttgcgaatacagcaaagcagcatccacgcggtcgttactcacaccgaaaccgagagtatttgtccattcacggttacgcgtgctgtaaccgtttttcatcatcacgccgaattgcctgtcgtccaacagcaaatcacggccttgcagcgtttggtaattcacaccgccgcccaatgcaccactgccggtattgaaagagtctgcgcccttcacgatttcgatgttgcgcacgagttcggggtcgatagacaaacgcgagctgttgaagttgccataacgggcgtacagcgagttttcttcagaatcaggcaggtttacaccgtctatgctcacgccgacacggttgccttccacgccgcgaacagcaaagcctttttgatggcggccgctgtcgctcaagccgacatcggtggaatagcgcaccaagtctttattgtcgcgtatcatttcttgtttgatacggttaaggttgacgcgttccacagccgcaggcgcattgcgctgacctttaacgcgcactgcttttatctctgccttaacgggtgtggtttcagttgcagcttcatctgctgccaagaccggattgccgaaaatactgccgaccagcgcggcgatagggagcatttgtaatggtttcatattatcaactcaagatgtatggattgttcatccatcggttagcgaataatagattttatgataatcattaatatttaataagacagtaatccatgtaaacaaagccgcgccgtgtaattaaaggtccctgcaaacagctatgccgagaccttgtttatttggttcgattcttgtttatttggttcgattattttttagtgcctgtgcggcatcattccttccggtgcttcggcatcggctgccaagccgaaggtttcgcgcaacacgactttgtagaatgcaaaggcttcgcgcgcgccttggatggcttccgcttcggcttcgggagtcaggttcaaagcgttcagatgctcgacgaaagcgcgccagtgtttgccgcgcccgtcgggatggggtgcgaggtggcgcgcgccgtgttcgccgttgtaatcgagtttttgggcgtgtttgaacaaaaatgccgcgcccaaattggatccttcggcgcaataaagccagccgattgctttgttgccggtttcatgcggcagcggtttgccgtattcgtaaggtttgtcacccaaatctgcaaggtcttgcgttacggcatcgtatcgcgccatgtattccagctcgggaatggctttgtttaattcggcatctttatagatgtggtcgacagccttgtggaaaacggattggagtttcaaaaatttgatgtagttttctttgctgacaaacggttggacagacataacgaggttatccacgctgtcgtgaaccgccgtggtatccgccttcaagcgtttggcaaatgtcaatgcttgattttcggtttcactcatattttttcctttgtcggtaagggataaggatgcggtgcgggcaaaatccgcacttgcccgcatatatagtggattaacaaaaaccagtacggcgttgcctcgccttagctcaaagagaacgattctctaaggtgctgaagcaccaagtgagtcggttccgtactatttgtactgtctgcggcttcgccgccttgtcctgatttttgttaatccactataaaaataataaagaatcataaacgaaatttattatcacatatttttggaaaaaatatcatttgcgtgatgtttttaagcaggtattttactattctttacagaatcgggattttatcaaatgggttcggcagtcggcggacaaccgctcaaaaaatatttttgccggacaccaagggtttgttcatactgccgaacctgccggttttgcatcctgattgggtgtatcgccttttttcctttataatgccgccacttatatttgccactttcccgatgaagccgtttgccgaaaatatcccccacagccttcgcggcaactgctgcgacgaagccctgccgccgcatacggtagattgtccggaatgcggctgccgcgcggatgtaccccggttggacagtggagaagcggcgttctgtccccgttgcggacacaaactcttcagggtgggcaggcatcctttttccgccccgcccgcctatgcggcggcttcgctgattttaatggcgtttgcttacggtatgacgtatatcgaggtcgggataccgggtgcggcatccgtcctttcgctgcccgagatgatgcgcctgatggtgtttcaggattatggttttttggccgaagtgatgtttgtgctgactttcggcgcgccggttctgtttctgctgctgtgcctgtatgtctatgccgcgctgatacggaaacaggcgtatcctgcgctgcgtttggcaacgcgtgtgatggtgcgcttgagacaggcgatgatggtggatgtgttttttgtttccactttggtggcgtatatcaagctctcgtctgtggcagaggttcgcttcgggccggcgttttatctgatgttcgcgctgtcagttatgctgattcggacttcggtatcggttccccagcattgggtgtattttcaaatcgggcggctgacgggggataatgcggttcagacggcatcggaaggtaaaacctgttgcagccgctgcctgtatttccgcgacagtgccgaatccccctgcggcgtgtgcggtgcggaactgtaccgccgacggccgaaaagtctgagtatttcgtcggcgtttctgacggcggcggttattttgtatttccctgccaatatcctgccgattatgatttcgtccaatcctgccgccacggaggtcaataccatccttaacggcatcgcttatatgtgggacgagggcgacaggctgattgcggcggttattttcagcgcgagtattttggtgccggtactgaagattgcggcaatgtcggttttgattgcgtccgcccgcttcgctttgccaacgggtgcaaagaaattgtcgcacctctaccgcatcaccgaagcggtcggccgctggtcgatgattgatatttttgtgattattattttgatgtgttcgttccacacttatgccgcgcgcgtcattccgggcagtgcggcagtctatttctgcctggtcgtgattctgacgatgctgtccgcctattatttcgacccgcgcctgctttgggacaaacgcgcttcagacggcattgctttcaatgaaacggaaaaacatgactgacaacagccctcctccaaacggacacgcccaagcacgcgtccgcaaaaacaacaccttcctctctgccgtctggctggttccgctgatcgcgctgattgccggcggctggctttgggttaaggaaatccgcaacagggggcctgtggttacgctcttgatggacagcgcggaaggcattgaggtcaacaatacggtcatcaaagtattgagcatcgatgtcggacgcgttacccgaatcaaactgcgcgacgaccaaaaaggcgtggaagtaaccgcccaactcaatgcggacgtatccggcctcatccgcagcgatacccagttttgggtggtcaagccgcgtatcgaccaaagcggcgtaaccggtttgggtacgctgctttcgggttcgtacatcgcctttacacccggcaaaagcgacgaggcaaaagacgtgttccaagtgcaggacattccgcccgttaccgccatcgggcaaagcgggctgcgcttgaatttgattggtaaaaacgaccgcatcctcaacgtcaacagccctgttttgtatgaaaattttatggtcgggcaagtcgaaagcgcgcatttcgacccgtccgaccaaagcgtgcattacaccatcttcatccaaagccccaacgacaaactgattcattccgccagccgtttttggctggaaagcggcatcaatatcgaaaccacaggcagcggcatcaaactcaattccgcccctctgcctgccctgctgtcgggcgcgatttcatttgattcgccgaaaaccaaaaacagtaaaaacgtcaaaagcgaagacagcttcacgctttacgacagccgcagcgaagtcgccaacctgcctgacgaccgctcgctgtactacaccgcgtttttcaaacaatccgtgcgcggcctgaccgtcggttcgcccgtcgagtacaaagggctgaatgtcggcgtggtttccgacgttccttatttcgaccgcaacgacagcctgcacctgtttgaaaacggctggatacccgtacgcatccgcattgaaccttcccgtttggaaatcaatgccgacgaacaaagcaaagaacattggaaacaacaatttcagacggccttaaacaaaggcctgaccgccaccatctccagcaacaacctgctgaccggaagcaaaatgattgagttgaacgatcagccttccgcatcacctaagctgcgaccgcataccgtttatgcaggcgataccgttatcgcgacccagggcggcggtttggacgatttgcaggtcaaattggcggatttgctggacaagttcgacaaactgcctttagataagacggttgccgaattgaacggttcgcttgccgagctcaaatccacactcaaatctgccaatgccgccctaagctccatcgacaaactggtcggcaaaccgcagacacaaaacattccgaacgaactgaaccaaaccctgaaagagttgcgcacaaccctgcaaggcgtatcgccgcaatcgcctatctacggcgacgtacaaaatacgctgcaaagtttggacaaaactttaaaagacgttcaacccgtgattaatactttgaaagaaaaacccaacgcgctgattttcaacagcagcagcaaagaccctatcccgaaaggaagccgataatgcgccttttcccgattgccgccgccctgtcgcttgccgcctgcggtactgtgcaaagcacacaatatttcgtgttgcccgacagccgctacatccgtcctgcaacgcaaggcggcgaaactgccgtcgaagtccgtcttgccgaaccgctcaaacgcggcggactggtctatcaaaccgacccctaccgcctcaacaccgcacaaaaccacgtctgggcagacaccttggacgatatgctcgaagcggcgttgagcaatgcattcaaccgtttggacagcacacgcatctttgttcctgcctcacgcagcggcagtaccgaaaaatggacggtctatatcgacgcattccaaggcagctacacgggcaaaaccctcatcagcggctacgccgtcctacccgacggtacgaacagacccttccatatcgaaaccgaacagcagggtgacggctacgccgcgatgaccgccgcactcgaacagggactgaaacaggcggcgcaacagatggtcgagtaaaccgtgaactattgcgaatttgccgcctcacttcccgaaaacaccgataacccgaacaaacattaccacgacacgcaatacggttttccgattgaggacgacaatgaattgtttgagcggctggtgttggaaatcaatcaggcaggattaaactggacgctgatgctgaagaagcggcaggcgtttcagacggcatttgaaggtttcgacatcgatacggttgccgccttcgacgacaccgaccgcgaacgcctgcttgccgacgcgggcattgtccgcaaccgcctgaaaatcgatgccgccattttcaatgcacggcaaatccaagcgttgcaacaagaatacggctcgttcaagaactggctcgacacgcaccatccgcgaagcaaagacgaatgggttaaactctttaaaaaacatttcaaattcgtcggcggcgaaatcgtcggcgaatttctgatgagtaccggctacctcaaaggcgcgcacgccgaaagctgtccggtttaccgtgaaaccctgaaataccacccgaaatggctcgatgccatctgaaaaaccaatgaacagaagaaccttcctcctcggcgcaggcgcgttgctgcttaccgcctgcggcagaaaatccgcccgaacccacgccaaaattcccgaaggaagcaccgtacttgccttgggcgattcgcttaccttcggctacggcgcaaaccctggcgaatcctaccccgcgcaactgcaaaaactgacgggttggaatattgtcaacggcggcgtatcgggcgatacatctgcccaagccctgtcgcgcctgcccgcgctgttggcacgcaaacccaagcttgtgattgtcggcataggcggcaacgactttctgcgcaaagttcccaaggagcagacccgcgccaatatcgcgaaaatcatcgaaaccgtgcagaaggaaaacatccccgccgtcctcgtcggcgtgccgcacatcacactgggtgcgttgttcgggcatttgagcgatcatccgctgtatgaggatttgtccgaggaatacggcattccgctgttcggcggcgcgtgggcggaaattttgggcgataataatctgaaatccgaccaaatccacgccaacggcaaaggctatcggaaatttgccgaagatttgaatcaatttttgagaaaacaggggtttagataaacaaaggtttatccgcacccaagttgtttatataatcatgaaccgactgggacaccaaactgcttcgggacgcatatgccgtctgaagtgcaaagcctacgccatacagccgcatgaagttgcagcggtatggcgttttttgaaaaagacggcctgccggttcagacggcatgaccgaccgtccgagcctgctgtggataaagcccggacaggctgaaatcatggaatattgcgaacctgaagaagcatccgacccgtacgcaacatacaggcgtgccaacctgatggcgggtctgccgctgtttgtcgtgattttggttctgctcaatattgtttttccgcttccggcgcatcccttagcttggctggtgcctgcaggtttcatggttttgggcggcggctttcccttatcgctgccgcttgtggcgctgcttgtcctgacctgctgcattctggcgcattgtccgccattatcccgtcttttgtgctacccttgcccgaatcatccgatgtctaaaaattctgcctgatggcagccctacaaacccgaaggagtagaaatgaaactgtccgaactgttcaaccccgacgaatttgccgcgcggcatttgagttttggcgacgaagcggcgttgcttgccgctgtcggcgagaaaagtatggacgattttgtcggcaacaccgtgccgcaaagcatccgtatgccgtctgaactcgatttgcccgatgccctgaccgaagcggacgcgttggcaaaattgaaaggcattgcgtcgaaaaacatgatcaacaaatcctatatcggtttaggctattacccgacccgcgtgccgaacgtgattttgcgtaacgtattggaaaatccgggttggtacaccgcctacacgccgtatcaggcggaaatcgcgcaggtcgtttggaagctttgttgaacttccaacaagtgtgtatcgatttgaccggtttccctgtggcgggcgcgtctttgctggacgaagcgaccgccgccgccgaagcgatggcgatggcgcaccgcgtgggcaaggtaaaatccgagcgtttctttgtggacgagcgcgtgtatccgcaaactttggacgtgatgaaaacccgtgccaagtatttcggcttcgagctggtggtcggcgattttgcccaagccgacgaaggcgaatacttcggcgcgctgttccaatacgtcggcaaagacggcgacgtgcaagacttgcaggacgttatcggccgtctgaaagccaaaggcacgattgtcgccgtttccgccgacatcatgagcttggttttgctgaaaccgcctgccgaattgggtgcggatattgcgttgggcaacacacaacgcttcggcgtgccgatgggcttcggcgggccgcacgccgcttatttcgcgtttaaagacgagttcaaacgttccgccccgggccgcatcatcggcgtatccaaagacgcatcgggcaaacctgccttgcgcatggctttgtccacccgtgagcaacacatccgccgcgaaaaagctacatccaatatttgtaccgcgcaggcattgctggcgaatttggcgggtatgtatgccgtttaccacggccctgaaggcgtgaaacgcattgccaaccgcattcacgcgctggcttctgcctttgccgatgcgctggtttcagacggcctgaatgtggttcacaaagtctttttcgatactgttaccatcgattttggcagtaaagagaaagcagaccaagtgtttgccgctgctttggcgtcgggttacaacctgcgccgcgtcaacgatactcaagttgcggctgcattccatgaaacatcggcatacgaagatttggtcgatttgtaccgcgcgtttaccggcaaggatacgtttacatttgccgatgatgtcaaaggccgtctgaacgccgaattgctgcgtcaggacgacattctgcaacatcctgtgttcaacagttaccacaccgaacacgaaatgttgcgttatctgaaaaaactcgaagaccgcgacttggcgatgaaccgcagtatgatttcattgggcagctgtactatgaaactcaacgcgactgcggaaatgttgccgattacttgggccgagttcaccgacatccatccttacgctcccgaagcgcaaaccgccggctaccgcgaattgctcgccgatatggaaaacagcctgaaagccatcaccggctttgacgcgatttccctgcaaccaaattccggcgcacaaggcgaatacaccggtatgctcgccatccgccgctatcaggaatcccaaggcgaagcgcaccgcaacatctgtctgattccaaaatcagcccacggtaccaaccccgccaccgccgccatgctcggtttgaaagtcgtcgtcgtcgacaccgacgaacacggcaacgtcaacattgacgatttgaaagccaaagccgagcaacaccgcgacgctttgtctgccatcatgattacctatccgtccacccacggcgtgtacgaagaaggcatccgcgacatctgccgcattattcacgaaaacggcggacaggtttacatggacggtgcgaacctcaacgcccaaatcggcatcatgcagcctgccgaagtcggtgcggatgtgttgcacatgaacctgcacaaaaccttctgtatccctcacggcggcggcggcccgggcatgggtccgattggcttgaaagcccatttggctccgtttgccccgggccataccttgaccgacacccacaacgcggctgccgatcaaaccgccgtggctgccgcagcatatggttctgcatccatcctgccgattacttggatgtacctgaccatgatgggcaaacaaggcatggaacaggcaacgcgctgggcattgctcaacgccaactacgtcgccaaagccttgggcgaggattatccgattctctacaccggcaaaaacggccgcgtcgcgcacgaatgtatcgtcgacttgcgtccgctcaaagccgaaagcggcattaccgaaaccgacatcgccaaacgcctgatggactacggcttccacgccccgaccgtctccttccccgttgccggcacgctgatgatcgaaccgaccgaaagcgagagcaaagccgaactcgaccgcttcatcgccgccctgaaacaaatcaaacaggaagtgctgaaagtcgggcgcggcgaatggccgaaagacgacaacccactggtcaacgcgccgcacaccgccgcagatataaccggcaactgggcgcatccgtattcccgcgaagaagccgtcttcccgttgccgttcgtccgcgaacacaagttttggcccttcgtcaaccgcgtggacgacgtgtacggcgaccgcaatctcgtgtgcagctgcccaccgatggaaaattatgaagactgactgttgatatcttaaaaaatgccgtctgaaacattttcagacggcattttcatcaacggcaaaccagttgcaccaatacacgtatctcgactataactttaaaacaaatgagttaaaccagtatccatacatcagcttttttatcatcctactttttattcatccgatcgtgcaaacagatttcaaagatgaaaagcctattcacaccctttgatgtcatttccacacggacaaacaaatatagtggattaacaaaaaccagtacagcgttgcctcgccttagctcaaagagaacgattctctaaggtgctcaagcaccaagtgaatcggttccgtactatttgtactgtctacggcttcgtcgccttgtcctgatttttgttaattcactataaattcccataaaaaaacggagcagatacctgccccgtttttatttaatccgaaattttaatctaaatttagaattttgcaccggattggtttgccatatagtcaacagccgctttgacttcgtcatcgctcaaacctgcattgccgcctttggcaggcatcgcgttaaagccttcaagggcgtgtttgtgcaaggtttctttgccttttttgatacgcggtgcccaatcgtcttttttgcctatgccgggaataccgggaatcgaaccgccgtggcacacctgacaggttgcttcgaagacttttttaccgtcaacgccgaccgcaggggctgccgcacccttgtcttctgccttcgcttctgccggagctgcactatcggcaggagcagaagctgttcctgaagcggcattgtcggcaggcgcagcctcatcaggattcgggaaagaaccgccgcttttgttcgccatgtaagtaatcgcccgtttaagttcctgatcggtcaggtctgccgcaccgccttttgcaggcatggcgttaaagccgttcagcgcgtgttggaacaaggtatcgaagccttgcgcgatacgcggtgcccaatcgccgttgtgttccagtttcggagcgttcggcacattgctgtccgccgcgtggcattggatacagattttgccgaaaatctgttcgccttggcgttcgccgacggggatgccgtcgcccatcgtcaattgtccgacaggctggatacgggtctgcgttgctgcttccgtagtggcatcgacatcgccgaacgagccgctgcccgccagcttaatcaggaaataaaggactgcaataacaataacgataccgctcacaagggtaaacagtgcagagccttgggctttgttgtcgcggagttgtttcatttggtaggcctcgccgtcaggttaggttgtgctgtaaattatagtttggtgtgttaaacgcagttaacaatattttgctggattatactgaattcacagggtctttccaatcgctatcattgaaaatatgaaaaaatttgccaacggtatctgtataaaacaaataatcctttgaaaataattgtttatcctcaagaaaactctccttatgccgccatacgccgcctgccggcgcaagataacctttgccaatttgcagaatttacgttaaccttgcgttttccgcacccatagctcagttggaagagtgtcagtttccgaagctggaggtcacaggttcgatccctgttgggtgcgccaattataaagagaccgtctgaaagataaatatttttcagacggtcttttgacttacttcaaactcttatttcaagacttccgcaaatgcgcgggcaacatagtcggtattcgacgtattcagtccggcgacgcacatcctgccggaatccagcaggtaaacggcaaattcgtcgcgcagcctgcggacttgttccacgctcaatcctgtgtagccgaacatgccgcgctgtttgatgaaataagtgaaatcgcgattggggatttgcgcagttaagacatcataaagtttctgccgcatcgcacggatgcggtcgcgcatcatataaacctcgttttgccacaaggcgtaaagttcggggctgttcatcacgtcggcggcgatatacgcgccgtgcgcgggcgggctggagtagatgcggcggacggtgaatttgagctgtccgaacaccaaatccgcttcttccttattcgggcaaaccacgcttaagccgccgacgcgctcgccgtagagcgacaggttttttgagaaggaattgctgacgaacaagggcaattccatttccaccgctttgcggacggcgtaggcatcgctgtccaaatcgccgccgaatccttggtaggcaatgtccataaacggaatcagtttgcgcgttttgatgatgtgcaacacttcgtcccattgccgttccgacatatccacgccggtcgggttgtggcagcagggatggaggatcaggacgctgttttcgggcagggtgttgaaaaacgcggtcatttcgtcgaatttcacgccgacagtggcagggtcgtaatatgggtaagtgccgacctcgaaacctgcgccttcaaaaatgccgcgatggttgtcccaagtcgggtcgctgacgtaggcgcgcgcttcgggaaaccagcggtgcaggaagtccgccccgactttgagcgcgcccgagccgcccaaggtttgtacggtaacgatgcgcccttgcgcaagcgcgggattgtctttgccgaacaataaatgctgcaccgcgctgcggtaagtgtccaagccttccatcggcaggtagggcgacggcgcaggcgcggcggcacgggcggtttcggctcggctcacggattccaacacgggcattttgccttcgtcgtcgaaataaatgcctatgctcaaattgactttttcggggcgcgggtcgtttttgaaggtttcgaccaaactcaaaatcgggtcgccaggatagtattcgatgtgtcggtacatagtccttacctcttgctttttcaaaggattttctttttcaacaatacaccactttcgatatggtgcgtaaacgggaattggtcgaacagggcggcacgttcgaccgcatgggtttccgccaaggtgtccaaattggcgcgcaacgtttcgggattgcaggaaatgtagatgatgttgtcaaactgcgacaccagcttcaaagtttcctcatcgataccggcacgcggcggatcgacgaaaatagtggaaaatgcgtaatccgtcaaagcaataccgccatccttaaggcgtttaaactcacgttttccggtataggcttcggtaaattcttcagcagacagacgggcgattttgatgttgccgatgcggttggcttcgatattccattgcgccgcgctgacggaggttttggagatttcggttgccaaaacctgtcggaaatatcgggacagcggcagggtgaaattgccgtttccgcaatacagttcgagcaggtcgctgcccaagccttccgccgtgcggcacgcccattcaagcattttctgacacacggcggcattcggttgggtaaaactgccttcaatttgccgataacggaaatcccggttgccgaccttcaaagtttccgttacatagtcctgttttaagactattttctgtcccctgctccgcccaataacggaaatatccaactgttgctgtaacgcttgcgccgcctgcatccactcagcatcaagccttttgtggtaaatcatggtaaccagcatttccccgctgagcgtggacagaaattcgacggcataccagcgttttttgagttcgggggattgcgcggcggcggcgatcagctcgggcatgaggcggttgacagcctcggaagctgcttcaaaacggtcgcagcgtatcatgcttgcgccgctggctttctgccctttttcaaacatggcataaaacatttccccgccttcgtgccaaatacggaactcggcacgcatacggtaatgtttgtccggagattcgtacacttcccactcaggaacatccaaacctgcaaaaagggttttaaggtagtcttttttaccttgaagctgctgcgtgtagtcattcatatcgctatcctgaaaaatcagaccggattataagccgatttgcctcgccgcacgcaaactctttgactgccgccccttcaatgacggacgggcttttgtgctaaaatccgccatctttccacactataccgataaagggaaaaatcatggcaggcaacactttcggacaactcttcaccgttaccaccttcggcgaaagccacggcgcgggtttgggctgtatcatcgacggctgcccgcccggcttggaattaagcgaagcggatatccaatttgacctcgaccgacgcaaacccggcaccagccgccacgttacccaacgccgcgaagccgaccaagtcgaaatcctctccggcgtattcgaaggcaaaaccaccggcacgcccatcgccctcttaatccgcaataccgaccagcgcagcaaagactacggcaacatcgccaccagcttccgccccggccacgccgactatacctattggcacaaatacggcacgcgcgactaccgcggcggcggcaggagctccgcccgtgaaaccgccgcccgcgttgctgccggagccgttgccaaaaaatggttgaaagaaaaattcggcacggaaatcaccgcctacgttacccaagtcggcgaaaaagaaatccggtttgaaggctgcgaacacatttcccaaaatcctttttttgccgccaaccatagccaaattgccgagctggaaaactatatggacagcgtgcgcaaatccttggattccgtcggcgcgaagctgcatatcgaagcagccaatgtccctgtcggcttgggcgaacctgtttttgaccgcctcgatgccgaaatcgcctacgcgatgatgggcatcaacgccgtcaaaggcgtggaaatcggcgcaggttttgacagcgtaacgcaacgcggcagcgaacacggcgacgaactgaccccgcaaggcttcctgtccaaccactcaggcggcatcctcggcggcatcagcaccgggcaagacatccgcgtcaatatcgccatcaaacccaccagctccatcgccaccccgcgccgcagtatcgacatcaacggcaaccccatcgaactcgccacgcacggcaggcacgacccctgcgtcggactgcgctccgcgccgatcgccgaagccatgctcgcgttagtcctcatcgaccacgccctgcgccatcgcgcgcaaaatgccgacgttcaggttaatacgcccgacattaccctttcaaacaaataaaaatttagccaaaacacagactttataatagaatatcgagcattgccgtgcagccttgacgcacgggtttgtttagaggaatacaaccgaaatgacacaagaaaccgctttgggcgcggcactaaaatccgccgtccaaactatgagcaaaaagaaacagaccgaaatgatcgccgaccacatctacggcaaatacgatgtattcaaacgcttcaaaccgttggcgctcggcatcgatcaggatttgattgccgctttgccgcaatacgatgccgcactgattgcacgcgtcctcgccaaccactgccgccgtccgcgctatctgaaagccttggcgcgcggaggcaaacgtttcgatttgaacaaccgtttcaaaggcgaagttacccccgaagaacaggcgatcgcgcaaaaccatccttttgtgcagcaggctttgcaacagcagtccgcccaagctgccgccgaaacgctgtctgttgaagccgaagcagccgaatcttccgcagcagaataaatccccaaacgaaatgccgtctgaaaaccgatttggtttcagacggcattttttcgtatgcggcaatcacggttcaaatatccaattccgccgtatcgccttcgcgttccatccaagcgcggcgggcggcggcttcgcctttgcccatcagtttgacgaagatgtcgcgcgtctcgtcatctgcaccttctgggatttgtacctgcaacaggcggcgggtgtcggggtgcatggtagtatctttgagctggtcggggttcatctcgcccaagcctttgaaacggctgatggaataggcggtttctttaacgccttctttttgcagccgctccaaaatgctgtcgagttcgttttggtcgagggcgtagaatttgcgggcaggtttgctcttaccttgtgcgttgacatcgacgcggaacagtggcggctgggcgacgtagatgtgtccgtcggcaaccagtttcgggaagtggcggtagaacagggtcagcagcaaaacttgaatatgcgagccgtccacgtcggcatcggacaggatggcgattttgccgtagcgcaggccgcttaaatcgggatggtcgttaataccgtgcggatcgacgccgatggcgacggaaatgtcgtggatttcggcgttgccgaagagttggtcggggtggacttcaaagctgttgagcactttgccgcgcaggggcaggatggcttgggtggctttgtcgcgggcgagtttggctgagccgccggcggaatcgccttcgacgaggaagagttcgttttcgcggatgtcttcgctttcgcagtcggtcagcttaccgggcaggacggcgacgccgctgccttttttcttttcaatctttttaaccgaacgcatccgcgcctgtgcttggcggatggcgagttcggcgatttttttgccgaagtccacgttttggttcagccacaattccaaagggtcgcccgatacggtggcgacgagtttcagcgcgtcgcggttggtcagcttgtctttggtttgaccttggaactgcgggtcgaggacgcgggcagagagaacgaaggcggtttttccgaacacgtcgtcgctttgcactttaacgccgcgcggcaagaggttgtgcagattgatgaagttgttgactgcgttgaacacggcttgtttcaagcctgcttcgtgcgtgccgcccagcggggtggggatgaggttgacgtagctttcgttggcgcacgagccttcttccagccaagtcagggcaaacgccgctccttcgccgatgctgaaatcgccgttgtgttcgtctgaaatgtagttttcgcaagagaacagcggtacggcttcctgcgcgtcggcaatcaggtcggtcagatagcttttcaggccgtcggggtaatgccaggtttgggtgtgcgcttcgtcttcgcctttgaccggacgggtcagggaaacgcgcacacccggcagcagcacggctttggcacgcagcaggcgttcgagttcgggaatgctgtaattcgggctttcaaaatatttgccgtccggccagacgcgcacttctgtaccgctgtctttgacggcgcatttgcccacttgtgccaacggttcgaccacgtcgccgccggcaaacacgatgcggtggattttgccttcgcgtttgaccgttacttcaaggcgggtggaaagggcgttggtgacggatacgcccacgccgtgcaggccgcctgaaaaggcatacgcgctgcctccgtcttttttgttgaacttgccgcctgcgtgcagacgggtgaatacgagttcgactacggatacgccttcttcgggatgcaggccgacgggaatgccgcgcccattgtcgtgcacggaaagcgaaccgtcttcatgaatttgcacgtcgattgcagtcgcgaaaccgcccaacgcttcatccgacgcgttgtcgatgacttcttggcagatatgggtcgggctgtcggtgcgggtgtacataccgggacgttctttgaccggctccaagcctttgaggacggtgatgctggattcgctgtattggttgtttttagccatgggaataatctgaaagtaagaaaaacaacgctttcagacggcctgaaagcgttgcgttccgttgttttagcggttgtcggaagattggcgggcggcaaagtcttcataactttccataccgcgcaggaagcgggaagagagttctttcaacgcccccaaataaacgtcgcgtttgaaatcaatcacttcgtcaacgggtgcccaatattgatgccaacgccagccgtcaaattcggggtggcgggtggcgcgcaggttgacatcgcaatctcggccggtcaggcgcaggagataccaaatctgcttctgtccgcgataagagccgcgccattcgcggcgtacccagttgttcggcacgtcataacgcagccagtcgcgcgtgcggccgataattttgacgtgttgcggcaaaagcccgacttcttcgtacaactcgcggtacatggcggtttcggggctttcgcccggcttgatgccgccttgcggaaactgccaagaatgttcgcgcacgcgcttaccccaaaagacttcgttgcggttgttgattaagatgataccgacattggggcgatagccttccctgtccaacacggtgtcgccctccgttaaattcaatcttgggattttcccacaaatcaggcggttttgacaaatcagacggcatggcggtacgcgtgccgaaacacggggggatttgggaaaatatcttaaatttggtttacaataatgtatttcaaattattcgggaatcagaccatgttagatatccaattgctccgcagcaacaccgccgccgttgccgaacggcttgcacggcgcggttatgactttgataccgcacgttttgacacactggaagaacgacgcaagtccgttcaggtgaaaaccgaagaattacaggcctcgcgcaacagcatttccaaacaaatcggcgcactgaaaggtcagggcaaacacgaagaagcgcaggcggccatgaatcaggttgcccaaatcaaaaccgatttggaacaggctgccgccgatttggatgccgttcaaaaagaattggacgcatggttgttgagcatacctaacctgccgcacgaaagcgtacctgccggtaaagacgaaaccgaaaacgtcgaagtccgcaaagtcggcaccccgcgcgaatttgactttgaaatcaaagaccatgtcgatttgggcgaacctttgggtttggattttgaaggcggtgcaaaactctccggcgcacgatttaccgtgatgcgcggacaaatcgcccgtctgcaccgcgccttggcacagttcatgctggatacgcacacgctgcaacacggctacaccgagcattacacgccttatatcgttgacgatacgacgctgcaaggtacgggccaactaccaaaatttgcggaagatctgttccacgttacccgtggcggcgacgaaaccaaaaccacccaatacctgattccgacagccgaagttaccctgaccaataccgttgccgacagcattatcccgtccgaacaactgccgctgaagctgaccgcgcattcgccctgtttccgcagcgaggcgggttcgtacggcaaagacacgcgcggtctgattcgccagcaccagttcgacaaagtggaaatggttcaaatcgttcatcccgaaaaatcatacgaaacgctggaagaaatggtcggccatgccgaaaacatcctgaaggctttggaactgccctaccgcgtgattaccctgtgtaccggcgacatgggcttcggcgcggcaaaaacgtatgacttggaagtttgggtgccggcgcaaaatacctaccgcgaaatctcaagctgctccaactgcgaagatttccaagcccgccgcctgaaggcgcgtttcaaagacgaaaacggcaaaaaccgcttggtacatactttgaacggctccggcttggctgtcggcagaacgctggtcgccgtattggaaaaccatcaaaacgccgacggcagcatcaacatccctgccgcactgcaaccgtatatgggcggtgttgccaagttggaagtcaaataagtttgcaggctgcctgaacgtcaaatgccgtctgaaacctgtttcagacggcatttcctttaaacttttaaaacacgtcagccgtcggcacgaaccgcattgccgcaatcgccggtctgtccgacctcgcggatattggacagcgtaacttccgaaatattacccaacgcctcttccgtcaaaaatgcctgatggccggtaaacagcacattatgacaagacgacaggcggcggaacacgtcgtcggtaatcacatcgttggatttgtcttcaaaaaacagctcgcgctcgttctcgtacacatccatgcccaatgcgccgattttccggcgtttcaacgcctcaatcgcggcggcactgtcaatcagcccgccccggctggtgttgataatcatcacgccgtctttcattttgtcgaacgccgcttcgttcagcatatagtggttttccggcgtggcggggcaatgcagcgtgatgatgtccgaccgggcatacagctcgtctaaatccacatatttgccgccgattttttccgcttcggggttgcaaaacggatcgtaagccagcaggttcatgccgaaaccctttaaaatccgcatggttgcaataccgattttccccgtgccgataacgcccgccgttttgccgtacatattgaaaccggtcagaccttccagcgaaaaattcgcatcgcgggtacgctgataggctttgtggatacggcggttcaacgtcagcatcagaccgaccgtatgttccgcaaccgattcgggcgaataggcaggcacgcgcacgactttcaagcccaactcttcagccgcctttaaatccacattattgaagccggcacaacgcaacgccacagttttcacgccaatttgcgccaatttttccaacacgggccggctgccgtcgtcgtttacaaaaatacagaccgcttccgcgccttccgccattttcgccgttttcgcatccagcataaaatcaaaaaactccagctcgaagccgaaatgccggttggcgcgggtaaaatgttcgcggtcatagcttttcgtaccgtaaatcgcaatcttcatcaatatgtccagttgtcgtctatggttgagaaacggcataatacactgaattcaaacaaatcagtagaatatggtggattaaaattgattgcatgcacggcatttccatttcaaaacacaaaactcaatcgcccattgccgccagaagctcggcctgatgctcggcaatcagggcattggtgatttcttccaagtcgccgtccatcacaaaatccagcttgtgcagggtaaggttgatgcggtggtcggttacgcggccttggggatagttgtaggtgcggatgcgttcgctgcggtcgccgctgccgatgagggatttgcgctcggcggcttctttggcttgggcttcgcgtttttgcgcgtcgttcaggcgggcggcgaggactttcattgcctgcgctttgttggcatgttggctgcggccgtcttggcattcgaccaccatgccggtgggcaggtgggtgatgcggacggcggagtcggttttgttgatgtgctgaccgcccgcgccggatgcgcggaaggtgtcgatgcgcaggtcggctgggttcagttcgatgtcttccagttcgtccgcttcgggcatgacggcaacggtgcaggcggaggtgtggatgcggccttggctttcggtggcggggacgcgctgcacgcggtgtccgcccgattcaaatttcaaacggctgtacgccccgagtccgacaatacgggcgatgacttctttatagccgcccaattcgctttcgttggcggacacgatttcaacctgccaacggttgcgctcggcgtagcggctgtacatacgcagcaaatcgccggcaaacagcgcggcttcgtcgccgcccgttccggcgcgtatttcgatgaagatgtttttgtcgtcgtcggcatctttgggcagcagcagtttttgcagttcggtatcgagttcgccgattttggctttggccgcttcgatttcttcggcggcaaagtctttcatttcggggtcggacaacatttcttcggcatccgccaagtcgctttgggcaagccgatagttttggaacacttcgacgacgggggtcagttcggcgtgttcgcgcgtgagcttgcggtagttgtccatgtcggacgtggcttcgggctgtccgagaaggtgggtaacttcttccagtcggtcgctgagttgttgtagtttttctaagatagacggcttcataattcttccataacaaacgccgcctgaatgttcagacggcatcaacactggattattataataggttttccggatattcaaaaagataatcttagatggataacctaccgtcccaacagggcatcggcattgcgctccgttacctttgcaatctcttctacacaggttccgcggatttccgcagcaatctttgcaatacccggaatattggcaggcgtattaatctcttttttcagcataaacgggctatccgtttccaatacgaaatccccgtcgttcaaggctttaagcgtatcgcgcactttacgcgcgttcggattgagcagcagcgaaccgatgccgattttgaaacccagtttcgtcaacacacgcgcttcttccgcgctgccggagaaggcgtgaacgatgccgccttgggcaaagcctgtctgtttgacggcggcggcgatgtcggcggtggctttgagattatggataatcacgcggcggcgcagggtttgcgcaatttcaagctggcggacgaaaacttgaatttgccgttcgcgctgctgcgacgtttgggttttatcgtaaaaatccaagccgatttcgccgacccatgcctgcggataatgtgccaacatcgtttccaggcggacgaaatcccgctcggcaatgccgtctgaaaaccaaggatgaatgcccagtgcaatacggatttgaccgtgttcggacggcatttccgccaaatccgccacgtcctgccaatcctgcgggcgcgtcgcgggaacgataaaccgcttcaccccaactttccgcgctgcggtcaggatgtgcggcaggttttcgcgcagggcgggatcagcgagatggcagtgggtgtcggtgaagttcatttcgatttcacactaactttagtcttaccaattctttgtaaacatcttccttaccccagccttgcgatacggcgagggtcatcagcgcggtggcggtttcgaggttgcatttgccgccgttgatgatgcccgagttgcggaacgcgttgccttgcgcgtaaacggcggcggttttgccttgtcggacttggctgatgttgagcagcagtttgccctgccgcgcgaagtctcggacggcgcggataaaaccttcgtctgcgggcgtgttgccgtgtccgtagctttgcaggataagagcttgggcgggaagctgtccgagtccgtccgcaagttcttggacggcaaagccggggataagcgtgcggacagcgatttttgcctgcgggtcgggataacggattttgaggccgtctgaaacggctgctgcgtcttgggacgggaggcgaagattgtgccaaccccgggtttcgtcccattcggcaagcgtgccgaaatgcggattgtcgaagcctgcagcagtttcggtgctgactttgctgctgccgacggcgggatacagtttgccgtcaaacgcgatgacggtttgtttgagcttgaggctgaaggcggcaacggcggtggagaggttgcgcggggcatcgctgttttcggcggcgtaaggccattgggaaccagtcaggacaatcggtttgcccaaaccttgcagagcgagcgcgaggagattggcggtgtacgccatgctgtccgtgccgtgcagtatcaggatgccgtcgcatgaagggagtttgtcggcaatgatgtccagccaatcgcgccagtgttgcagcgtaacggaggaggaatcaatcaagggattgcagacgtgccactcgaaatcgaggccgtctgaaaagggggaaagggcttggctaaccagtgcggtatcggggcgcaggccttcgctgctttgggtcatgcctatggtgccgcctgtgtagaggacgaagattttttgtttcatggacatcatcgggtcgtctgaaaataataatacggcttatttaactatatttcggacagactggcaatttggcggcgcggacggttttcagacggccttcaaatgaaaaagcacccgagggctgtcgatatttgattttccaagtagatttttattcacgaaataggagagccgcaacaagcttaaatcccttgtgaggttcccaacacggaagataccgctttgtggattaaaaaatacggaaactattgaatatcgacaacctatttaggtgcttgattttattgtttgctttgcgcggcttttttggctgccttggcggctttgcgttgcgcccgcttttctttcaatttgctgcggtaaaactggatacgttggcgttttttccaccaaatccaagcgacaacggtcgcacctatacccaagataacaaaaatacccgattgcaggctgtgcattttcgccatcagccaatcgatgttgtgcgcaccgtattcgcccagataaatccaaatagggacggaaatcagtgcggccagtccatccataatgataaaacgcaagtatgaaaccttgcggctgataccggctgtaacaaatacggccgttctcaaaccgggcaggaaacgggcgacaaataagacccagttaccgtatttgtcgaatttttcctgaacctgctcataacgtttcggcgtcatgatgcgcgcaataggtttgaaccttaggattttctgcccccaaattcgtccggcggcgaacatgatgccgtccccgaccaatacgccgagcataccgactgcaaacataatatgcggattggtataacccatacccgaaatcacgccgcctgttaccaaggtcaaatcctcgggaatcggcacgccgaaaccgcagatgaccaatacaaaaaaaacagccgcataaccgtattcgacaaaaaaggcttctaaaaaagcaaacatggcggatattccattgtcggagataaaaagtcagaacaaaccgaaacattttctacatgaagcaggcattctatcaaagattatgccgtctgaaagcggaaaaaaggcagattcgcgcatcctccgcatgttcagacggcatttaaacagaaaaccggccggttctaaaaacggttttgcctgattttgcctaaatgccgccgatggcggcggcaatgcgttccgccccttcgcgcgcccaatccgcctgccgcgcctccaccatcacgcgcacgacgggttcggttcccgaagcgcgcaacacgacacgccctttgccttcgagttctttttccacttccgccaacacgtctttcgaagcttcctgccattgctgacctttttggatgcgcacgttaatcatcgtttgcggatacggctgccaatcggcgcaaacggtggcgaggtcttggttcagcgtttgcagtgccgccaaaacttgcagcgcggaaataatgccgtcgccggtgttgtgtttgtccatacacaaaatatggccgctggcttcgccgccgatgagccagccgcgttggttcagctgttccaacacatagcggtcgccgactttggcgcggcagaaatccacgccctgctctttcagggcgatttccatcgccatattggtcatgaccgtgccgaccacgccgccgatgttgataccttctcgggcgcgggctttggcaatgacgtaaatcaggctgtcgccgtcgtaaacctgcccgtttttatcgaccatcatcaggcggtcgccgtcgccgtctaaggcgatgccgtagtcggcttcatgctgtaaaacggcggcctggagtgtcttggtataagtcgcaccgcatttttcgttgatgttgtagccgttgggttcgttgccgatgctgacgacctgtgcgcccagttcgtgaaacaccttgggggcgacaccgtaccccgcgccgttggcggtatcgacaaccaacttcaaaccccgaaggtcggaatggctgggaaaggtggatttgcaaaattcgatatagcggtcgtccgcaccgctgatgcggcgtgcgcgaccgagacgggcggacggttgggttttcatttcgccgtcgattttggcttcgatttccaactcgacttcatcggaaagtttcacgccgccttcggcgaagaatttgatgccgttgtcggaataggcgttgtgcgacgcggaaatcatcacgccggcggacaggcgcaacgcgcgggtcagataagccacgccgggcgtgggcagcggtccggtctgtaccacattcacacccgccgccgtaaaaccggccaccaaagcggcttccagcatatagccggaaatgcgcgtgtctttgccgatgaggacggtcggtttctggtcggtgtcgtgctgcaccaaaacctgccccgccgcatagccgagtttcaatacgaaatcgggcgtaatcggaaattgccccacttcgccgcgcacgccgtccgtgccgaaatatttttttgccatgtgttgctccgagaatgtgaaccgttgtccgagattatacagtcagtttgtgccttgctgtctgcaccgttgatgccgtctgaaaccgccccgtccttttcagacggcatgaagtatgtgaaccgctgtttacagattgatgcccaacgcttcccacaccttcaacgcatccgctgtcgccttcacatcatgcacccgcacgatttgcgcgccgcgcgctacggaagccaacgctgccgccacgctgccgtgtacgcgttccgccgcatttgcctcgccggtcagctcgcctatcgtgcttttgcgcgatacgccgatgagcagcggaaaacctgtttccgccatcaattcgggcaaatgccgcatcagcgcgatattgtgttgcaagggtttgccgaagccggagccgaagccggggtcgagtatgatgcgttgcggtgcgatgcctgccgcgatacattccgctgagcgcgctttcaaataccgcgctacttcaccgacaacatcttgatatttcggattaatctgcatggttttgggcaaaccctgcatgtgcatcaggcaaatgcccgtgtccgcctgacgcgccagcaattcgaccgcgccctcgtcattcaacgccgccacatcattaataatatcgatgccgccgagtgccaacgctttttccataatcaccgtgcggcgcgtgtccaaactgatgggaacgccccaccccgccacttccgccaaaacaggctcaacccgcgcccattcttcttcaggcgaaacataatccgcacccgaccgcgtcgattcgccgccgatgtcgagaatgtctgcgccttcttttagaagctgttcggcatgtgccaaggctgtttgggcgttttgcgaatacacgccgccgtcggaaaaagaatcgggtgtgagattcacgatgcccatgattttcggtttgtccaaaccgatttcaaaccgtcctgcctgccaaacgtgtcgtgccatctgaactcctcccaaaataaaaaacagattatatgccgtctgaaaccgtcttgtgcgcttcagacggcaccgctattcgggcggcagacggcatgttgtccgaatgtctgctccgcctttgaatctgccggtatgcctgctatccgcccgacttttcaaaacaggttccgacgattccgcacgcgcctgccgcctttgccaagccgtacaggatttcctgcggcatatcgcggttccataatcccgtaatattcgcaatcacgggcagatggctgatttggcggactttcacgatggattcgacatccaaacggtagggatggcctttggtatggttcaatacgcccgactcgcccagaatcaggtggcggttgccgcgcgagacgacatattctgcggcattcaaccaatcttcggcagaatggtgcttgtctttacacagcaccaagggaatgttcaggtttccggcttcattcaatacggcaagatcggacatcagcccgccgcccaaatacaggatgtccgcccccgcattcaaagccgcttcgacatggcggacgttgcggacgcgcaccaatacgggtttccctgcatcatgcgccgatgcggtctgttccgccaaccgtctgcaccgtccccgcccttcatccgcacttgaagtgtcgtataagtttgccgaagtgaaaaacggatccagaaacactgcatccgcattgcgccatactgacggttctgcggcgatacggacggtttccccgccgccgaaagccacgcctttggcggcaacgcggctgtcttccgcccgattttcccgactgacggttttccatgtatccaaaatgcggacggctttctcgacctccggcagcgtctgcacctccctgacgctcaaaaccctatcgtcgccgattgcgccgatgacagtacgctcgtcgccgtgagaaatgtgttctcgcagacctctgctgcggataaaggcgacaacgccggcaatgtccgcttcggcggcacgcctgctcatgacaataatcatatttcctcctgacacaagaaacggcctacccaaaataggatttttgcaagccgtgttatactgtggcgtgttttacagattgttcgggctatggatttattatcggttttccacaaataccgtctgaaatatgcggtggccgtgctgacgatactgcttttggcggcagtcgggctgcacgcttccgtatatcgcaccttcacgcctgaaaacatccgcagccgcctacaacaaagcattgcacacacacaccggaaaatctcgtttgatgcggacattcagcgcaggctcctgccccggccgaccgtcatcctgaaaaacctgaccattaccgaacccggcggcgaccagactgccgtttccgtccaagaaaccaaaatcggattgagctggaaaaacctgtggtcggatcagatacagattgaaaaatgggtggtttcgagtgcggaacttgccctgacgcgcgacgggaaaggtgtttggaacatccaagacctgatcgacagccaaaaacgccaagcctcagtcaaccgcattatcgtcgaaaacagcaccgtccgcctcaatttcctgcaggaacagcttatcctgaaggaaatcaacctcaacctgcaatcccccgattcgtcggggcagccgtttgaaagttcgggcatactggtttggggaaagctgtccgtcccgtggaaaagcagggggctgttcctttcaaacggcatcggcccgcccgaaatctcaccgttccattttgaagcttccacttcgctggacggacacggcattaccatttccaccaccggcagcccttctgtccgcttcaacgccggcggagcggatgccgccggcctcggcctgcgtgcagacacttccttccgcaacctccacctgaccgcccaaatccccgcgctggcactcaggaacaacagcattaaaattgaaaccgtcaacggcgcatttaccgccggcggcgaatatgcccgatgggacggttcgttcaaactcgacaaagccaacctgcactccggcatcgccaacatcggcaacgccgaaatctccggcagcttcaaaacaccgcgccaccagaccaacttctccctcaattcgccgctcgtatggacggaaaacaaagggctggacgcgccgcgcctgtatgtatcgacccttcaggataccgtcaaccgcctgccgcaaccccgtttcatcagccggctcgacggttcgctgtccgtaccgaatctgcaaaattggaatgccgaattaaacggcacattcgaccgccaaaccgttgccgcgaaattcagatacacacatgaagacgcaccgcatctggaagccgccgtcgcactgcaaaaattgaacctgaccccctatcttgacgacgtgcggcaacaaaacggcaaaatatttcccgacaccctcgccaagctgtccggcgacatcgaggcgcacctgaaaatcggaaaagtccaacttcccggcctgcaactggacgatatggaaacctacctccacgccgacaaaggccatatcgcgctcagccgtttcaagtcagggctttacggcggccataccgaaggcggcatcagcatcgccaacacccgtcccgccacttaccgcctgcaacagaatgcaagcaacatccaaatccaaccgctgctgcaagacctgttcggcttccacagcttcagcggcaacggcgacgcggtcatcgacctgaccgcgggcggcgaaacccgaaaagagcttatccgctcgcttcagggcagcctgtcgctaaatatttccaacggtgcatggcacggtatcgacatggacaatatcctgaaaaacggcatttcgggcaaaactgccgacaatgccgcacccagcacacccttccaccgattcacgctcaacagcgaaatttcagacggcatcagccgccacatcgataccgaactcttctccgacagcctctatgttaccagcaacggctataccaatctggatacgcaggaattgtctgaagatgtccttatccgcaacgccgtccatccgaaaaacaaaccgattcccctgaaaatcaccggcacggtggacaaaccgtccattaccgtcgattacggcaggctgaccggcggcatcaattcgcgcaaagagaaacagaaaatcctcgaagacaccctgctggaacaatggcagtggctcaaacctaaagaaccgtaaacatcctgcgtacaaaaatgccgtctgaaacacccccgcgcttcagacggcagaccgtaaaacctacaaccccaattcctcccaaatcccatcaatcttagccgtaaccgcagggtcttttttgatgacgcgtccccattcgcggtcggtttctcccggccatttgttggtcgcatccaaacccattttgccgccgagtccgctgacggggctggcgaagtcgagataatcgatgggcgtgttttctaccaaaacagtgtcgcgcacggggtccatgcgcgtggtgaccgcccagatgacttctttccagtcgcgcacgttcacatcgtcatccaccacgatgatgaatttggtatacataaactggcgcaggaacgaccagcagcccatcatcacgcgcttggcgtgtccggcgtactgttttttcatgctcaccaccgccatgcggtaggagcagccttcgggcggcaggtagaaatcggtgatttcggggaactgcttttgcaaaagcggtacgaacacttcgttcaacgccacgcccaaaacggcgggttcatcgggcggtttgcccgtgtaggtcgaatggtaaatcgggttttcgcgcatggtgatgcgttcgaccgtaaacacagggaaataatcctgctcgttgtaatagccggtgtggtcgccgtacgggccttccaacgcggtttcgttcggatggatgacgccttccaacacgatttctgcgcgggcaggcacttgcaaatcgttgccgatacatttcaccagctccgtccgcgaaccgcgcagcagtccggcaaactggtattcgctcaaggtatcgggaacaggcgttaccgcgcccaaaatggtggcggggtcgcagccgagtacgacggcgacgggatacggcgtatcgggattgagtttgcggaactcctgataatccaacgcgccgccgcgatgcgacagccaacgcataatcagcttgtttttgccgatgagttgttggcggtaaatgccgagattttggcgttttttgtgcggcccgcgcgtgacggtcaagccccacgttaccagcggcgcaacgtcttccggccagcaatgctgaatcggaagttgatacaaatcaacgtcttcgccttcccacacgatttcctgacacggcgcgtttttcaccacgttcggcgccatgctccaaatgtctttcagcagcggcagtttggaaaacgcatctttgatgcctttgggcggttcgggttctttcaaatacgccagcgtctgcccaatttcacgcagcttggacacgctgtccgcgcccatgcccatcgccacacgttcgggcgtgccgaacaggtttgccaacacgggataaccgtagcgcgtaccgtcgggcttaatcgggttttcaaacagcaacgccggcccttcggcacgcagcacgcggtcggcgatttcggtcatttccaaatacggggaaatggggtgtgcgacgcgcttgagtttgccctgctgctcgagcatggcgatgaagtcgcgcaggtctttgtatttcatattcatcctttttgtccttttatcctgaacaatccgattcggataccgcccctatccttgcctgtgcctcggcatattctatgccgtgataaaagtcgcgtaccagcggatgttcgccgccttgatggagttgcaacaaaggacgttgaccatcgggttgggtaacgacattgcagtgcagaccgaaggtgtcggtttcataagggggcagctggttgcagatcatgccgaaataaacagcgttttcaaggttgtcgtaaaagcggctttgatagtcgttaaaactcttttcgctgacggatacccacacgccatattccagcgtttcctcatgcccgataatcggaatcggcagcaccgcgcggataaagcggtcggtttggtcgggatagcggatgatgcagaaatcagaatcgcattctgcttgataagcaatgcgttcttcttcactgagttgattatagggatcgggtgcggtaaagccgattgcgggcatttcttcgtggttttcgccgcaggaagtgcaagtgtacataaggtttcagactttcaaaacgagtttgcggtaaagccattcgccggcaaacagcatccccatcaatacataggcaatcacgccggtataaaccgcccaccaatcatatcgccccaaccgtgccaacaaagcggcaagcgtcccgttgattataaaaaatacgcaccaaacctgcgttacccggcgggtatagcgcacggctttttcaggcaggtcgggctgttgcagccgcgcaagtttttcaatcaccgtctgcccggcaaacaggctgccgccgaacaccgccaacatcatcagattgacgaggacgggataccaatacatcgaatcatgccgcccgaacaccaatactgcggcaaaaaacagtgtaataaacaaagccgcataacgctgttggggcagtttggcagtcagggcgcgcagcagccacaacccgcacatcgccgccgccagccaaacaaaccagcccgcctccctgccgtatatagtggattaacaaaaaccagtacagcgttgcctcgccttgccgtactgtctgcggcttcgtcgccttgtcctgatttttgttaatccactataccacaaagcgggataggcaatgcttaatacggtcagaaaaatatgtccgaaaaaaccgggtttcattttgaatccgcacaaatgttttcagacggcatccgataaaaacatgccgtctgaaaaataattagaaatacccgattagcccgcctgaatcttcaataccgcctgtaccacgtcgttgacggtgcggacattgcggaaatcttcggcctgcagcttgcggccggtttcgcgcttgatgcggtcaatcaggtcgatggcatcgatgctgtcgatttccaaatcttcgtaaagattggtatcaggcgtaatccgttccggttcgatttcaaacaactcggtcagggtatcgcgcaacaaccggtagatttcttgttcggtcatatgtttcatccttatgcttggcggcttttgacaaaggcggcgagtgttttgacattggcaaaatgttcgcgcaagttctcctgctcgccgtccaatcggaaaccgaaatgtttttgcaccgccaagcccaattccagcgcatcgacggaatccagtcccagccctccgtcgccgaacagcgcgtcttcgctgccgatgtcggcggcggttatatcctccaaagccaaactgtcgataatcagttgtttgatttggttttccaagtcgttcatatggttttccttgtaaaatagtcctgcagatattcattcagccgccgcgccgcaatcggcaacggtttctcggcgagccagtcttgggggaggatgtcgtctccgacggtaatttcataccgtatccttttcggggggatgcggtaccacggctgcccctttttaaaattgggcggattcattttgatacatacgggcgtaatcacttcggcataccgcagtcccaaagaaaccgcgccccggtgcatttttacccgtccgtcccaccccgtcctcgttccttcggggaacaccagcaggctctgcccgctgtcaaaaaccgcctttaccgtttccagcattgcttccgactcttcgttcggaatatagcccgcacctttaatctggctgctcattgccggattgtgctgcaaatcttttttcacgatacagttcatttcgggcacatggccgacaagcagcaccacatccagcaaagacggatggtttgccaaaatcaactgtcccgggcggttgagtttttcaacacccttgaacgatacctccaacacgcccgaccatttcagataagcaacgaacaaacgccaagatgttccgataatccggcgcgccgccaattggcgggcgacagaccctgaagtgccgttcaaagtataaggcaacaaaaccaatttcatcataatgccgccgacaccgaaaatcacaaatcctaaccaagtcgcaaaaaaacggcggcaataatccaatttatccattccgctgccacagccattcacgattgcgatatacccggcggcattctcgactgccgttcagcagaaagcgcacccattccaaaccgctccaatatgcctcgggcagcataccggcttcagacggcatatcgtccgaagcagacaaagtcaggctgtaacgcgtccctttggtcagaaccatcgccaaagcataagcaaacggcgcgcgagtcgccgatacggcatatccttccggcagcggatcgtccgccgccaaaaccaaaaccgacccgcatccctcttccaacagtgatgccgcttccgccaatgccgtttccacaccgtcggcacacacggccaatgccgtctgctcgctcatatcctgacgcaatatcgaccattgccccgccgttgcattgtgcaccgacaaaccgaacgaagtcggcgacacggtatgcgatttcaacagttccaaccacaaatcgaaactgcgtgccatttccccgtcgtgcgaggcataaactaccggactgccgggatgggcggaggcaatgtcccaagccgcgtcgcataccaaacgcgccgccttactcaaacggcggcgctgcatagcgggcaggaacggcaattccggcctgacatcgggcaaaccgtcggcaaaatccggacattccgcccattttgcccactgggccatatcgcgcattttgctgcccgaaacccgccaggcggcgatgtcgaagtggaaccggcaaataatcgacggcatagtttctttcaaaaatttacactgtgccgcattctaaccaaagcctatccccctgacaatgccgaaattcaaacgcatttctgccccctttctccgacaacgccgcccctcggaaaaccgccagaattagcctgaatttacatttatcattataatgcccgtatttgccagcctgccgccgcaatatatggacacactgccagaatgcccgattaccaacaccgcctccctgctgccgcacagcgggcgtatggttctgatagaccgcattacccgatacggcgatgattttgtcgaagcaggggcacaggtaagccccaatcacatccttttacttgacgacaaactgccctacacggcatttatcgaactgatggcacaggctgtcggcgcgtatgccggtatccaagcccgaaaaaacgcacggtcggtccggctcggcttcctgctcggcacgcgcaaacttgaaatcttcgcccaatccgtcccaatcggcacgcatctgctggcaacggcgcatatgtctattcaggatgccgggggtatgggcgtgtttgactgcgaactgcgttggacagacgcgccggaaacttcgtccgaaacactcccttcagacggcattttggcgcgcgcctcactcaacgtgtacagccccgaacaccctgccggaacaaccgatgccgtctgaacaggcacacacatacggagaacaacgatgaccgaaactgtcctgattaccggctccaacaggggcataggcaaagccgtcgcattcggtttggcggaagacggctttgatatcgctgtccactgccgcagtcgccgcgacgaagccgaagccgtggcggaagaaatccgcgctttgggcagaaatgcgcgcgtgttgcagtttgacgtgtccgaccgcgaagcctgccgcgagattctgaccgccgacatcgaagcaaacggcgcgtattacggcgtggtgttgaacgccggactgacgcgcgacaataccttccccgcgttttcagatgacgattgggatgtggtgctgcggactaatttggacggtttttacaatgtattgcatccgctggttatgccgatgatacgccgccgcaaagccggacggattgtgtgtatggcatcagtgtccggcctgacgggcaaccgcgggcaggtcaattacagcgcgtcaaaagcaggcattatcggcgcggcaaaagccttggcggtcgaactggcgaaacgcaaaatcaccgtcaactgtgtcgcgccgggtctcatcgataccgatattatcgatgagaacgtacctgtcgaagaaatcttaaaggctgtccccgcagcgcttatggggctgccggaagaagtggcgcacgcggtgcgtttcctgatggatgaaaaagcggcgtacatcacgcgccaggtgattgcggtgaacggaggtttgtgttgaataccagaagggtcgcagtaacaggcataggcggcattaccgccttcggccgggattggcaaagcatacaggcagcattcaaagccgaaaaaaacgccgtcaaatatatggattggcacgaacgtttccccgaattggaagcgcaactgggtgcgccgattgaaaattacgcgccgccgaaacattggacgcgcaagcagctcagaagtatggggcgcgtgtcgtacctgtgcgtcgatgcggcggagcaggcgctggcggatgccggtttgctcggggacgaaagcattaccgacggacggatgggcgttgcctgcggctcttccagcggcagcaccaaagacatcggcgatgtgggcgaattgttgctgaccggcacgtcgcgcaacttcagcgccaacacctatgtgcgtatgatgccgcacaccaccgccgccaatatcggcatctttttcgggctgaaagggcgcatcatcccgacatcgagcgcgtgttcgtccggcagccaaggcataggttatgcctacgaagccatcaaatacggtctgaccgatatgatgctggcgggcggaggcgaagaatttttcccgtccgaagtgtatgttttcgactcgctttatgccgccagccgccgcaacggcgaaccggaaaaaaccccgcgcccatacgacgcgaaccgcgacgggctggtcatcggcgaaggcgcggggattttcgtgctggaagaattggaacacgccaaacggcgcggtgcgataatttacgccgaactcgtcggctacggagccaacagcgatgcctaccatatttccacgccccgccccgacgcgcaaggcgcaatccttgcctttcagacggcattgcaacacgcaaaccttgcacccgaagacatcggctggattaatctgcacggcaccgggacgcaccacaacgacaatatggaaagccgcgccgttgcagcggttttcggcaacaatacgccctgcacgtccaccaagccgcaaaccggacacacgctgggcgcggcggacgcaatcgaagccgcgttcgcgtggggcattgccgaccggcaaagcaatcccgaaggaaaacttccgccccggctttgggacgggcagaacgaccccaacctgcccgccatcaacctgaccggcagcggcagccgctgggaaaccgaaaaacgcattaccgccagctcgtcgtttgccttcggaggaagcaactgcgtcttaatcatcggatgaaataagtttgtcaatcccaccgctatgctatacaatacgcgcctactcttgacgggtctgtagctcaggggttagagcaggggactcataatcccttggtcgtgggttcgaaccccaccggacccaccaattcccaagcccggacgtatgtttgggcttttttgccgccctgtgaaaccaaaatgctttgagaaaccttgataatgaaaaaagtcagcgtattgattgttgccaaaaacgaagcaaaccacattcaggaatgtattgaaagttgccgtttcgataaagaagttatcgttatcgacgactacagcaccgacaatactgccgaaattgccgagggtttgggcgcaaaagtcttcagacggcatttgaatggggatttcggagcgcaaaaaacatttgccatcgaacaggcaggcggagaatgggttttcctgattgatgcagacgaacgctgcacgccggaactatctgatgaaatctcaaaaattgtccaaaccggcgattatgccgcctattttgtcgaacgccgcaaccttttccccaaccatcccgccacacacggcgcgatgcgtcccgacagcgtatgccgtctgatgccgaaaaaagacagttcggtgcaaggcaaagtacacgaaaccgtacaaaccccctaccccaaacgccgtctgaagcattttatgtaccattacacgtacgacaactgggaacaatatttcaacaagttcaacaaatatacttccatttcagccgaaaaataccgagagcagggaaagcccgtgcgtttcgttagggacattatcctccgcccgatttgggggtttttcaaaatttatatcctgaacaaagggtttcttgatggaaaaatgggttggattatgtccgtcaaccacagctattacacgatgattaaatatgtcaaactatattatctgtacaaatccggcggaaaattttaaatggaaaaagaattcaggatattaaatatcgtatcggccaagatttggggtggaggcgaacaatatgtctatgatgtttcaaaagcattggggcttcggggctgcacaatgtttaccgccgtcaataaaaataatgaattgatgcacaggcgattttccgaagtttcttccgttttcacaacgcgccttcacacgctcaacgggctgttttcgctctacgcacttacccgctttatccggaaaaaccgcatttcccacctgatgatacacaccggcaaaattgccgccttatccatacttttgaaaaaactgaccggggtgcgcctgatatttgtcaaacataatgtcgtcgccaacaaaaccgatttttaccaccgcctgatacagaaaaacacagaccgctttatttgcgtttcccgtctggtttacgatgtgcaaaccgccgacaatccctttaaagaaaaataccggattgttcataacggtatcgataccggccgtttccctccctctcaagaaaaacccgacagccgtttttttaccgtcgcctacgccggcaggatcagtccagaaaaaggattggaaaacctgattgaagcctgtgtgatactgcatcggaaatatcctcaaatcaggctcaaattggcaggggacggacatccggattatatgtgccgcctgaagcgggacgtatctgcttcaggagcagaaccatttgtttcttttgaagggtttaccgaaaaacttgcttcgttttaccgccaaagcgatgtcgtggttttgcccagcctcgtcccggaggcattcggtttgtcattatgcgaggcgatgtactgccgaacggcggtgatttccaatactttgggggcgcaaaaggaaattgtcgaacatcatcaatcggggattctgctggacaggctgacacctgaatctttggcggacgaaatcgaacgcctcgtcttgaaccctgaaacgaaaaacgcactggcaacggcagctcatcaatgcgtcgccgcccgttttaccatcaaccataccgccgacaaattattggatgcaatataaactgctttcagacggcatatgccgtctgaaagcctttgatgcaacaaaccactaaattatattcgttcattggaaagaaacaccccgaattcatccttcaaaataagaaaatcccaatatcccccgatattacgcagcctattggcaaagttttgcagcgtcttccccggcttgtgctgccgcgtcaagtgctttgttacaatgtatagtagactaacaaaaaccagtacagcgttgcctcgccttagctcaaagagaacgattctctaaggtgctcaagcaccaagtgaatcggttccgtactatctgtactgtctgcggcttcgtcgccttgtcctgatttttgttaatccactatactaccttcacatttcttaataaattttatgagtaaccatacttcttggtcgtccaaaatcggtttcgtccttgctgcggcaggttcggccatcggtttgggcgcgatttggaaatttccttatacggcaggcaccaacggcggcgcggtgtttttcctgctgtttttgatatttactatcttggtcgccctacccgttcagcttgccgaattttatatcgggcgcacgggcggtaaaaatgccgtcgattccttcagggttctgcgtccgggcacgcaatggctttgggtcgggcgtatgggcgttgccgcctgctttattttgctgtcgttttacagcgtggtcggcggatgggtattaaattatgtcgtccacagttttacgggggcggttcataccggcgcggactttgaagccttgttcggcgcgacgatttccaatccggcaggttcgctgtcctatcaggcactgtttatgctgattacggtttgggtggtcaaaggcggcatttcagacggcattgaaaaggcaaaccgttatctgatgccggggctgtttatcctctttattgcgctggcaatccgttcgctgacgctgccgggtgcaatggagggcgtgtctttcctgctcaaaccgaattggtcgtactttaaagccgatacgatgattacggctttaggccaggcgttttttgccctgagcatcggcgtttccgccatgattacctacgcttcatatttgggaaaagatcaggatatgttccgttccggccatacgattatgtggatgaacctcttggtttcgctgcttgccggcctggtgatttttccggcggtgttcgccttcggttttgaaccgagccaggggccgggattgatttttatcgtattgcccgcagtgtttatgaagatgccgttcggtacggttttgtttgcggtatttatgctgctggtcgttttcgccacgctgacttcggcattttcgatgttggaaacggtcattgcctcaaccatccgccaagacgagcgcaaacgcaaaaaacacacttggcttatcggcacggccattttcattatcggcatcccgtccgcgctgtctttcggcgtatggggcgagtttaaggttttcggcaaaaccatttttgatttgtgggactatgttatttccgccgtcattatgccgattggtgctttgagtgtttccatctttaccgcctggattcaggacaagcagtctgtgttaaaagatgccggcgcgggcagcaccgtaccacgggcagtgctgctgctgtggctgaataccttgcgctaccttgccccgattgccattattattgttttcatcaattctttggacatcctttaaaagccatccaaacagcaaaaatgccgtctgaaagcctttcagacggcatttttgcttcgggttcagcctatttcgttcaaagtatagtggattaacaaaaatcaggacaaggcgacgaagccgcagacagtacaaatagtacggaaccgattcacttggtgcttcagcaccttagagaatcgttctctttgagctaaggcgaggcaacgccgtactggtttttgttaatccactatagccttgcgcgatgccgttcaaggacaaacccatacccttttcggcaaaacggatttcacggtcgtcaaacgagactttgccgaagccgacccgtttcagggcttcgtccacgctgttttgaggaggcggcgtttccgcatcgggacgggcggcaaaataatcggcatacagtttccacaacgcctgcactgtcggatcgaacgcgccgtccgtcagcgcgtgaatatcgcggcacaggctcaacagttccaaaaaatccgccgacggcgaagtcagataaccgtccctgttcaggcggctgatcaggctgtcttcacggtaaaggctgaacaattttttccaaacgcgccacttccgccaaaaccttgttgaccaaatccgccgcacgcctgtcgtccacaccgaacagacggagctccgcaccggaacccagtgcgacacctttccagaaaaacacattttcattgcgtttttcatccccgttgcgtttttcatcatcggcggcaaaaggattcggcaggaaagaaaccgccgcgcccgccgccgcaacggcggcaaccgtcagaaaacgcctgcgcccgaaatgcctgcccataccgcctctaaaccgacactgccgccttgatatgcggatgagggtcgtaaccttccaactcgaaatcttcaaacttgaaggaaaacaaatctttgacttcaggattgattttcatcactggcaaggcgcgcggttcgcgttccaactgcaatgcggcctgctcgaaatggttgcggtacaaatgcgcgtcgccaaacgtatggacaaactcgcccgcctccaatccgcacacttgcgccatcatcatggtcaacaatgcgtagctggcaatattaaacggcacaccaaggaaaatatctgcactacgctggtaaagctggcaggacagtttgccgtcggcaacgtaaaactgaaacagcgcgtggcagggcggcaaggccatttcatcgaccaaagccggattccacgccgatacaatcaggcggcgcgagtcgggattcttcttgatttgttccagcacattggcgatttggtcgatatgcctgccgtcgggcgcgggccagttacgccactggtagccgtaaaccgggcctaagtcgccgttttcgtccgcccactcgtcccaaatggaaacattgttgtcctttaggtatttgatattggtatcgcctttgagaaaccaaagcagctcgtggataatcgaacgcagatgcagctttttggtcgtcagcagcggaaaacctttgcccaagtcaaaacgcatctgataaccgaatacggagcgcgtacccgtaccggtgcggtctgatttgtccgtaccgttgtcgaggacgtggcgcatcaagtccaaataggctttcatagcagtctttcatcaaattaaacggcgcatattgtaacatttccggataatgcccaaaacacggatacaggcaggcaggattgttggcaatttcagtccttttccacagtaaaacccggtgggaaaacaaaattaccttgattggaatcaaaaaatctagtttaattacttagaataaaatttcaataatatttttatttacgaaattaatttatgattattgattaattatcggcaacaaacatcaaacatcgaaaatatggaaaaaataatgtcaacaatttttgccaaatcgggcttggcatcagaaaaaaataggtttatattcccacctacaaatttgttttcccattagtacactatcaaccaaaaggagtatccgaatgactgacctgaacaccctgtttgccaacctcaaacaacgcaatcccaatcaggagccgttccatcaggcggttgaagaagtcttcatgagtctcgatccgtttttggcaaaaaatccgaaatacacccagcaaagcctgctggaacgcatcgtcgaacccgaacgcgtcgtgatgttccgcgtaacctggcaggacgataaagggcaagtccaagtcaaccggggctaccgcgtgcaaatgagttccgccatcggtccttacaaaggcggcctgcgcttccatccgaccgtcgatttgggcgtattgaaattcctcgcttttgaacaagtgttcaaaaacgccttgaccaccctgcctatgggcggcggcaaaggcggttccgacttcgaccccaaaggcaaatccgatgccgaagtaatgcgcttctgccaagcctttatgaccgaactctaccgccacatcggcgcggacaccgatgttccggccggcgacatcggcgtaggcgggcgcgaaatcggctacctgttcggacaatacaaaaaaatccgcaacgagttttcttccgtcctgaccggcaaaggtttggaatggggcggcagcctcatccgtcccgaagcgaccggctacggctgcgtctatttcgcccaagcgatgctgcaaacccgcaacgatagttttgaaggcaaacgcgtcctgatttccggctccggcaatgtggcgcaatacgccgccgaaaaagccatccaactgggtgcgaaagtactgaccgtttccgactccaacggcttcgtcctcttccccgacagcggtatgaccgaagcgcaactcgccgccttgatcgaattgaaagaagtccgccgcgaacgcgttgccacctacgccaaagagcaaggtctgcaatactttgaaaaacaaaaaccgtggggcgtcgccgccgaaatcgccctgccctgcgcgacccagaacgaattggacgaagaagccgccaaaaccctgttggcaaacggctgctacgtcgttgccgaaggtgcgaatatgccgtcgactttgggcgcggtcgagcaatttatcaaagccggcatcctctacgccccgggaaaagcctccaatgccggcggcgtggcaacttcaggtttggaaatgagccaaaacgccatccgcctgtcttggactcgtgaagaagtcgaccaacgcctgttcggcatcatgcaaagcatccacgaatcctgtctgaaatacggcaaagtcggcgacacagtaaactacgtcaatggtgcgaacattgccggtttcgtcaaagttgccgatgcgatgctggcgcaaggcttctaagcaaacgccgccgctccgcaaacaaaatgccgtccgaaccgcaaatgctgttcagacggcatttccttatccgcccgttcaaatcgggtgagactaccgatacatctgaatatgctatgccgtctgaacggcattcacaccgcccaatcctgcacgcgcttcaaatcattttgcgccaaagtatctgcgtggcggttacggctctgatattccctgtctttcaagatgctgctcgccacataattcaaatgtgcctttgccgcctccgaagcctcgcccggccggcggtttgatattgcctcatacaatacacggtgctgcgccatcagcttcggacgcggatcttcttcctgattcagataaataaggctgctgcgcgtctgccggtacagcattttcaacaaaccgcccgacaaatggctgaacaacaaattgtgcgccgcatcggcaatcgtctgatgaaagctgacatcagcttcgctctgatgttccaaattgccgctttcgcacgcctcctcaaacttttcaagccaaaacccaatccgcttcaaatcggcatccgtgcggcgttctgccgccaatgccgccatacagccctcgatgtggcaactgaaatcaaaaacatcctgttcccaattggaatgcttgcccaaaagctcctgccaactttgcaaaaaatcctgctgcggcttgaccgaaacataataaccgtctccctgcctcgcttccaaaacctgacgggcgaccaaaacattcaatgccgacctgaccgacgggcgcgaaacgccgaactcttccgccaaaacgcgttcgggcggaatcttgcccccttccgcgtaaaccccttccgcaatgcgctcctccaataccgacaatacctgatcgctgattttctgaggccttaccagtttcatcactcctcctttataaagattccctgcagaacccttccgaaatatagtggattaacaaaaatcaggacaaggtgacgaagccgcagacagtacaaatagtacagaaccgattcacttggtgcttcagcaccttagagaatcgttctctttgagctaaggcgaggcaacgccgtactggtttttgttcatccactatacatcaaacatcaaattggactgaccaatcagggcggattctaatgacacgccgttcccgccgtcaacggcatttacctcgcaccgcccccgaaacacaagaaaaaactacaccaaactacaatttttgttcatgcaaatatttgttttgacaggatttaaacaaaagctccgattcaaatctgccgaaccgcccaaaaatatattgacctaaatattaaagtttcgtaaagtaatgcaacgttgctttaattggtttgaccactattgccgacgattagaaaaatattttcggagatgttcaattatggaaacttgggttcaaaactacacggcaatcggcggcagcctgtatctgactgccgccgccgcactcttacccatcgtctttttctttgccgcgctgaccgtcctgaagctgaaaggctatcaggcggggctttatacgctgctgattgcgcttgccgttgccgtattcggcttcgggatgccgacgggtatggcggtttcttccctgccgccgcagccgcattgacccaacgcccctacgccacactgtatttgaccgcgcattacaaaatcggcaaatccacccgcatcggtttggactttgaaaacgtgttcaacaaacgctaccgccctatgcccgacattcacgtttacggcacgccgcgcagcctgaccgcaaccgtcaaacatatagtggattaacaaaaatcaggacaaggcgacgaagccgcagacagtacaaatagtacggaaccgattcacttggtgcttcagcaccttagagaatcgttctctttgagctaaggcgagccaacgctgtactggtttttgttaatccactataaagaaagaaatgccgtctgaaaccttatcgtttcagacggccttggattcggatttcaagtgcaacactagtgtattagtggttggaacagattcaagaataaaacacttggcgtttcgtagccaagtgtttttcttggtcggtggttcaactcatcttgaaccctgcgtatctcccgatcactgatgttacggaaatcggtttgtttggggaagtattgccggatgagtccgttggtgttctcattcagccctttctcccaagaatggtaagggcgacaaaaataagtctccgctttcaatgctttggttattttggtgtgttggtagaactctttgccgttatccatggtgatggtgtgcaccctgtctttatgtgcctttaatgccctaacagctgcccgggcagtgtcttcggctttgaggctatccaatttgcagatgatggtgtagcgggtaacgcgttcgaccaaggtcaataatgcgcttttctgtcctttgccgacaatggtgtcggcttcccaatcgccgatacgggatttctggtcgacgatagcgggtcggttttctatgccgacacggttgggtactttgcctctggtccatgtgctgccgtagcgtttgcggtagggtttgctgcatattctgagatgttgccacaacgtgctgccgttgcttttgtcttggcgaaggtagcggtaaatggtgctgtggtggagcgtgatccggtggtgtttgcacaggtaggcgcatacttgttcgggactgagtttgcggcggataagggtgtcgatgtgctgaatcagctgcgaatcgagcttatagggttgtcgcttacgctgtttgatagtccggctttgccgctgggctttttcggcgctgtattgctgcccttgggtgcggtgccgtctgatttcgcggctgatggtgcttttgtggcggttcagctgtttggcgatttcggtgacggtgcagtggcgggacaggtattggatgtggtatcgttcgccttgggtcagttgcgtgtagctcatggcaatctttcttgcaggaaaggccgtatgctaccgcatactggcctttttctgttagggaaagttgcacttcaaatgcgaatccgccggcattttattgcccgaccggttatttgtcggtttgggtatcccgtttcaatccgccgccgagtgccttgtacaaatcggcaaggttttcggcgcgggtcagttgtgccgacaaagccgcaccctccgccgcatagctgctgcgttccgcatcgagcaagtcgagcgcgccggatacgccgtgcttgtaacgcaggccgaccaagcgcaacgcttctttagaggcgcggctttgtttgcttaaagcgtcataggctttatccagctgctcgcgcgccgccaatgcgtttgccacgtcttgaaatgcggattggacggcggattcataggcaacgatttgtacctgttggcgcagcttggctacatcaaggttcgccttgttcgtaccccaggtaaaaatcggcagggtaatagacggcgcgaacgaccaaacgcccgtgccgcttttgaacaacccacccaattcggcagaacccgtaccgacggttccggtcaggcggatggatgggaaaaaggcggcgcgtgccgcaccgatattggcgtttgcctgtttgagcgcgtgttcggcagcacggatatcgggacggtcgagcaatacttcggaactcaaaccggccggcagtttttcaacaaaaaactgcttgtccagcggcaaaccggcaggcaggtcttcgggtatcggttggttaatcaaggttgccaaggcattgcgcgcctgttcgcggctgcgcgcggcatgggcataatcggctttggcagattcgatcagggcttcctgctgacgtagggcgacggcggaaatcacgcctgccttgtaacgtaattcggacagcttgtaggtttcctcgcgcgttttcaaaacacgttgcgccaaagacatcgcttcttcggcgtaacgttcgttgaaataggctttggcaacggtggcaatcaggctcaaatgtgccgcatcgcggttggcggtgctggcgaaatagccttgcagtgccgcctcgctgctgctgcgtacacgcccgaacagatcgagttcgtaagatgccgcacccagtccgactttgtagctgctgcttacattgccgccgctcaagctgccttggcgcgagtcgttcgcattggcggcaagcgtgggcaggaggttgttgcgctcaatcatgtattgtttgcggtagatttcgctgttcaatacggcggtacgcaaactggtattgcgctcgagtgcgatgtcgatcagcttttgcaggcgcgggtcggcaaaatagtcatgccaacctaaatcgacggcgcggatgccgctgtcggcggtatcgtttttgaacgtttcggcaacttcgactttgggctgctcgtattggggaatcatggtgcaggcagacaatgcaaaggctgctgcaacagaagtcaaggtggttttcaatgtagtatccataaaaaagtcctgatgccgtctgaaaacccgtgggcgttcagacggcatggttgcttaatgttggctgtcgtccgaaccggtgatgcccgcttcggcggcgtgttttactgccatttcgtgttcgtgcgcggtttctttgaagaatttgcgcaccaccacatagaaaagcggaacaaggaacacggacaagagcgtgccgatgagcatcccccagaatacggttgtaccgatggcgcgctggctggcagaacttgcaccgccggcaatatacaggggaaccacgcccaaaataaaggcgaacgaggtcatgataatcggacggaaacgcaggcgggcggcttccaaagcggcttcaaccgcgcttttcccttgcgcttgaaggtctttggcaaattcgataatcaaaatcgcatttttcgcactcaaacccatcacggtaacgaaaccgacttgaaagtagatgtcgttggcgaacgagggaacgctgcccaacagtccttcaaacaggttgcgcccggttacgcccgcagccgcaccgatcaaacccaacggaatcacaaggatgaccgccagcggaatcgaccagctttcataaagcgcggcaagtaccaaaaatacggctgcaaccgccaaaccgtacaaaatcagggtttgcgagccgccttttgcctcttcgcgcgactgtccgccccactccaggctgtaaccgccgcccaattcgtcaaccattttttgaaccgccgccatagcctgcccggtggaaacgccggttgcaggcgaagcggacagcttcatcgaaggataaccgttgaagcgtacgctctgttccgtaccgttttcccaagaaacagtagcaatggtggaaagcggtacggcgacgccggatttgttcggcacggtcaggttcaaaatatcggcaggctgcatacgggcatcctcgtcggcctgcaccatcacgcgttgcagacggccttggttcgggaagtcgctgacataagacgaactcagcgcgcttgccaatgcggtgcggatgtcggcaaacgaaatgccttgcgccgccgccgcggcacggttgatgtcgattttcaactgcggcgagtcttccaaaccgccagcacggacggtgctggggtcaaacaaaccgctggcacgcattttctgaatcaactcgttgcgcttcgccagcaatgcggtatggccggtattgttgcggtcttgcaggttgatgctcagacccgaaccgttgcccaactccagaatcggaggcgggacgacggcgatgccaaaaccgtctttaagcgtccccatcatcatacccgtcagcttgccggcaatcgcaacggcatcgctgccgggcgcggtacgctcgttccaatctttcaatatggcaaaacccatcgccatattctgaccgctgcccgaaaagctgaagccggaaacggtaatgatgttttctatttcaggaatgcttttcgccagttgggtaacttgcgccaaagtcgcattggtgcgctcttgggtcgctcctgcaggcagttgcacgctgaccatgacgaagccttggtcttcggtcggcaggaatgaagtcggcaggcgcataaacaggaacacgcccacaaccgccaagccgatatagacaaccatcatgcggaaagtcttacgcagcactttggcaacccggccttcgtaaccgtgcgtccaactgttgaatttcttgttaaaccagccgaagaaaccttttttctcttcgtgatgccctttcgggattgtcttcaacattgtggcacacaaagcaggggtaagggtcagcgcaaggaaggcggagaatgcgattgatgacgccatcgtcagggcaaactgtttgtaaatattgcccgtcgccccgctgaacatcgccaacggtacgaacacggaaatcagaacggcggtaataccgatgaccgcgcccgaaatctgacccatcgcttttttggtcgcttctttgggcggcaagccttcacccgccataatgcgctcgacgttttcaaccaccacaatcgcgtcatcgaccacgatgccgatgaccaaaaccatcgcaaacatggtcagtacgttaatcgacatgcccatataagagatgaaggcgaaaccgcccaacagcgaaatcggtacgacgatggtcggaatcagcgtataacggatgttttgcaggaagagatacattacgacaaacaccagcaccatcgcttcgattaaagtgtgaatcactttttcaatcgaaatttcgacgaatttggaagtatcgtaaggggttttccagctcataccctgaggaaagtatttttccaacgtcgccatgcgttctttaaccgcctttgccgtcgccatcgcattgccgctgttggacagcatcaccgccataccggtggtatttacaccgttcagacgggttgaggaagaatagtcttccatacccagtccgacccttgccacatccttcaggtaaacattagaaccgtcggtattggcgcggaggatgacgttgccgaattcttctgccgtacccaactgcccttgcgccgttacggtagccgtaaccgtctgtccgcgaacggcgggaagcgaaccgatagaacccgctgaaatctggacgttctgggcggacagcgcgctgccaacatcggcaaacgacaaattgtagttttgcagtttcttaggatcaacccaaatccgcatcgcgcgttgcgcgccgaacaggcgtacctgccccacgccttcgatacgctgcaactcgggaacgatattacgctgcgcgtagtcgttcatctcttcggttgactgcacatccgacgaaagcatcacaatcatcaggaaattggaacgcgccttggatacggttacgccgtattgctggacagttgccggcagcgtgctcaatacttcggaaagcttgttctgcacttccacctgcgccagattctcgtcggtatcgggcgtaaaggtcaggctcacgctgccgctgccgctcgaatcggcggaagtggacatataatccaaaccttccacgccgttcatattccgctcgatcacggaaagcacgctgtcttccattacctgcgcggacgcgcccggataagtggccctcagggtgatggtcggggcggcgacggacggatattgcgaaaccggcaggcttttgatgccgaaaatacccgccgcaataatgaaaatcgaaataacccacgcaaaaatggggcggtcgataaaaaatttagccatcgatgccttccttatttcgcttcagaagcaggtttggcttcagatgccgtctgaacgccggattgaggcgcggcggcttggttttcagacgacgcccattctttgggcgttacctttttcgcacccgttataccggcgatactgatgccttccacaaccaccttgtccccgtccttcagacccgacgtaacaatccaattcgtaccctgctgttgcgcaaccgttacctcgcggggttccataccgccttgggcattcacaatcatcacggtatctttcgcaccgcgcgttaccgcctgctgcggcacaacaaatgcgttatccaccgccacttggtccatcagcacgcgcacatacagaccgggcatcaagatattctgatcgttcggtacggcggcgcgcagggtaatctgaccggtcgattcgttgacggccggatcggcaaacagcaggcggcctttttcagggtaaactgtgccgtcgtcaaatttgatgccgaccgcaatcacaccatccgccgccagcagtttgccttcggctatctgacggcgcaatttcatcacttcggatgcagactgggtaacgttcacatacatcggattggtttggcggatggtcgccagtacggtcgcatcgccagcgttcagcaacgtaccttcggaaactttggactgaccgataaagccggaaatcggcgcggtaatgcgcgaacggttcaggctgatgccggcggatttgattgccgcctgcgccgctttaacgcctgcctcggcagaacgtttcgccgttaccgcagcatcgtattcctgccggctgacggcttcggcggcaaccaaaggcttgtatcgcgccaaatccgcatccgctttggcaagcgttgcctgagccgttgccagttgcgcgcgcgcgctttccagacctgcttcataagtggaactgtcgatctgatacagcggctgtccggcacggacataactgccttcttggaacaggcgtttttggatgatgccgccgacttgggcgcggacatcggcggtacgcagcgattccaaacgccccggcaactcgacggtcaatgcgacggtttgcggatggacggttacgacaccgacgacgggcgcaggggcttcccgaccagcaggctgcccgccctgcgccgcgtctccgcctttaccgcaagacgacagtaccaatgcaacggcggcagccaacgcggccgcacgcatcgccttaaaagcataaaaagccattatttatcctatctgtctggtttgatgtaaagggttttgccaatcaacaggcattcttatagtggattaacaaaaaccagtacggcgttgcctcgccttagctcaaagagaacgattctctaaggtgctgaagcaccaagtgaatcggttccgtactatttgtactgtctgcggctcgccgccttgtcctgatttttgttaatccactatatttcaggatataaaaaccgcctgcttcgccaacccgatgttcaaacgggttgcgaagcaggtttcatgggttttcaaagttgagatgtagtctcaatttcatgggtttcattatacatacacgattgcatggttacaaagtcttttttataatccgccctcatcaaaccgacccgaaacgaaaccgccattatgagaaaaaccaaaaccgaagccttaaaaaccaaagaacacctgatgcttgccgccttggaaaccttttaccgcaaagggattgcgcgcacctcgctcaacgaaatcgcccaagccgccggcgtaacgcgcggcgcgctctattggcatttcaaaaataaggaagacttgttcgacgcgctgttccaacgtatctgcgacgacatcgaaaactgcatcgcgcaagatgccgaagatgccgaaggagggtcttgggcggtattccgccacacgctgctgcactttttcgagcggctgcaaagcaacgacatctactacaaattccacaacatcctgtttttaaaatgcgaacacacggagcaaaacgccgccgttatcgccattgcccgcaagcatcaggcaatctggcgcgagaaaattaccgccgttttgaccgaagcggtggaaaatcaggatttggctgacgatttggacaaggaaacggcagttatcttcatcaaatcaaccttggacgggctgatttggcggtggttctcttcctgcgaacgtttcgatttgggcaaaaccgccccgcgcatcatcgggataatgatggacaacttggaaaaccatcccgacctgcgccggaaataatcaagccttggtagcaatgccgtctgaaacgaacaaaccctttcagacggcatcaaaatgacacaaagccttcttctaaaaatacatattgagacctttgcaataacataggttactaaaattttatgctcaatcttattttcaaaatgcaaaacttttctgatttttcctactttttgctcaatattaggaaggttttaggcaattgaaaattttttggcgcatttttatgcgtcaaatttcgttaacagactatttttgcaaaggtctcatattcactaaattgcatttttaatttcttctatcattgcatggacattctcttggtcaaaatgtccgttttcttctgaataaacttctaacaaataatgttcaatgaacgttttatctgtcgtcagcgatacatctctggcaatgtcttcatacgactcaaaatcatcttcatgccagggattatatttgtccatatttttttgaatttcatttttcatatcatttaccttccaatatttatttacaattaataacaataccattcaaaatgtaaactgcatttttctccagcatttttgcaaataaaaactgaaaatcccgccatttccgcgaaaacgggaaaccgttttttgagttccagtcattcctgataaggctttaacgtcaagttttcggattaccgcctttatgagaataacgatgtgggcattttctgttttaatctattgcggttatatacatatgcgattattttagtttgcttacaaaacacttcatgttacattcaaaaatttaatgcactcaatatatttttttaaggagaagcagatgagtcaaaccgatacgcaacgggacggacgatttttacgcacagtcgaatggctgggcaatatgttgccgcatccggttacgctttttattattttcattgtgttattgctgattgcctctgccgtcggtgcgtatttcggactatccgtccccgatccgcgccctgttggtgcgaaaggacgtgccgatgacggtttgatttacattgtcagcctgctcaatgccgacggttttatcaaaatcctgacgcataccgttaaaaatttcaccggtttcgcgccgttgggaacggtgttggtttctttattgggcgtggggattgcggaaaaatcgggcttgatttccgcattaatgcgcttattgctcacaaaatcgccacgcaaactcactacttttatggttgtttttacagggattttatctaataccgcttctgaattgggctatgtcgtcctaatccctttgtccgccatcatctttcattccctcggccgccatccgcttgccggtctggctgcggctttcgccggcgtttcgggcggttattcggccaatctgttcttaggcacaatcgatccgctcttggcaggcatcacccaacaggcggcgcaaatcatccatcccgactacgtcgtaggccctgaagccaactggttttttatggtagccagtacgtttgtgattgctttgattggttattttgttactgaaaaaatcgtcgaaccgcaattgggcccttatcaatcagatttgtcacaagaagaaaaagacattcggcattccaatgaaatcacgcctttggaatataaaggattaatttgggctggcgtggtgtttgttgccttatccgccctattggcttggagcatcgtccctgccgacggtattttgcgtcatcctgaaacaggattggtttccggttcgccgtttttaaaatcgattgttgtttttattttcttgttgtttgcactgccgggcattgtttatggccgggtaacccgaagtttgcgcggcgaacaggaagtcgttaatgcgatggccgaatcgatgagtactctggggctttatttggtcatcatcttttttgccgcacagtttgtcgcattttttaattggacgaatattgggcaatatattgccgttaaaggggcgacgttcttaaaagaagtcggcttgggcggcagcgtgttgtttatcggttttattttaatttgtgcttttatcaatctgatgataggctccgcctccgcgcaatgggcggtaactgcgccgattttcgtccctatgctgatgttggccggctacgcgcccgaagtcattcaagccgcttaccgcatcggtgattccgttaccaatattattacgccgatgatgagttatttcgggctgattatggcgacggtgatcaaatacaaaaaagatgcgggcgtgggtacgctgatttctatgatgttgccgtattccgctttcttcttgattgcgtggattgccttattctgcatttgggtatttgttttgggcctgcccgtcggtcccggcgcgcccacattctatcccgcaccttaaacacgataaacaaaatgccgtctgaaatgcttaaacgctttcagacggcatttgcctttctatcccgtcaggcttctccggcctcttcctttttttccgctgcggcaagcgtgtcggcaagcagacggacgaggttttcaaacaggggctgttcgagcgggttttggcttgcgttgccgaacacgagggcgacttcggtatagtctttctgccctttgctgactttgctgccgtggtaggcggtttgggcttttttcagggcggcttcccaatcttgtttttgggcaaacgcttcggcggtggcaagcgaggttttggcaaaaaacggcagcgggcggttttgcccgatattgaaaaacgccatccattccgacaatagctgcaatgccctgtcttgcgcgatttccgccaatatttcggtttctccggattggacgataaaggtttgccgcatttcggcttcagacggcataacggcgcaaaatatcaggtgttccagcagaaaagcgatacgttgcggcgcgttgggtttgccgtaggcgtaaaacacttgtccgcagcggtacagattgcccaagctgcctttcaggatttgcccgtccgacggtatggcatatgaaagcggtggcagtttggggctgtttaaaaccgccgtgtcgatttgtttggcagcagtttggaagtcctgctgccaaagtctgcccaactctcccgacggcaggaggctttccgccccgatgcgggcggcggtttgggcaaaatcccgtccttcgcaccgtgcttcgatgtagatttcggcgatttgatcggcgtgttgcggctcgaagggttcggcaggctcccaggcttcgccgatatggggttcgctccacgcaagctgctgctgaagccatactttgacagggttgcgccagaaacggataaattcgtcctgtccgatttcggcaacaggttcggcgttttctacgggttgatcgaaaaagggttgcggcggttcgggcgtttgtccgagcgcggcggcgtagtcggtacgcgtgccgaatatgccgtctgaacgtccgccttcttgaaaatatcggcgcgagaaggcttgcagcggatgctgttctatcaggttttgtgcaagttggcggctaccgatgcccgccatagcggcaacggtatcgatgagttcgcccaacagggaagacggggcaagctcttcgtctttgcggatgtcgcgcccgatgtaggacaggtagaggatttcacgcgcgctgatgagggcttcgaggaacaggtagcggtcgtcatcgcggcgggcgcggtctcctttggcgggatgtttggcaatcaggtcgaatacggcggctttggtattacggggaaaatctccgtcgttcaaacccaacaggcagatgactttgaacggcaggctccgcatcggcaccatactgcaaaaggtgatgccgccgcgtaaaaagcctgcctcgctttcgctgtcgagaaagcgtcggatatggcggatgacggtgtgcggcggcaactgtccggaaaattgcgccaattcggtttccgcctgccatttgacccattcgttttcaaggttttggactgacttttggtcatcggcttcagcttggaacaatgtttcaagcaaatcccggcaacgcgccacccattcgccgaccgttgcgggctgccgccatatccgtacaatatccgtcagggtttcgaggaaggcggcaaaacgtccgaacatggcggtttgattcacgtcggcataccacgcgctgacatcctgccacatcggattgccgcctttgggcagcatccagcccaatatcatgcgttctaccgcctgcttccaggtgaacagctgatccgtgccgccgcgcatttctccgtccaaaccccagtggacgttcaaatcggcaaccatgtcgtgcaaaagcggtaaatcgtcctcagtcagtccgaaacggcgcaacacgggcgcggtttctaaaagcacaagcactttatcgacttcaaatcggctttccaacaagtcgaacaggcatgacaaagcatgaaacagcggttggcggcggctgattttcacgtctgacacggaatacggcaatgcctgcgcaccgggctgcgcctgtccgaacacggcttcgataaaaggcgtataggattcgatattcggggttaatacggcgatatcgtgcggctgccaatcgggatgttcatgcagaattttcaacagcttgtctttgagtatctgcaattcgcgcaaagggctgtgtgcggagacgatgcgtatcgagccgtcgcccgtgttgacgcttcccgccatttcagacggcattttcaggttttgaatatcggtttgcagggcgtgtaaaagcgtatcgcgcccgccttcctcaaataccggcgtttcgccttctatttccatttcgttcaaaaagtcgaaaaagtcccgcccctgcttgcccaatgaggcgagcagcggatgccctgcctgagttaaatcgggatcgccgccacctttgaggatttgcgccgcttcgatgacgttgccccagtacatcccgctcggattgagtgcgaacacgaacacgtcgcaatgttcggacagcttgtgcaaaagttgcaaatacatcggcgccatcgtggaaatgccgaacacgaaataacgctcgggcagcttatcactgctcaaagattccaacagcttttcccacaacgcgacacggtgcggcgcgctctgcctgccgtcgtcgaggtaacgccacagtttggactgccagatttcgtcgtcgcccaaaccgagccgcctgccctgctgccaagcgtctatccactgaggacggtacacgaggtattggtcgaatatgtccgcaagctgtcccgcaagctggtaatctgccgattcgccgctgcccagatagtcttgcagcacattcctcacatcttcaaattctgccgtattccgaaatgcctcgctgcggaacaaatccagcagccgccagcgcatgacttcgggcgcaaacgggctgagttccggaataccgggaatcagttttttcatcagcttccacgtcaggccggcgggcaggctgaacgacaaattcgccgccacgcccaaatcgcgggcgaggcaggtattgaggtagcggcgcatcccctgactctgcacaataatctgttcgggctgtaaagccgatttcagcggtttgactttttgaatgcgggcaaacaatgccgccagcgtttcaagacggttggattgatacagataaaacatgatttcaaacagaagctgtggtcaagtattcgggattatatagcctttcccccgtccgccttcaaacaaaatgccgtctgaacctttcagacggcatttggtcatttaaaccatctcctcaaaacaggaatccgcgacaacagcagcgtatccaacagccaaatcacggcaatggcaagcagtgaggtcgggaagagcagtgcgattgccaatagcggcaatgccatcatccaccaaaccggcagcttgactttctgcgccggcggaacgatgcccaccgctccggtcggacggcgtttccaccacatcacgcagccgctgataccgataaaaatgacggcaaggcagaacaagacgttcgccaacacgctccaccagcccagagtccccatatgcagcgcaatgcttgccgccataaatttgccgaacgggttgtaatcgtcaaaacggatgtcggcaaggattttgccgctgtactggtcgatatgtaccgtgcggtcggcaaacgggctgatcatgtcgtaactcatagaatcctgcgacaaagtccatacgccgtcctcgcctttgggcaaattcaactgataacgccctttgaaaccgatttcccgcgcaaagcggtcgacggtttccaatgtcatcggctcgtcagggttaatgccgtctttgcccacagtcgtccctgaaacaggcataggcgtaagctccaaaacccacggcacttccttaaccttgccgtcattcaatacctcgccgtgggtcggcacgactgaaacggggttcggttcgacaccccatttaccggcagggaactgactccaagcctgtacgaacttgccgccccaaatacccgcccaagcaatacccgacaggcagaacaacagcaaaatcaacgacacccaagttccaaacgtgccgtgcagattccgccaccaagaacgcgccctgccttttgacggcagcagcatcgccttgatgccgcgccgtttcacccaccaaaggtacaagccgctgacaaccataataatggtcagtgaagctgccgtttccaaaagataatcgcctgccgcaccgagcatcatatcgctgtggatttcatccatcgtgtaataccaaccctgattgcgcggcatggtactgaccacttttgccgtataaggatcgaccgcgaccatcgttgctttgccctcattgttgacacggaacacggcaaccatatcatcggcacgcggcgcaatatactgaacgacggacgaagtttccggattaacggcactgcgtgccgcttccgcctgaacagacagaggttgtaccgttgcctgcggcacaacatgaatccgctcgccctccttaccggtaatattggcaaacagcagcatacccaaacccgtaacggcaagcagggtaagaaaaggcataaccagcagaccggcataaaaatgccaccgccaaacggtcagataacgccggttgctctgattgtcggcttcagttttgatttgtgtatccattaatcgtccttttgaaaatagggctatcgtgatgatgcgcgattataaacaataaagactaattctttatgactaaagtcaaaattcattacaacaaataggcagtctgcgtttaaaaccggatgcccgttaaaacaaaaaatccagattcaatactgaatctggattttcataaccgataatatcggaaactcagtcaagttagaatttgccgcctgactggttgaccatatagtcaaccgcagctttaacctcatcatcgctcaaatcgccgcgaccgccttttgcgggcatcgtattgaaaccttcgatcgcgtgtttgtgcaacgtgtccttgccttttttgatgcggtcggcccaatcggctttgatgcctacatggggaatacccggaatcgcattgccatggcaggcggcacaaacggtttcataaacctatttgccgtccgctttggcagcaggtgcagctttttcctcggctttaggttctgctgcggcaggtttggcttcggacacggcttgtgctgcttctgcaggagcagaggctgcgggttctgccgccggtgcgggagtcggtgcaggctcggcttttttcaccggagctttaccgtctttatcggaaagaccccatacataagcagtcataatatgcagtttgtctttatccaagaaatgtccccaagcgggcatttggctgctgcgaccgttggtaatggtttcgataatggatttttgcgtaccgccccacaaccacacgtcatcagtcaggttcggacccaaaccttggataccttgtcccttatcgccgtggcaagtgaaacagttggcaggcggaccgctgaacaaggcttgtccgcgcgcggcacgttcctcatcatactgaccttcgggttttgaaagggacatcacataatgggcaacgtctttcacgccttcttcgcccaaagcaggaccccaggcaggcatagtcgcaacacggcctttttcgatggtctcgtggattttatcgggatcaccgccccacaaccaatcgctatcggtcagattcggaaaacctttagagcctttagcatcagagccgtggcactggatacaataagtgttaaacaggttttgggcgatttgcttggcttgagggtcttttgccactttttcaatcggcatatccgcaaacttggcatacagtttgccgtattgctcatcggcttttttgacctctttttcatattggttatggctggtccatttcagcagacctttgtagtcgccgacacccggatacataaccaaataaccgataccgaacagccacgtcaaaacacacagccaaaaccaccagcggggcagcggattgtcgtattcggcaatgccgtcccactcatgacccgtagtttgtacttcttcgcccttcttcggacgtttgacaacattttgagacagcagcagccaagccaaagcgataaagctcagtaagacaataactgcaatatatatattccagaaattactggtaaattgggatgttgtgttcattgttttgctccgttatcacaatattaacggttttcgcttttcttatcttgcgcatcttggttttcatcaaaaatgctgtttgcggcattatcgtagtttttcttattccgcctgttgaagacgatatagagtaccaacaggaaacagataaagatccataccgtgaagagagcacgaataccgttaatatccatgatgttaccttacgtttttcaaagccagacccaatccttgcagataggcgactacagcatccagctcggatttgtttgccaaagcctcaggtgctttcgcaatttcctcatcactgtaaggagtacctactttacgcaaagccttcatgttggcaacggttgcatcgacatcgactttattgcgtgcaagccacgggaatgccggcatattggactcaggcacgacatcacggggattcagcaggtggatacggtgccattcgtcggaatagcgaccgcccacacgtgccaaatcaggaccggtacgtttggaaccccattggaacggatggtcgtaaaccgactctccggcaacagagtaatgaccgtaacgctcggtttccgcacggaacggacgaatcatttgcgagtggcagttgtaacagccctcacggatgtaaatatcgcgtccggcaacctgcagggcattgtaaggcttcacgcccggcgccggctgtgttgccgccttggtaaaggccaagggcacaacttcaatcaacagaccgacactgactacaagcagcgtgaacacaatcagaacgccgattttttcttcagccaattgttgtaatttcattttggtagcctatctttcttagtattttagtggtgctgtgtttgggaaaccgcagggatttcggcatcgactgctttaccaccgatggctgtgcggtacacgttgtacgccataatgcacataccactcagatacaataaaccacctgcaaaacggatcacgtagtaaggcatggtgcgttttacggattcgacaaacgagtaggtcagcgtaccgtcatcgttcaaagaactccacatcaaaccctgcatcacaccggcaatccacatggcagcgatatacagaaccacgccgatggtcgcaatccaaaaatgtgcttctaccagcttggtgctgtgcatctgttctttgccgaacagacggggaatcatgtaatagacggaaccgatggttacaaagcctacccagcccaacgcacccgcatgaacgtgcgcgacggtccagtccgtatagtggctcaatgcattgaccgttttaatcgacatcatcgggccttcaaaggtagacataccgtagaaggacaaggatacaatcaggaatttaagaatcgggtctgtacgcagtttgtcccacgcgccggacaaggtcatgatgccgttaatcataccgccccaagagggtgcgaacagaatcaaagacagaaccatacccaaagattgcgtccagtcaggcagcgcagtgtagtgaagatggtgcggacccgcccacatataggtaaaaatcaacgcccagaagtgaacgacggacaggcggtaggagtaaacggggcgggctgcttgtttgggtacgaaatagtacatcatacccaagaagccggcagtcaggaagaagcccacggcattatgcccgtaccaccattgaaccatagcatcaatcgcaccggaatagacggggtatgacttcatcaaaccggccgggatgctgatattgttgacgatgtgtaaaagtgcgaccgccaaaataaagccgccgtagaaccagttggcaacgtaaatatgtttaatcttacgtttggcaatcgtaccgaagaatacgatggcgtaagccacccaaaccaaagtaatcagaatatcgatcggccattccagttcggcatattccttaccttgggtccaacccatagggaagctgacgacggcggcaacgattaccgcctgccagccccaaaaggtaaatgccggcagccaaccgccgaaaagacgggtattacaagtacgttggacaacgtagtatgatgtgccgatcaggccgcaaccgccaaatgcgaaaataaccgcattggtgtgcagcggacgcaggcggccgaagtggaaccaaggtccgatattagacaagtcgagggcaggagcaaaaagctgggcggcgacgataacgccgaccaacatacccacaatcccccaaactacagtcatgatggcgaactggcgcaccactttgtagttgtaagtttgtgtgtccatgagagtctccatgaatttatgggaataaagatttttatcctgccgcttccgcagcctgtttaaggtgcaatccgggcaagcgtaattttttctaaatttaacatatctgccttattacgccaagcggaattacattcgcaccgccgacgagccctttgcttaatctgttttttattacatataaatcatattgttataataaattacaacccgaccgccattgcttttgtttccaattttccctttttgtggcactttattgatgtaggttaagctgcattttaaaggtatttaatccatcccgtttaacgatatatttgatagttatgattcattataaaataaccccgtcccctctcgaccacgagtggcacatcctgctgacattcacacaagatgatgatcttcctatagaaataagcctgccaaactgggttccgggcagctatctgattcgggatttttcccgccacatcacttctatccatgcatcctgtaacggcacgtccatgccgctcgaacaaattgccaaaaaccgctggcatgccgccgccgtacgcggcgagtggcaaatccgctacaccgtatatgcattcgatttgtcggttcgaggttctttcctgacgacagaacgcggtttttttgacggatcgtgcctgtttttgaaagtcgaaggaacggaaacgctgccgcaccgcttggaattgacgggtattccgtccgaatggcgtattgccacaacgctgccggaaacagggaggtttgtctttcaggcggcatcttatgccgaattgattgaccgacctgtcgagatgggcttgattgaatttttagattttgaggcggcaggcattccgcacacaattgccttaagcggcatatatcccgatttcgaccgcaacaggctggtttcggatatcaaaaaaatctgcgaaacagaactggcggtgttttcctcccctgccccgtttcaaaaatatttgttcctgctccacgtcggcgaccatatttacggcggtttggaacacaccgacagcaccgccctgctcgccgaccgccacagccttccgccgtacggtatgaccgatgccgacgatacctacaccacattgctcggacttttctcccacgaatattttcacgcgtggaacgtcaaatccatcaaacctgccgcgttcgtcccttatgacctcgacaaagaaaactataccgaacaactatgggcattcgaaggtattacatcctattacgacgatttgtttttggcacgcagccgcaccatctcgcccgaatcttatttaaacctgctggcacaaggcattacgcgcgtacaacaaacccgcggccgtttgaggcagaccttggcggaatcgagttttaccgcgtggaacaaattttacaaaccggatgaaaacagccccaacgccatcgtcagctactaccagaaaggcgcgcttgccgcattgtgccttgatctgataatacgcaaccgaagcaacggcagacattctctcgatacgttaatggacaaactctatcgggagtggagggacacacactcgggtattccggaaaaacactggcaaatccgctgtcaggaaattaccggcttggatttggaagattttttccaaaaagcgttatacagtaccgaagatttgccgcttgccgaatgcctggcaaccgcaggcgtgggactgaccttcctgccgcttccccgacaacacggcggcggatacgcagaacacatctgccccgtcccgtcggcaggcgattttggcgcacgtttcaaacaaaacaccgaccacatcgtcctgacccatgtcttcaacggcggcagcgcggaatctgcggcactgtgcccgcaagacaaaatcattgctttagacggttatgcctgcaccgactttaccgcacaatgggcccgataccacgtcaatgcaaaaatcaatatccacttcttccgtgccggcatattgcgtcaaaccgtcttgacggttcaggcagcggcagcggatactgccatcctacatatcacagaccggaacctgttggacaactggttgttcggttaaactttcagacggcattgcacacaaaatgccgtctgaaaaacaaccgcaaagtaaaggaaacaaaatggccattctgaaacttgacgaacacctctatatttctccgcaactgaccaaagccgatgcggaacaaatcgcgcaactgggcatcaaaaccgtcatctgcaaccgccccgaccgcgaagaagaatcgcaacccgacttcgcccaaatcaaacagtggctggaacaagcaggcgttactggattccatcaccaacccgttaccgcacgcgacatccaaaaacacgatgtcgaaaccttccgccaactcatcggacaagccgaatatcccgtccttgcctattgccggaccggtacgcgctgctccctcctgtggggcttccgccgggcggcagaaggtatgccggttgacgaaatcatccgccgcgcccaagcggcaggcgtaaatttggaaaacttcagagagcggctggacaacgcccgcgtctgattacaagccgaaacgtttaaaccacaccttcaagcggcattccaccgcaacttgaaaaagaggacggcaaaccttactgccgtcctctgtccttctccgtttttacagtgggagacctttgcaaaaatagtctgttaacgaaatttgacgcataaaaatgcgccaaaaaattttcaattgcctaaaaccttcctaatattgagcaaaaagtaggaaaaatcagaaaagttttgcattttgaaaatgagattgagcataaaattttagtaacctatgttattgcaaaggtctcagtgggtatagcggattaacaaaaaccagtacggcgttgcctcgccttaactcaaagagaacgattctctaaggtgctgaagcaccaagtgaatcggttccgtactatttgtactgtctacggcttcgttgccttgtcctgatttttgttaatccactataaaaattagaaatgcacattttcattattctcgcgcaggcaggactccagacttacccatttcagtaatgtttgaaaataaaagaaaaatcagatgtttgtattcccgcctgcgcagaaatggagacggtgctctgtcgtctcatttttgttttaatcaactatatatagctgattaaacataagaaatgccgtctgaaagactttcagacggcattcgttcaagcgtcgaactttattgcgccttggtttcggttacaaaaccgattttggtgattcctgcctgacgggcggcttctaaagctttgtttacataatcgtattccaccgccttgtctgccgcaatcgccacaatcacgttttcattctgctccttggcggctttcagacggctttccacttccccgatttccactttgcttgcagaatccccgccgacataatagccgccgttcgcatcaatcgtcaggcgcagggggtctttaggctgtttgtcctgcttgtttgtctgctcggacgcggtcggcagttccaaagggatggaatgcgtcagcaccggcatagtaatcataaacacaatcagcaacaccagcatcacgtccaccaacggcgtaacgttgatgtcggacatcggagaatcgtcgccggaattcatcgaaccaaatgccataatcagctatccttttgattaagcaggcggacgtgcaaatcgtgcgccatcgcatccaaatcctgggtcagtatttttgtgccgcgattgaggaagttgtatgccaacaccgccggaatcgccacgaacaaacccgccgccgtcgccaccagtgcctcgccaatcgggccggcaaccgccgcaatactcatctgcccgctttgcccgatattgatcagggcgtggtaaatcccccaaaccgtgccgaacagcccgataaacggcgcggtcgcgccgatggaggcaagcgcggtcatcccgtaatcaaaccggcgcataatctgcgccatactgttgcggatttgaatgaccaaatactcgttcaacggcaaagcctgcgccagttcggacgcttcgtttcggcggtagttgcggtaagactgcaatgcctcttgcgccagtttggacaaaggcgcatcgacggcgcgcactttttcgaccgcgtcgttcagcgacaaagtatcgcgcatatgccgtttgacggcggcattccctttgcgcgcccgatacagcttgatgcagcgcaagacaaccaaacaccacgttacgatactcatcaacagcatcaacacaaacacaccaatcaggacgggatcgcccgattcaaacactaatttcaaattcataatgattccaacactgaaaaaaccaatcaaacatccaagctgccgcaaaccgctgcggcaaccgcctaattcaattcaaacttgacggggactttaaactccgtccaggcattggcttgaaaatgcccgttttgcgccgccttgcgtgccgcattgtccaaccgggaaaaaccactgcttttcacgattttaacggactcaacatgaccgcccggagaaaccaaaacgctcaaaacaaccgtaccctgctcgtcattctccatagaaagcgtgggataagccgggcgcggaatgctgccgttggcgcgtaaaggattgcctttgctgctgccggctccttccccgtgttcgcctttgacaccgccgctacctttaccgctgccttctccgcgccccgttccgtctcctttggtaccagttcccttatcttccccattgccctgctcgctgtctgctttggcagaagcattgccgggatgttcggcaggtttttcagacggcttctcgaccggtttttccgccggtttcgggacaggcttcgcttccggcttaggctctggtttcggtttttcttcgggtttcggcttttcttcaggtttcggctcttccttaggctgctgaatatccgcatccgcctttttcgtaaccaccggcttcaaaaccggcttgggcggctcgacaggtttgggcggctcgggcacgggttgcggttcgggcgcagcaggcgcgcctgcaccttcgggggcgccgtcccctccgccaaaatcgcccaaatcgacaaattcaataacattgcctgactctatcacgggcagcttgtgcgcctgccagagcaatgccaccattgccaaatgcagcagtgcgacggaaaacacgactgcgggggttaaaattcgttctttatccataattcgggcataataatagcaacaattcctatttgcaacctatttttacaatttttggtcatatgaatgtctgttccgttcacaggcaaaccgtgtttaaacgctgtattacagcaaatcatcagataacgggccggcagaaaaaatgattccgtctgatttcttattccaataaaatcaggttagatgatatattgccgcttctgtctgtcagccgtttcgggctgcacaccacatctgttcaaaggaaaaccatgtttcaaaattttgatttgggcgtgtttctgcttgccgtcctgcccgtgctgctctccattaccgtcagggaggtggcgcgcggctatacggcgcgctactggggagacaacactgccgaacaatacggcaggctgacactgaaccccctgccccatatcgatttggtcggcacaatcatcgtaccgctgcttactttgatgttcacgcccttcctgttcggctgggcgcgtccgattcctatcgattcgcgcaacttccgcaacccgcgccttgcctggcgttgcgttgccgcgtccggcccgctgtcgaatctagcgatggctgttctgtggggcgtggttttggtgctgactccgtatgtcggcggggcgtatcagatgccgttggctcaaatggcaaactacggtattctgatcaatgcgattctgttcgcgctcaacatcatccccatcctgccttgggacggcggcattttcatcgacaccttcctgtcggcgaaatattcgcaagcgttccgcaaaatcgaaccttatgggacgtggattatcctactgctgatgctgaccggggttttgggtgcgtttattgcaccgattgtgcggctggtgattgcgtttgtgcagatgttcgtctgactggctttcagacggcataaacgctccagaaaacgcggcaggacatattgccctgccgcgttttcctgtagtgtaatcttatttttttcatcattattagaaccaggttgcatgataatacctttcattaactgaaacactgattaagaaactccagtctgtctaatgatgaggttttcacatcgccaaaacttgccaatcaaatgctggatttattgccgtctgagatttggtcaaatccaaaggcgacattcttagaccctgtgtgtaaatcaggggtatttttgcgtgaaatcgtcaaacgcttggatgaaggcttgaccaatcaaataccagataaacaaactcgcattaaccacattttaaaaaatcaagtttttggaagtactgccacgtatgtaggtagctttgaccgatatttgcataaaaactcctttgctggtgaaaggaattattttgccaattttaaaatatttctggcaccaaatagtacaatgacaaagacaatcatgccaatgattaaatcaggatagctagaatgagtcaataacgtcaatgctcccgccgctatcacaccgatattgatgataatgtcattggatgtaaaaatcatgctggctttgatatggatttctttattttgatttttgctcagtagatataagcacagccagtttgcaatcaatgccaaaaatgccgtgccaatcatcagttgataattgggcagctgctcagcaccgataaaacgcctaatcacttctatcaccccaaataacgccaatattatctgcgttatccccgccaaaaatgccacacgttttttatacgccagcgtcataccaatggctgatagcgccaatatatagacaaagctgtccgccagcatatctagactatcagcaatcagccccatagaattagcaaaaataccaaccgaacactctatgataaaaaacacaaagttaatcatgagcacttgatataataatcttttttctaagtgctcatcaggcttgttaaacactatcttatcaacaatcacttcggtggaaatgatatgactatcaaaattaagcggttcaagtacttgtaaaatcgttgtatcttgattatcgtgatagacggttaagcaccgcccagcaatatcaaactgtaattcataaatatcagacacatcttttaaacgcatgcgaatgagctgttcttcggacgggcagtccattttggtaatgttaaaaatggtctttttcatctatttagttccttgttttgatcaggttggctcaaataaatctgtgtttatattgctgcttggtaatttttggatggtttgagtaaattgattaggttaaaatttacctttggaagtaccgccacgcataatagtttagatatgtttataatctctggataaaaaaacgtaataagtgcttactggataacaaagtccaaaccaatagcaggcaaaataaggcatccaccccccttcttcattaaggatatatattgagaaacaaatcgcaactaaacagaaaaaacttgggagataaagccatttcattcccctattcaagaatctagccaagataggtattttgtattctacaaaaaagaaaggcatttccaagggaaacatgtcagataaaaacttttgtttattttttactatagatagaaccttgcttctcaagagaaagccattaataataccgatgacagctattaatatatagagaatagtataagtatgaataatcttcattagacaaaaagaagaaatggcagataaattacatacgatatattggaatataaaatatttacggtctaaaccttgttcagttgcaatttttttaaaattgccttgcataaaaaaatcaaaggcgtccattaaactatctttcacattagaaatttaaaagctaaataatacgacaaacaatgtgaagtactattcatggtttatttaaaaaataatactattctgaacattatttagatacagaaattaacaaattagaactaaacaagcttttaaatactttaattttattggaaagctataaaaggaactataactttacacactagtcacttctttttaagaggcaaaagggattgggaaggtcgtcttggagataagcactggtatttcggccaatggtaaatagagtttacctcaaatagggtagaacctccttcatctgtcagttaataacagccacttttacaatgccctgtcaaaataaagcggcacgcccgatttttcactcatcgtcatcaaataacccatcaccttttggggccattcgatgccgcgcaccacggtcagattcctcaaaacggggaaaaccaaaatatcctccataccgattccgccgttgatgccgtctgaagcaccgtccatcaaattttccaactcttgcaaatctgcgtttatccgttcgaggtattgggcggttttattcaaattggcggaaaagctgccgatgcttttctcttttttgtctgtaaaatatttcaccgcttccggcgttgcaaattcaggcagcccgattttgatcacgcgcggctgcaccagtttgtcgttgtatccgcccaccttgtccagccacgcccgtatctcggggcggacttcgtctttcagacggtcttcgcggtcgaaatgccgcacaatgtccaaactctcgcccataaacgaaccgtcttctttttgcaggacgggcacttgtttcgcaccgatcataccgatcggcgttgcctcgtcgtcgtttgccagcacggcttcttcaacgtccgcgccaaacagcccggcagccatccgcgcacgcacgcaaaacgggcaatggtcgtaaatatacagtttcatcaaaatattcctcgtcaacctgtcggtaccgactaccttaacaccccgcgccgcccgaaacaagtttatcttcccgcctatgcaccgtaaataaataagctgttacaataaactcgtttttatcggaacggaagaccccatcatgaccgccatcagcccgattcaagacacgcaaagcgcgactctgcaagaattgcgcgaatggttcgacagctactgcgccgctctgccggacaacgataaaaacctcatcggtaccgcatggttgctggcgcaggaacattaccccgccgatgccgccacgccgtatggcgagccgctgcccgaccacttcctcggcgcggcgcaaatggttcatgaactcgacctgctccccgatgccgtcgccgccaccctgcttgccgacatcggacgctacgtccccgactggaacctattggtttccgaacgctgcaacagtaccgtcgccgagctggtcaaaggtgtggacgaagtgcagaaactcacccacttcgcccgggtggacagcctcgccacgccggaagaacgcgcccagcaggcagaaactatgcggaaaatgctgctggcgatggttaccgacatccgcgtcgtgttaatcaaactggcgatgcgtacgcgcaccctgcaatttttaagcaacgcccccgacagccccgaaaaacgcgccgtcgccaaagaaaccctcgacatcttcgccccgctcgccaaccgtttgggcgtgtggcagctcaaatggcagctcgaagatttgggcttccgccatcaaaagcccgaaaaataccgcgaaatcgcgctgcttttggacgaaaaacgcaccgaacgcctcgaatacatcgaaaacttcctcaacatcctgcgcggtgaactcaagaaatacaatgtccatttcgaagtcgccggccgcccgaaacacatctactccatttacaaaaaaatggtgaagaaaaaactcagcttcgacggcctctttgacatccgcgccgtgcgaattctggttgataccgtccccgagtgttacaccacgctgggtatcgtccacagcctctggcagcccattcccggcgagttcgacgactacatcgccaatcccaaaggcaacggctataaaagtttgcacaccgtcatcgtcggcccggaagacaaaggcgtggaagtacaaatccgcaccttcgatatgcaccaattcaacgaattcggtgtcgccgcccactggcgttacaaagagggcggcaagggcgattccgcctacgaacagaaaatcgcctggttgcgccaactcttggactggcgcgaaaacatggcggaaagcggcaaggaagacctcgccgccgccttcaaaaccgagcttttcaacgacacgatttatgttttgaccccgcacggcaaagtcctctccctgcccacgggcgcgacccccatcgacttcgcctacgccctgcacagcagcatcggcgaccgttgccgcggtgcgaaagtcgaagggcagattgtgccgctgtccaccccgctcgaaaacggacagcgcgtcgaaatcattaccgccaaagaagggcatccttccgtcaactggctttacgaaggctgggtcaaatccaacaaggcaatcggcaaaatccgcgcctacatccgccagcaaaacgccgacaccgtgcgcgaagaaggccgcgtccaactcgacaaacagcttgccaaactcacgcccaaacccaacctgcaagagcttgccgaaaatctcggctacaaaaagccagaagacctctacaccgccgtcggacaaggcgaaatttccaaccgcgccatccaaaaagcctgcggcacgctgaacgaaccgccgcccgtacccgtcagcgaaaccaccatcgtcaaacagtccaaaatcaaaaaaggcggcaaaaacggcgtgctcatcgacggcgaagacggtctgatgaccacgcttgccaaatgctgcaaacccgcgccgcccgacgatattatcggcttcgttacccgcgagcgcggcatttcagtgcaccgcaaaacctgcccgtctttccaacacctcgccgaacacgcgcccgaaaaagtgctggacgcaagctgggcggcattgcaggaaggacaagtattcgccgtcgatatcgaaatccgcgcccaagaccgctccgggcttttgcgcgacgtatccgacgcgctcgcccgccacaaactcaacgttaccgccgtgcaaacccagtcccgcgacttggaagccagcatgaggttcacgctcgaagtcaaacaagtcaacgacctcccgcgcgtcctcgccagcctcggcgacgtcaaaggcgtattgagcgttacccggctttaaatacaaaaatgccgtctgaaagccgaataacgcttcagacggcattttgattgccggggtttgctattttttgttgcatagtcaattaaaaacaaaatagtacaatactcaactttgaaggtctaaccatggcatactctgcggacttaagaaacaaagctttaaactatagtggattaacaaaaatcaggacaaggcgacgaagccgcagacagtacaaatagtacggcaaggcgaggcaacaccgtactggtttaaatttaatccactatattacgaacaatgcaaaaacatcagccaaaccgcagcaacgtttaacttgtcaagaaacacactttacctgtggattcgccttaaaaaacaaacaggcagcctaaaacatcaagttaccggtctaaatgccgtcaaatcggataggcaaaaaccggctcaatatgttgggcaacaccaggatgcctatctgcatgaaatcgccaaacattttgattgtacggcagccaccgtttgctatgcactcaaacagatggggataacgcgcaaaaaaagaccaccacttacaaagaacaagacccggccaaagtaacgcattatttgacacagccggccgaattttctgactaccaacgcgtttatttggatgaaacaggatttgaccgccacctgttccgtccctatgcccgcagcctgaaagggcaaatagtgaaagcgcagataagtggaaaaagataccgacgcttatctctggtgtccgcacaagtcggcaaccggctgattgctccgatggtttatcaaaatacgatgaccggagtcttttttgaagcgtggtttcagcaatgcctactgcccgcattgactcaaaaatcggtgattattttagataatgcacgatttcaccgtatgggtgtcttacgggaaatggcggaaaaattgggacataaggtattgcctcttgcaccttattcacctgagctcaacccgattgagaaggtttgggcgaatattaagcggtatctgcgaaccgtattgtctgattacgcccgatttaacgatgcactactgtcctattttgattttaattgaatatacatttgaattaattcgcacttaatttaaatgtgtttttaactgtgctttatttaaaggcaatgagaatgtgaaaatatcggatcaatcccaaagcagcctgcactttcgaaacggggtgcaggctgctttgggaatttcataaccgtttcagcctgctttattccgcaaataccgtttccaaccctaacccgctctctttcaccaagcgcaaataagccagcatgaatttataccgtgcttgagccagtttctgttctgcttgggcgacttcctgccgcgcccgtattacttccagccggttgcggatgccgtattgttggccggtttcggtcgatttcagtttcaaacggctgctttccaaaacccgttcttgcgccatgatttggtaacgcgccgcaccgctttcggtataagcctggcgtacggcgagtttgatgtgccgctcggttgcggtcagctgtgcttcggcggccccgtattgcgcttcggcttcatggattttgcccgacaattctccgccggtataaagcggcaaattcaactgtacgccgacgctcatccctttgccccgatagtggtagtcattattctgcgcagatgaagtgtagaggttattctgatagccgacatgggcagaaacggtgggatagcggctgttctgtgctgcccgaagcgcctgtccgctgctttgcagggcaagctgctgcatccggtattcatgattgttggataaggcaatgcgctgccattcatccagactgtaacgttccagcttgggcagatagcgtgccaacaggttggcggtatctatggcctcgatttgtttgctatccaggtcggtgtagtcgttcaactggttttcataggtttgtttctcagccaatacggcgatttcttgggccagggcattgtcgtaaccggctttggcttcgtgaatatccagcgcggtggcagcacctttattgaataaagcctgcgcctgccttacctgctgggcataagcctctttttccgccgcatgggcggcaacggtgtctcggctgagtaaaacgttgaaataactttcggcaactttcaacagcaattcttcgcgtgccgcatcgaaacgctgttctgcagcctgcgtatcgaacctgctttggcggtattgtgcaaatttggcagcgtcaaataaggtttgtcccacctgcacgctccatccctgtgtttcgcgggtggaagaaatcgatggcggctggcgctggtagctggcattggcggatacatggggaaggaatgcggccttggcttgttgttgccgtgcgcgcactgcatcacgctggtaatgggacgcttgaaaatcagccgaatgttgctgcgccgcccgccatgcttcaggcagcgtaaaagccgaaacggatggggaaagggatagtggcaaggtaaaaagtgaaacgggtaggatatatttggaaaaataggatttcatagccgaaaatagttcatgttgcaaatagggcgtcagtgtcaggcaaacggaaataccgtaatcttgcattatcattagattgagcaatgtcatccgggcaatggtttcaggcagtctgcatgtccgaaccggcggataacaaatgcccagtacggatccgcctatcgctccctaaagctttcgtccaatttggtttgcagcgggcttaacagataatccagcacccgccgtttacccgttttaatctccgccgtgacattcatgcccgccgtcagattcactgctttgccgtcaatattcaaggtatgtttgtccagcgacaccaccgccgtataaaccaagcccaactgttcgtggcttaccgcatcatggctgacacttttcaccttgcccgtcagataaccgtagcgcgtatagggaaagctctcaatcttcaccaccgcatcctgtccctgttccacaaaaccgatgtctttgttcaataccaaaacttccacgtccattttgtcgtcatcgggcgcaatcaccatcattttttgggcagcctgcaccacaccgcccaccgtataggtagccaattcctgcaccgtgccgtccgcaggcgactgtattgtcatcagctgctgccgctgctttgccttatccgtttggccgcggtattggtcaatctgttcgtttgcctggcgcagcgcatccagcgtatcgcgtttcaggttctgcgtattcagcacccgattctgctccgcctgtgcaatggccgcctgaatctgcctcatctgaccgcgcgtactttccaaatcgttccaattgctgaccgatttgctctgctgctccaaaaacgcatgttccgaaataaaattgtcggcccgcaaacggcggtagtctgctgttttctgctgctcgatcgcccccaccgaaaccagcttctgctcctgcgccttggccgactgcaattccgcctgatggccgcgcaaagccgactgcaattgcgcatcctgcgccgcccatgcctgatactggtgctgcgccaacacctgcgccgattgcacatcggcatcggagagacctaaagaccgtgcttgcgccatatcgatatgcggcacggtacggctttccaatgccgccaataccgcttcataacgcagtttggacaattgggcagcctgcaaagcctgctccgactgcaccacatcgctgtctgttcccacagcctccagttccgccagcgtttctccctgtttcacatgctgcccgtcgcgcacatgtaccgccttaaccaccgccgtttccagcggctggatggttttgctgcgcccgcccgacaccgttttgcccgaagccgccgccacaatatcgattttgccgaaccaggaccacaacaaagccaaaagcgcaaacgccataataaaacgcgccgcccatttcggagcggcagagaccggcgtatcggtcagttccaaatgcgcgggcaaaaacgcctgttcttccgccgtgcgtttgggcggtttcaactggtcgcgcaccgcccaaacattgcgccatacagtaatgtatcgagaaagaaaggatttcagggcggagaaaaacataacgggtataaccttggcaatatagaaacaggaaacaatataaatatgtaaaggaattttaacggaaagcgcggcagctgttaagggaaaggcgggaatattgacaaaaaatacccaagtcgttacaaatattcattattttactgcgtaacgcaacgctgaagcgcaggctgcttttgagatgcggcaaggttcggcaaaaagcagcctgcacatttaaccacaggaacaacccatgtttaccacaaacgatttacgccatttcctagaaggtttggccatcctattctcaatcggctattggggcaccatgctgctgttgctttggtttctcgtccgctttgcctataaaaagcccaaacggaaccccggcaaaatcctttcaggcagcctgaccgccgccgctatcctgatgctgtttgtttggattattcccaaacaattcggcccgatcaaagaagaaatacaggcacaagaagagtgggacagaaaatacaaagaagccgaagccgtgtttaacgaacaatgcaaaacggcgggggaaagatttaccagacggcggacaatgtggaagggattatgctgttgaaggtagtacctgagcgtaccgtttcggcagatgcaaaaaccagagacccgatgtgggacaatgcggctttacagaccagcgaaggcgtaaattttattgctcgtttcctaggattttttagcgatggggaataccgctatgtggatgtcctgcaacccaaccattccgatattattcggtattcaggtaaagatttttccgctaaatcaaatatttaatcatatacaccccgcccgttatgcggtaacgttcgaaaacaatgtcgattccaagctgcgcaggcactgggtggcaggtgcgaccatacggattatcgaccgccaaactgacgaagtgattgccaagaaaaccatctatgtctttgaaaaaggcttggacggcacgggtggggcgagaatgccgtggaagtttgctatcttgtgcaataaagaaagacttacttcttcagagccgttatcggattttgttcttagcgttttaaaaccttatatattgcgtcccttatatattgcgtccctaagaagggacgattaacaaaaattaacgtcctttactttctacaagtaacagggcttttttttgcccgtttttgaggattcgcaccatggaagataagcaagggatgacaaaggcggttgccggcgtgatgacggacgcgctagcggacggcaggaagccgacaaccgcttcaaatcttccccccttatctaacagggggggacagaaaccgaaacggcaggcagggttcaggaagtcttcgaatgttacgaaacgtacataacggacggtaaaggaaacctgttaggcgttcctcttcggcgcggtgtatcagattcggctttcattgatcaaattagcttttcatttcatgaaaaaacctttttcgataaatacggcgttcgtgtaagtcttttggaagacgaagattttattcgcgccgcgtccatgctcgccgaagaagttttcggtttcggtatctacaaagaatccaaaggttcgggcggtcgtttctatgagcgctgttggttgatgggttcggaagacgccctatacggtcgcgtccattttggcggccaacaaaataccattcttttcgaactgaccggcaccggttgcggcgtcgcaaaagaaggctgggaatcacgacttttcgcattcctgactaatgcaatccgcccaaaaatcacacgcgttgacatcgcaaaagactttttcaacggcgaatacagcccgaaccaagcccgtgaagaccgaaataaaggtatgtttacctgtcatcacgtcaaaccaaaaggcgaatgtttggggtcagattgggaagaagacgatgaagccaaaatgaccaaaggcaagacctatggtatcggctcccgtgaatcgtccaaatatgtccgcgtctatgaaaaaggcaagcagttgggcgataaaacaagcacatggacgcgatttgaaattgaattcaaagcaaaagacatcgttatccctttcgaagttttgcagaatccgggcgaatatttcggcggcgcatatccgatttgcgaacgattcgcccaaaaggcaacgcgcatacacgcggttaaggaagataaggtcatttcagccgaccgctaccttgaatgggtaaaaaaacagttcggacgtgcggcaaacggtctgaaattcatttttcccgaattggacaaagccaaactgtttgaactgattgagccgagtcatcacaagctgcccaagtctttggctcccgaagcctacgactgcgcctttttgaaagctcaagccattcatgaacagcccgcattcaaaccgtacaaagacccttactatatgtacgaatattacgagaatcttgaaaaacagcttgaacagcaaaaacacgtcaacaatgaagaaagctataacaacttcatttacgacaaattcgcaagactaccgatttcatgggcttaaagtgtctgcccgaaagacgtttaatcacacaaggaaaccaaaaaatgaacatccaacttcaaggccacatcgtcggcgttaaaaaaatcaacggacaaatcgaaggcaagagcttcgactattgctgcctgattgtcgccacacccttagacagctcccaaggcaacgcattgggcagctctactactgaatacgatttcggcggctctgccaatttcgagcagttccgaaacgcccaatttccgatcgaagcaaacctgaacgtagaaatcgtcactacgggcaaaacccaaaaactgaaagtcatcggttttcaactcgtgaagaaaggctgattgaatgcagaaagtctatgttgtccagtccgtatcaacaggggactttctgtatctctctcctgaaacgggcgacatcggacataccaaattaatcaccaatgccgattatttctacgacttcgaagaagcgattaacgcaggtttggaagaaatcggcaaccaatacgaatttgtcgtattcggatttttgaaagactgattttcggatgttcggcggtcgtctgaaaaacgctccatccattaccgccaaacactttttgaaggaaaatatcatgaaatttattaacacctgccgtaaatacggcgcaaaactggctgttgtaacagctgctcccctggctttggccgcacatgcaaatgcaacgttgcccgatacggcaaaaaacgctttggaagccgcaaaagcggacggtatggaagccggttggattgtagtgggcattttcgccgcgctttttgtattttccatcgttaagagagtgatgaagtaagacggcatgtactaccaagtcggaaataaatgtcttgagaagcaccaggctgaaaacctttatttcagcttggtagtaccaagaatcaaagaaaacggacagattgtcaggccggaatataacggcagcctgtggaagatgtcggacggtcagccgctaaggcttttattggcggaatgcagtccgaaagacaacctgcaaagcggtcttgaaacaggctggatagtattcggcatcctcgcgtccgtttactttgtttccctgctgaaaaaggttttgaaatgatggatttttatttttatctcggcgtttccgtacccgtattaatcggggcggttctgtttaagaattgagcgcatgaagttatggtgtcaaaatcaggcttttaattagacatttgaggcttgaaaccatgaataaaaatgaacgtgactttttctatatatcaaattctgatttagataaattgtcagaatcttatcctgataggcctctttcttatgtgttttattgttatttgaaagaaactggtctattgaaaaatttctcaatggataaatgtcataatttttttaatagaattaattttaatgaatcttgctttgaaattaaattcaaggatgattcatttttcattattggcaatggaaaaattgatgtttcggattctaataatttcttttctgtttcttttgagtgctaaatctttttcagcagatttagaaattaaaaatgggaaattgatgtatgcactttcggaaaaatataacgataatggatttaaggcatacaaagttttaggtgagggaggaggaattcatacagaatataattacaaatttgataaaagtttgaatttgaatgtattagaaagttcaacaggcgcacgctctcttgaaaaagtccccgttaaagtaactgcatcagtttcccgcgccgccgtcttgtcaggagtcggcaaacttgcccgcttaggcgcgaaattaagcacaagggcagttccttatgtcggaacagcccttttagcccatgacgtatacgaaactttcaaagaagacatacaggcacaaggctaccaatacgaccccgaaaccgacaaatttgtaaaaggctacgaatatagtaattgcctttggtacgaagacaaaagacgtattaatagaacctatggctgctacggcgttgacagttcgattatgcgccttatgtccgatgacagcagattccccgaagtcaaagaattgatggaaagccaaatgtataggctggcacgtccgttttggaattggcataaagaagaactgaataaattaagttctttggattggaataattttgttttaaatcgttgcacatttaattggaatggcggagattgtttggtcaataaaggtgatgatttcagaaatggggctgatttttcccttattcgcaattcaaaatacaaagaagaaatggatgccaaaaagctggaagagattttatcgttgaaagtcgatgccaatcccgacaaatacataaaggcaaccggttatcccggttattccgaaaaagtagaagtcgcacccggaacaaaagtgaatatgggtcccgtcacggacaggaacgggaatcccgttcaggttgtcgcaacattcggcagggattcgcaaggcaacaccacggtggatgttcaagtaatcccgcgtcccgacttgacccccggaagcgcggaagcaccgaacgcacagccgctgcccgaagtatcgcccgccgaaaaccccgcaaacaacccgaaccccaatgagaaccccggcacgagccccaatcccgaacccgaccccgatttgaatcccgatgcaaatcccgatacggacggacagcccggcacaagacccgattcccccgccgttccggaccgcccaaacggtaggcatcgcaaagaaaggaaagaaggcgaagacggcgggcttttgtgcgattattttccggaaatcctagcctgtcaggagatgggcaaaccttcagacggcatgtttcacgatataagcataccgcaggttatagacgataaaacatggtcttcacataactttttaccgtctaacggcgtatgtccgcagccgaaaacctttcatgttttcggtaggcaatatcaggcaagctatgagccgttatgcgtgtttgccgaaaaaatccgttttgccgtactgctcgcctttatcattatgtcggcttttgtcgttttcggttcgttgaaggggaaataaatgccattacttgccggtctgattccacttttaggcatacttctgaaaatgctgattgtcagaataatccttgcaacaggtctgacatttgtaacctatgccgggtatctcatcgcgctggaaaagttcaaagactacacgtcaaatgcgatcaattccatgccttccgacatactgaaccttcttttaatttcgggattcggtcaggggttgggctacctgttcggcgcattctcgttcttcattggtatgcacgcattcaaaaaactgacgtttgtctttccaggatgaggtagaagcatgatttatctgtttacaggaaacatggggacaggcaaaacctcccgcgtcgtctctatgattttgaacaacgaagacggattgttcaaaatgaaattggaagacggcacagaggtagacagaccgctttatttctgccatatcgacggattggataaacggcagtttaaagcccacgaactgacggaagagcaaatcatgtccgccccgcttcgtgatgtcataccggaaggcgcagtgctgattgttgacgaagcgcactacacttatccggtacgcgcggcaggccgtcccgttccgccttatattcaggaactgacagaactccgccatcacgggcataccgttattttgatgacgcagcacccgagccaacttgatatattcgtccgcaaccttgtttcaaagcatgtacaccttgaacgcaaggcaatcggaatgaaacagtattattggtataaatgcgtaacctcgttggacaatcccgcaggcgtaagcggcgtagaagtcgcaagttggaaaccgccgaaagaagcctttaaatactataaatcagcaagccagcaccaaaagttcaagaaaaaagtaccttgggcggtttgggcgttgattgcgattgtagggtttgtaggctggaaaagttacggcatttttaaagtttacagcaaagccacagacagccggattgagcaggaagcgcaaaaagaaagcgttgtgcagacgatgacggagcagcctgcatcatcagaggaaatgcctttaaaaaattcagacaatttgaaacctgaagactttgtgccgactttacccgaaaagcccgaaagcaagcctatttataacacagtccgacaagtaaaaacctttgagcaaatcgccggatgtatagacggcggaaaatcagattgcacatgctattcaaatcaaggaacacccttgaaagaaataacaaagataatgtgtaaagaatatgtgaaaaacgggttgcctttcaatccttataaggacgaacagcaaaggacggaacaggtggaacagtccgcgaaagcggacaagccgcaagttctcgtaatgggcggaaagccgtagcaaaatctcatgtacgacaactgaagagcgcggaaaaccgtttgaaggaattggcggcggagtcgtaaagcagaaagttcaatccctacccctcaggatggcttgagctgagtgaagggggttaattgctagaatggctgttttttttaaagtgtctcagtctggaatcgcttcgttcgggggttgtaggtgcaggaaaatagggcagaaaaaaggaaaagggggaagctttgtaaagattgggcgcgctttttacccaatctttatgaatacccccttttccttttttatgaactgtttttcaataccggaaacccccgaacggagtgattccagactgagatacgcccaaaaaaaatcagacattcgggtcgcaacagaaacctttaccaaaacctgcgaccccaataaaatcagatacggcaaaggcgataagcttcaagccctgaatgagtaaatcagcccattgagggcttggcgtttgacgaaacaccaagtaaagcccacgacttcgaaagtacggccaaagcgtacagcttgtaagaaagatagaagcgtgggctttcgtacatcttaagtttgaacactatctagggcaaaaagcccgaattaataaggttaaaccatgtacttaggaatagacgtttcaaagctcacaatagattgctgtttgattgtagacggtcaaaattatcaaaagaagtttcagaacaacaaaggaggatttgaacaattaataaattggctacaaagtcataaagtaaacgataagctccattgcgtgtgcgaagcaacaggcacatattacgaagcattagccgaatatctttattcaagatatacaattaccgtagagaatccacgaaagataaaaggatatgcgatagcagaactacaacgatcaaaaacagatacacaagacgcaaagttgatagcccaatattgccaagaccgaaagcacaaattaaaagcatggaaaccgccgacaaaagaacagaagcaattacaggaaatcgcccgatatttagactatctgaaacagcaacgcgcaacagaaaaagctaaacaacacgaagcacccgactatatcaaatcccatattcaaacaactatttcaaacctgacagcacaaatacagatagtcaaaaagcaattactccagttctacaaagacaatccaagttataacaatctacgcaaaaggctgaaaacaataacaggcataggcgagcaagcgacagcagtattgctatcaacctataaaagacatgaatttaaaaatgcaagacagttcacggcttatctaggcctagaccctagaaaatttcaatcaggaacaagcgtgaacggaaaaagcagaatatcaaaaataggaagttcggaaataaggaaaagcctttatatgcctgcacttgttgcatatcgttgtaatgccttccctgaatttgtagggcgtctgaaaaataaagggaagcatataaaattgatattaattgccatcatgcggaaactggcggtaatagcgtttacgattttgcaaaacggccaagatttccaagtggaaagatataaataaaaaattaaactgggctttcgccggtgattttcaatttattgaaaataaagtataaattaaaacatcaaatccattcaaaacgaaacaaacatcccgaaaaagtcggggtgcgcattcttgcaacttcaagaaatgtaaagttatttgaccgtgaaatacactatctttttttcaacaagccaccacagcaatcagacaaaagcaacccaccgccacacccatgtcggcagtacggccggacaaaccaccatccgaagcggcggggataccaccctcaaaggtgctcagcttatcggcataggcatacaggcagacccccaactacaaccctgacgactattggtggaaccgatattaactgacccccaaaagttggacagtttaatcaagcggctttcagggactgaattctgtactgaacagggctcagtccttttaatttcaacttgattctatcgttgttgtagtaacggatatattcgtgcagtacagcttccaattcggtaacggaatcatatttgcacgtatggaaacattccgatttcaacgttccgaagaaactttccattgccgcattgtccaagcagtttcccttgcgggacatactctgaaccagaccgttgtctttcaactgcttttgataaatatcatggatatgccgtttcaaatcggcatatttgtcttctgccgattggacaaccaattggtaatagaaggtgccgcgtggcagtccgacaatcaccaacagcagttcaacggatggcattgccttaaccctgcgacgagttgcgttctttctaccgcacttctttcccatagattaaggcatcgagcttttttagggcagccatttccgctttaaggcaagccaattccgcaagcagttcttccttggttttcagatagtcggctttttcgtttccggcggatgctgttttttcacgggctttcttcctttgggtttagggtttgggctttaaaccgttaataccattcaaatggtagaggcgcaaccattgcagcaagatggagcagtcgggcaaattcagttggtctgcggcagctttttgggacattccctaccccgccaccaggcggattgcctcaagtttgtattcgaccgaatattttgtcgtatgctttctacgtttgatgccactctctccgtgtaatctgtattttgtcacccatctgcgtaccaatgaatcggaaatagaaagatggtctgctgttccctgccaaatagtattgaacgacggcaagtcggaattcatctgaatattttgccataaaaaactgcaccccctaaagtcggtaaggtgtccaacttttgggatgcagttcagaagcggtctttttttgcctgccggttttgaatcatcctccgtgtatattcccttgacgaaaaaaatgatgatattacggataccaaaactaaggtcgtatccgcccccctactctccctaagcaaagagatgaaacagcgtatcggctccctgccggttgaattttccgaaaaaacgcgacgtaaccagcatcaacatatataagaacagcacaaatagcatcaatacatcaggcaacgaaaatgcagaataatgcacttaatggtgtttggatatctgttgttttgtgctgttagtaattcttctttctgtgtttacagtttagcagttgtacagttttacagtaatgtttaaacaatgactgatttattttaaatgcagatattgtagaggataaaaatggccaaagtcctttcagtaacatttttgattttttagcgagccttctcatttccccggcgagatcggcaatggcagcggtactttggccgccgatatgcttaagttcagtaaccttacgccaccaaaacccttgctagctaagggttaaacagctcacttgaaatctacttaagtctaatctaaactatccaatatggatagatttttaaacatagggcaagcagcaaaattattgtagctgaaagcacaatcactcgctggtggtctcaaacacgtgccgactacctcgccgaaaacactatcagccgcgataaaccgtgggaaaagctcgttatcagccgccgcacttggtactatcgcgggaaaccgatgctgtctgaaacgcaacaggagaaaaataatgagccgttacctgattacctttgatatggataccaactgcctgaaagacaattaccacggaaataactataccaatgcctactccgatattaaaaccatcttggctagacatggatttgagaacattcagggcagtgtttatctaggccgtgaaggcatcagtgaagcacacggaacaatagccattcaggaactgaccgctcggtttgattggttttactcctgtatttcaaacattaagttttaccgccttgaaagtgatttgaacgcacaatttatcgctgatggtgtgtatcaagccaaacaggctttccttcaacgtgttgaacaacttcgtatatccctaacagaagctggattgtctgatgagcaaatcaatcaggttctggaaaaacagaaatttgaattggaaagtcctaacctgaaattaaattaacctcctttactcaccaacatccgccgcagctctgtcagtttttggcgcgctgcggcgatttctgtgcgttttagagcttcgggtagggtgtgaaacaactcactcgaaatttacttaagtctaatctaaactatccaagcagtaattagtacaaaaaaggcaaacttattttaggagtttaaaattgcagctgcgataaaccgtgggagagtctcggcatttcccgcgccacttggtacaaacgtggcaaaccgatgccgtctgaaaccgtacaacaggagacaaaataatgcttgctcaaatcgaactcacaccctgccagctaatggtttacgtaacttaaggttactggatttacgcactaaggttactgaacttaagcatatcggcggccaaagtaccgctgccattgccgatctcgctggggaaatgagaaggctcgctaaaaaatcaaaaatgttactgaaaggactttggccatttttatcctctacaatatctgcatttaaaataaatcagtcattgtttaaacattactataaaactgtacaactgctaaactgtaaacacagaaagaagaattactaacagcacaaaacaacagatatccaaacaccattaagtgcattattctgcattttcgttgcctgatgtattgatgctatttgtgctgttcttatatatgttgatgctggttacgtcgcgttttttcggaaaattcaaccggcagggagtcgatacgctgtttcatctctttgcttagggagagtaggggggggcggatacgaccttagttttggtatccgtaatatcatcatttttttcgtcaagggagtatatcgactctagaagataggtattagatactgccttttcttacaagagtgatggtaggatggttctcttcaagtcaatcaaacaggaaagtatttcttttctgtctgaagatttgaaaaaggactggatgtttcacaaggttaaaactggggaaaaagatggatatggttcagatgaaatgctgagcgtaccccgtgtctatttggaaatgatgtcgcggaaaacgggagtcccctactccagtattctttaaattctaagcagaagacttcttcgtcggtctttttttgttgtttggtttgcatggagtaaaactgtacaactgttgaagcataaaaccagcaagaaggtaaaaaagaaagaagcagttctttggattttagatattaccgcaattagtttcctttcctaaaatttgtttaaattatttgcaatattaatataaacgagatattaatgatgagaaatcaaaaaggcataatgaatatattttgtacaaaatatttgcagtatttaaaaatgttggttcgtatatgaaaagttaaaaatgccaaaatgtacagttgctaaactgtaaaactgctaaagcaacaaaacataaaaaggaatgcaaggatgcgatcactacatctttttattccgaagcgtttatgattttacggtcaactgctactctatgtgcctagcttttcagctccctattttcgaatattggaggaggcattttcatcagtgtcgtaatgccgaccaaaactctcacaaaccatattggttcttgtggcagcaacacctatccgtttgttcaagcgaccacaagagtaacatgattggctggtagcattggctttaatctcttcgatatgaactccatttttagctgcaccttctttcagcatatgcagcagtagggatgaggcaactatcttctggtggagtttgttgactttaatctgtatgcactgtaggttgagcagattcaattttttgatacagattatccggctttgttcggcaattctgtttgcgaacgtatagtagagctgtcgtcttgcagctttcaatttgcggtaggtattttaccattcaatgcgtagccgctcggtacgtttgagccaaatgttatcttcgccatttgtaccaatttgtttttacattaggctgtgttttagtaatctattgatttcaattatttgcaagggaaaagacaattattttccggttaggaataaacctatcctgttgaataccttaaagccaaatacgcctatcaacaccatattaaaacacagccttttttaatatagtagacacaatctttccctatttatgaaggtgatcgtttctttcagattcgtattttaatgctttctatttctataaaaattgactagaatagctcaattataaaaaattgcgcgattttggtatttatcatgaaaatttccagacctccggaatttaccctgttgcaacaggaatatatgcagcatctcactgaaagaatgacgcaaattgccaagctgctgaattcttccgcaaacaatcctgatatagacattcccgattttcttactgaaatcaaagattattcagaattttccgtgacagatgaaaatggaacctacctgcattgggacaaattccgccggattcacacggaagatacgcggatgaaatggcgcgccgttaaggaaagccgcaaaaaaatccaaaaaccaattgatttcccgtttgaacatcagttttggttctgcattcccgactctttgcaggcacggcttcatttgattgacaaaagctgcggcagttctatcggcacgtctagcttgggtggcttcggcagaagcgagcaaaacagattcttgctcaagtctctgattatggaagaagcgattacatccgcccaactggaaggtgcggctaccacgcgtaaagtggccaaggatatgctcaaatcgcagcgtaaacccaaaacaaaagacgaaatcatgatagtgaacaactatcacttgatgaaaaaagcggtagaattgaaaaatacgccgttaagtgttgaaatgattttggatttgcaccgcattgctaccagtaacgctattgaaaacaaggccgagcccggacaattcaggcaggatgacgaaatctttatcgccgatatcaatggtaacagcctgtatcaaccaccgccgcacggacaggttcatacgctgatggaagaggtgtgtgcgtttgccaataatacctatgacggcgtggaaaatccgtttatccatccggttgtccaagctattatcttgcatttcctcatcggctacatccacccatttggtgatggcaacgggcggacagcgcgggctttgttctattggtttatgctcaaaaacggctactggctatttgaatacatatccatcagccgtcttctgaaaaacgctcctgcccaatacgccaaatcctatttgtatgcggaaactgacgatttagatttaacctatttcatctattaccaatgcgatattatcaagcgggcggttgccgatttggagcactacatttccgacaaacaaaaacaccaacaggaattcaaagcagcgattgcccaatatactgaaaagataggaaagttgaaccaacggcaaattggtatcctgcaaaaagcagtggaagaaagcggaaaaatctttactgcacaagaaattgccaaccaatacggcatctccctgaatactgcccgtagcgatttgagtaaactgggagaatatagattcctagtgccgttcaaatcaggaaatgctttagagtatgttgctcctcaggatttattggaaaggttagaaaaaaaatagtttgctagcccagaatgcagctttaaccgagtcaaaatcaatacagtccgcaccttcaaaaagaagctgcggactgcttgctttttgctctacaaatgatctttgtagctgatttaaccaagattgtagcaattttgctttccaagcaagcagggttagaaaattcgatacttttaattattggctgtgttttaatatgatgttgataggcgtgtttggctttaaggtattcaacaggataggtttattcctaaccggaaaataattgtcttttcccttgcaagtaattgaaatcaacagattactaaaacacagccttacattattggggtgactatcctgtaaaatatgtcctaaaacgtggaaaccacttttgctctgctaaattttaaggaatctttatgttacatataccccccaacggaacctgttcgatatgttagcagtattgtagccttaaacgtgcatagtcctaacggtacaggcgactggcatagtgcaaaggcattgagtgatcgggcttaccctgaaaaattttatatttacggtgaaaatcaagagcgaaataccaatcatttatttggtgataatggcattattgatgggacggatcgactgaacaaaatgggttatttccctgaaaacatcccagtttggctcgcagatcacccccgtgcttgcgtggattatctttacacagcagtgttacaaactggctcaatcggtcgggtgattttagatgattggtttccaagcgatgaagacaagcaatcagtttatgacttacttaaccaaatcgaaccgcacttgaatactcaagaatgggagaatttacagctatggaaacgcaaaaacccaataatgtaatgctaaccgaacgagataaaaggcacgagaagcggtattactgaatttcatccgcaatacgccatgtacaattaaatcagcagatgtgtctaaacgtaccgctgttcccgtttgaaagaatttttcatgatgaagtctatcctcaccgtatccggaaatcgtatgcgtaaacccagaatcacctatttggatgtttgggcaaacgatgaaagaatcggtactttggaaaagggggccatgtatcggttcgcatacgacaatcccaattcttcgttgctgggcctgcattatcaagacagaagcaaggtatatatcagcaacaatatgccgcatatctttgcacagtattttccggaaggctttttggatgcacacatcacaagcaaatatgcttttcatgatgcgccttttgaagacaatgagatgctgcgcttggcaattctgtgcagagagactttgggtcggatacatgtgcgctgtaatgacccgctttttaatgaatggattgacgggttggagatgaaaaatccaagaatattgactgaacgggatttgctgggcataaatgcccgacaggtttttcagcaatatatggcagaaatcttccatcacggccgtttcgtcagtgtatccgggatacagcagaagatgtccttagatgccatccgcagaaataccaagcaaactgcctcatatattgccaaaggttttgatgcatccgaatatccttgcttggctgccaatgaatttttatgcatgcagaccatcaaacaagccggcattgccgttgcacagaccagcctgtcggaagattcatcagtcttattggtacgtcggtttgatgtcagtgaacagggttattttttagggatggaagactttaccagtctgcgccagtattcggtagaagataaatataaaggcagttatgcggctattgcacagattatccgacagatatccggcagaccagatgaagatttaatccatttctttaatcagcttgctgccagttgcatattgaaaaacggcgatgcacacctcaaaaatttttcagtactctatcatgacgaatacgatgttcgtcttgcacctgtctatgatgtattggatacatcaatatacagggttggaacacaaggaatttttgatgcttatgacgatacgctggcattaaacctgactaaccacggtaagaaaacatatccttccaagaatacattgttggattttgctgagaaatattgcgatttgggaagagaagatgcatcctttatgatagatacaatcgttcaagctaaagaacaggttcttgttaaatactcggatgtattgcgtgagaatgaatggttggcgcagaagtggcattttatcccggatgaaaatgaagaaggtctaccgtttacattccggtagctgccgctgtcagagatggccggtctactttcaccctgaaaatcacttcatcttatggtgtttgaaaccgagaaattagaagaatcgtattcggtaggagatatactgggaagattggaaaactggtaaatcactctattgattgagttggcggcctatatgtttaatgtaggcaaacgagaaggaatcatgtatttcatgattccttcttaaattcctgtgtcaatctaatatcaaaacacagccatctcttaccataatcatgataggtgttttattatgaaaagctatatctatagttaccgttgatttgactatgccgttttaaaacgtatagcctacctgaaaaccgcttgcccatttccttgattggaaaaattcgggctttttcaatgcgcggccggtaaatatatcgtaatgcaggttgccgccaagctttatctgcccgcgtatcccaattgctgtgccgactagagtttggcccgataaccatttggcggattgtcctgaaacatgtcctacatcagccccaagataaagctgatggcctggtttaaattgccagctcaaatcgttgcgccaataccatccccgctcggcagacaaactcatttcaccgtcgaagccacgtacggtgtggtgtccgccgatagccagtttgtcttgcgatgttagcggggttttgttccattgtgcatgaacggatgtgtcataggcaaatagctgtttaccgatttgaaaaggagtatttacatcagccgatgccgtccaaattttcatacgtgacgtgccttcgccaaaggcttcttcaggcgcgcgcagagcatctttcatgccggtgccgcgtttatatttcaacttaaaatctgccgtactgcgaccgatatattctttgtgggaaagttctgccaaccaacccgcagttttacgccgttgtacagtcagttcggcatcatcaatgtaactttttgtttccctcatccacagttttacaccgagataggttttgcgtttggcatcacgatacaacaggcggttgaagccgaaatcagtattgtaactttttccattatagtcatagacttccgataatccggaaactgcctgatggtaacggtagccattgtgattgaatgcccatgtccatttaccgaaaggggctgaataatgtacggcgtaattgtttgatccgccttctttgcgatggccgtcaaaactttcctcatcgggcgtaccgccaatcgaacgtccataatttacatagaacatatcactcagtcccaaaggattgtcggcagagaaagtgatatttccttggtattttcctgtcgcctcactacccgaattatccatccccacactcacacggtagggcagcagacgttgccgccattgcaccacgacatcactttggtttggttctccctctacgggaacgatttggagatcggcttccgcagtcgggagacgtttgagattttccagtccttgttccaaatcacgcagattcaacagatcgttcgagcgggtgggaaatttgttctggaatgctgcaatacgtcctgcatgggtttgatcatcgttagaccgatcgattcgtatggagcgcagatagctcggtatcagggttaattgaagcttgccactattcaaatcctgtggcgcagccaagatacgggtcgtggtatatcccctgccgatcaaagcattttgtgctaaggacatgatttgattaatgttgcccgcatgcagacacttgccagcctgaaaacccgtttcgcgcaaggcacgttttagggcaaactgaaaccgagcatggtgttcgccttccaacaccacttcgttaatggcaaaacacggttggctgctgtcatcgcccatcaactgattaaccgtttcccccgtgtttttttgatgcaaacgcacatcgctttcaggctgcatggtttggcgcaactgctcttcgcgttggcgttgctgaatatcttgctgcatacggatttcggcagggttgggggaggccaacaaagtagcaggagcaatgatacctgccaataagcagcaccaagacaaaaagcgaatattaggcaaataggataaaggaagtttcatggcatggtcgcaaaatcaataaaatcatcaatgggcattcaatacacgattgcatcaagttttaaaagttaaaattctcaaacccttatcgctccctttatgatacaaggcgcgtactgtcgtactaggaaataactggcgcacagctgagcgcatttgatgactgtgtcccaatggcgcaaaccattgaatcagccaaatattgtcgccacagttccaatcgctgttgtcacgcaaatggcggtcagattctaaataatgcgcctgcgccacttcatcaaaataagcccatgagatataaccgattggttgggtacccttgcaaaacaaagcgaactgcccgttttttaacacaggcaatatatacgtcatcatctccacaataggtacttggcgatgcgtaggcgactgataccatagccaagtgatggcaccgagtgcttcgctttcgttccattgttcattggggtagagtttaggagagatgatgtttaagggtggagtgatgggcatattttaagttagggttcgtgttggttaaaacaaaaaatggtttcagcctgaaatgaaatatttcacgttaaaacatagttttagcacatgagactgaactgcgtgggcaacgagttgcccaccctaccatgtaacagttcgcattaattgcacaggctacgctggttattgcacaaacaaatgaccatactgcttatctttacgaatattgtatccaccgccatggtgaatacactgataagaaatatgttgcccaatttcactaaatgagacttcggtaatagatttatatcctaattgattgcctaattcatgcaaaacaaaggtgagattttcagtttcacatgtgtcaacggctttctcccagcgtggattaagtttggagcaattccagtctgcacaactaccccaaaaagggcaagctgttagcattgttgagcagaatgatattagcactaaattagaaagggttttcttcatatctctctcctttataagttattgtgtgttacaacataattaggatttttaatgcactgatagtaaatatccattactgttttgtttttgtacttttcttcatcattctcaaaatagatattcagttttactaatgccttatcaaggcaattcataatttcttggtgttccttatcagtagttgtccagttactactagtaccgtacaaggctgtaccgactacgacagtacctaataaggtagtagcgcaagctgttagacaaaaaacagatgaaagaaacagagaatatttagaaagcttctttttcatatttttcattatcttttgttttgtttggttctaccagtatgggtttagatttgttaattggcttaccttgagcgtcatattcaacttcaccccatatttttacatagtcatcaaattcttttgtacctgcttttggcacctccgcaaaataactgctatgcgaatagcacaaccccttacatgtaccttgtgtggtgtcattggttcctagcaagaaaggtatccatttgttccccacaaaatctttatcatgcacgattgagtaggatccgctgttataagttttgccgtctgcacccgtataggtatagccgtttttctgtaaaacatcggcgtaatcattctgcacatttgtggctgtaccatagaaacgtgcttttctgattggggcaatgccattttgtttttgattgtttacccaatcttttaaggaaacgcttgctgtaattcccccacgactgtgattactggtatcaaccgaccagccgttacccattttttgaacctctcgataaatatcttgattcagtttttctgaattggttttgggtaaatagccttggaacactttattatttaattggtcgtaaccgacatacatcagttcagaaacaagacttgaaccgagccataaaaaatcttttattttgttattagaatcagatttatatttccctgttggaggattcatgactgcaataacaccactaccgtttgtactattacgattttgttttgctgcgttgcttaatgaatcttctcgattattgaaaataccaggattagacacagtaataactttgccatttgtgtcttgaatgcttgccagttcttccttgcttaaatcattcaatgaccaaatttgtctggtatcaaaggatactttacctgttttttcatctattatcttcttatggaaccacatttctttaggtgcagttgcagaccttaccgctctatcggcttgggttgtggcaaacatactccaagccatatcagaactccctgctccccaaacgagtcctaatcctgaatcctaggcggtaatgacgaaggatagttttacaaaagtttcggcctacaatttataggtttataataataaaaatatccatcaaaaaaatgtgatttttctttttttaaaagttgcatcttgccattcttgtaatcacattcgtaatattcaacatttttcaaatctgaatcaaatagatattgaggtaaaacattcccttccttatctagttctattaattcctcaaaaactatcttacttttatgataaaaaacaattttttggaaatctgaattgattatatacagttttacataatcccaattaaaattcgttatatcactaattaagaattcttttttattataattaaaacttatttttcttattacattcttttcaaatataaagaaaataacaatagtgattaataaagaaaatatataaagtatatttttattcatcttttatcttctccattgtctggctgaaatttgtgctctgatttgttttctcctctgctgaattttaaatccggcaccagtattatctaagtgaatcaatatattgcttgtattctggtaatctttttcagataatctttttcttacaacatcataatttccattactgtttctttctgcttgataaaaaccattatttttataagtttccagaattaatccaactaactcttttgtgtttaacctattggtatttaatgctatttctcttcctatttcgttatttagttgatcaatcatttcatctgctttatctaatgaaagattacgtcttatagaataattaattttttccccactttcatgactatttcctactttaacagcaatatctttgccaaattctcgtgtgatggttgcttgccataaaacgtgcctgaatgcattgccaactccaccttcaccaccaaattcactattaggaaataaatttaattgaaaagttgaagcaattgttgaaatattaggctctaatgtagagccaggatctttatgtacagatccaattgcaatagcaattctagggtgcctaagagcaaatttcacttgctctacagtatcattattctccaccgcactttgcgcattcaggctgccttgcgctgcatctgttgcgctgttgccgactgccgcacccgtagccgtacccaatacatttgtaatcgctgttacagtctctttctcttccgccgttaagtcgcttcctttttctttgccgtataaccatttgctgatgtaaggcgcagccgcttccgacccgcccgcactcaatgctcctgctagagcattgttgtctcctactgcggcaaccgctgctcctaataccgcgtgggcaagaacgtgtgcggtttcttgactggcggttagtttaccattcgcgttttgaccggctaaatctttaaagtgctgtccaatcgcatacgatacggctggcgatgcggtagccgcagcgatgcccgctccgctttgggtcggcgcagctaaacctgaggctaacatgttgagaatgactttgccttgttgccaattatctgcttttgctgccgcatcttgagcttcatgggctttgcgtttggcagtttccatatcgccattggctaatgcctcggctgctgctgtttcggctgcttctttgtctgctttgagtttgtctaaatgttggttaatctcggtattggcttgttgaacatttttactaaaatcttggctgacggttctttgtaaatccagttcactttgcaccgcttctttgttgaaggtgttcttcaagctgcccgaatgtcgttcggcggtgtctgtggttacgtttgtatcaatatcggctttggtttgtgccgctgttttgcctgtcagccggatttgtgcggcttcgtcggtgatttgaatgttgcgggtgttgatgccgctttttgtgatgctgctttgactgtcgctgtcgctgccataacccactgatgaacttgcgctgtttttatcggctacgcttgtcaggtgtttgttttgaggtttattttgtgcgccctgtcccagtgttttgccgcttatggacgcacttgcgcccaatccaaaactttcgcctttgtattggctgtggtttttgatgtcgctatgggtgagggtggccgtctgaaagcggtttttacccttgtcttctgcgctttgggtactggtgatgatgccgcctttgaggtctgtatggtttccgaccttgatttgatagccgtcttctccggcataaataccgctttgctcggttactgaaacatggtcggctcggattttgctttggctgtaatcgccaccggcactgaagccataacctacggtaacttgtgcactggcgttttgttgtttgctttgataggtttctctatcttgtacgctttgaatacttaggtttttggcattgacttgtacgcctttgccgcgtacttgcgcgcctttgatggtagtgtcgccaccgctttggataagggtttggctgcctttgtcgccgatatggctatggcggtgggtgatgctgtcgccattgccgtagcctttgccgacattgccgcctgcggtaacgcctaatgaccagcctccttgtccgaatgatacggcagcacctgcgttccagcctgccgatttgttttggccgcgttcggtattgctttgctcggctgattggagtgtgatgtcgttatcggcaatcaggattgtgcctgctttgccggcaacatctgagcctgcgatgttgatattggattgttctgctgcgcctgtggcgattaatgtggttttaccacctgcttgaatttgactcgcttgggcttgattggcttgaacttgggtggtttgtcggttttgctgttcgccgtaggttatggagatgctgacttgtttggcattggttgtaccattggctaagttttgtgcactcttacctgtttgataggcttgccagcctgcattggcagccgccatggcattaacgcggtcgtttttgctttgtccgacttgtttgctgctttgtgctacggcaatcgcttgttgtgccaaatcggtaacgggcgaactgaatgccaccgttaggcctttttgttcataggtttgggtggtattactgtttaatttgttgtgtgccgcttgaatgtctatgctttgggcatagatggtattgttgccttccgggctggaaacggtactgccgatttgttcgtagtgtttgcctgcaacaatggtggtatcgcctttcaagctgcctacggtactgcctgtatgttcgttgctttgggattggttttcttgtgtgtttgtcttgctgccaatagtgaagccgatacctgcactcatcaatcctgatttctgggtttgatgataggtttcgctttggctttgagtttgggttgtaccaatgcgaacatgattgcctgcttgaatctgggtgccattatcggaaataacattgctgccaaggatgttggcatcgtttcctgcctgcaatacaacttgcttgccttcaaaggtgctgctttgggcggtttcgtgatgactttgggctttatcggtaatgactaatttattgccaccaccgcttctgcctgtgtgtttggacgcatcatcaacatgggtcgtgttgatgcctgcgctgatgttgatgtcatttttggcagacacagcgagtgtaccgtttgcgctgctgacttcggcagctttggcattgaggttattccctgacaatagggtaacatcgccttttgtttgaatgctgctgccgacttcgttcgttgaaccgcgaataacatggttatcggcatcaaaatgggttgcttgatgtttgctggtttgtaccgtatctaggttaatgtcgcgccctgcttgcagccgggtttgcccttgctctgattgattgctgatttgaccggcaatgatgttgatgtcttttcctgcctgcgctgctaaaacacctttttctttgcctgtgatataaatacctgccattcggtctaggtaggtgctgctgccttgtgtattttgactgctggcggtggtgctttggctgttgatgttgttgcctgcgttgagcaataatgtctgttcggcagaaagcatgccgccaatattattgatgtcttgtgtggccgtaaccgctgatttttgcgcatgaatacgcccaccgatattgtctagcgtatcggtattgataataagcgcattgcgccctgcaatcgtgcctgagtttttcaggctgcctgaaacattgatttgtgtattgctgcctgacaacaatgcacctttaccgtctatgtcgccatttttaacgcgtacataaacctgtggcaccaatacggtttgtgtgccgccatcaggaagcttaacttctttttgtaccaaccaaacaatatcgctggtcagttgcgctacttgctcggcacttaatgcaatgccaacgctgagattcatcgaacgtgccgcagtcgcgccattatccattaaggctttaaattgttcttcgtcgttttgataaccgtctaaacgacgatgccctgtcagctctgcgatttgttcattgattaaacgttgctcgtaataaccatcacccaaacgtttatgtaaattgtttgggtctagtttgaggctgtccagcatatagtcactacccaaccattgacggtagttggcaaagcgtggatcggtttcaacaagatagcctttattgacaggattgataatgtataagctgctgctgggtaatggggtaaaagaattggacgtatagggtagcgaaataccgttgctttgcggcaactcagtgccttggctgggcgcatgatggcttaatgctttgcgatgcgattcataggcaaatgaacccagtgaaatgttgcgtgtgatttcctccggcaaagtgtaattttgttcgctatgtcccgttgagtctcgtcctttatgtttctcacgccaatagctgtgtaatttgccattttcactgaatactttcttttcgccaaaggtttgctcgttatgcaaaccgtctttttctgtttgtacaatgagattgccaccagcaatgatttggctatcggtattaaatacttctttaccatcaatggttaaatcattacctgaaatgattttggctggcgcagtttgggtaacttgggttttttgggtgactttttcataatcgtatttatgccaattttcatgcgccgctccatcaggggtgcgtaagtggtctgattcatcgttatagacagaccagcctaattcatgttgcgtgccttctcgcaataattcgtgtcgtccaaatgcttcgtaatcaacaatatgctcgcgccctgtttctaccaactgcgttttcaaatgctcattggtattgtgcagcttttctacacctaaacgcattttgcctgcagcttcaatggttgcgccggcattgtgtatcctttgggctttgcctgtggcttggccattggtatctaatgcgccgccaaccgccatatcgttaccgctgtaaatcagactgttttcacggttgtttaattgtccgatgcctaaattcaggttttcacgtgccgcaatggcggcacctgtaccgttttcatcttgattgtctaagcgggtagccgcaatagcgatattgtcgccataaatccgacctgtaccgatattattcatttgcccggcttggattttggtttgttgtccgtcaatcaagcctctattggttaaattgtgctgcgtgccaatgtctgtcgtaccgccggattgaatgttgccttgtgctgcattatcaaggttatttgctttaatccgaatgcgttttcctgcttgcaaagtatgtgaatttttcaggctgcctcgtgtactgagcgacaattcattgcccgccacgatattgcgttctacataaaaatcatcttgtaacgcaatatccagtttattatcagcggcaagtgtgccgttgttggataacgattttgcctgaatagcaacatcacggcctgattgtatcgtgccattcgtattatcaatgacagcggtagattgctgaccatcgtgaataatcagttgttgattggtcgctatttcgccattttgattgttcaggctgcctgaaacggctaaatccgctatttctgctgataataacttgccatgagcgttatccagttgatcggtttcaatctctaactgttggcgtgttgtgatgttgccattttgattattcaggctgccggcttgaatgtggaccgcatcactgataattgttccattgtgattgtcaaacgccgaaccttttgcatttaactgatgaatgtctatttgtcctgcattatttaaaccttgttgcgcactaacatctgtttgaccattggcaataatactgcctgaattatccagtgcaccatgagtgcgaattgtcccatcagcaaaggtaggcgcagttatgtttgatatagaaacggttgcagtacccgtacctgttgccgttgttggtgtggtagtggatgaatggaaagatgcattgtaactattgccggtttgattgcttgaaccatttgacgcggttggtgcggtatcttgtaaacccatgcggccacggttatccattttgccttgtgcatcaatatggagtttttgtgaacctgtttgagagagtttgccttgattattaagtgtgtcggtatcaatagccaaacgagcggcttcaatggtgcctgatgtttcatttttcaggctgcccgaattgtgaatcaatatttcgcctgaggacaataatgtgccagtgttttgaatcgactgactgtgaatttgagtgccttgttgcgataccgccgtaccgctgttttcaacgccctgactgcggatattgactttgtgttccgctgtattatccgtatctttcgcattggcggcagccatcgtgccactattgactaaacggccatttgcatcaatcgccacattaccggaagaagcaaacaactgcccttgattacgaatgcctgcttgctcggccgtactgatcaaggtgattttgttggcatacatacctcctaatttgcctgtatcaatcgcaaataaagggatatgtgtgccgttgttggctgtattgtttgacgtattggcagcagcattattgagaataggcgaatgtgcattacctgttgcgaccacatcgttttgtcccgcgacgacacgaacatcttgtccccatacgggtgcatcaattttggaatgataactgagaatacgtgtgaaatcggtatcacgggcatccaaaccgtgtccggcgattacaacattgccttgccttatcttaaagccgctaaggtctcctgcttgatattgcggttggcctgtcgtcaaagtggcacgggaagcattgataaaaccaccaccattgactgcaatccctgccggattggcaataacgacttctgcacgtcgtccgcccacttcaatatagccattcatttgtgaagaatggctgctgttgatttggtttacaaccacacgtgcttcgccccttgccaaccaaggattaccttgaatccaaccgcctagctgtgtttgggtgttgctgcggctgttgtttaaaatcgccccgcgattacccacatcaaactgggcgtattgattaacagaaacccctgccgaagtaggggtttgaatattgacttgcggtatgccgttacctgtttgcagaatcgtggcttgttgagttttaggagcagctttatcagcaataatgccatcagcaaaagcaatattggccgtacctacagccaaacataaagaaaagcccaataaagaaaaagaaaagatatttgaacgacaaacaggtgcatgagtagtaccaaaaggaacagatttcacatgagcgctgcctgaatcactatcggcacagcttttaccttcgcgcttggtagtttcagcaacggctaccacagccccacgtttgcggttgaaaattacacgatagagagttttattcatgatttcagttatttgatttttatagagttattagaaaaaattggatagtctgaccattctagatcaaggattttggcgagtcaattaccgccattttactgccatttgtttattaaattagggactttactagataacggttaaaaatcccattcgaacgaaatggcaaggtttataccgtcgttgtccctaatgcgcaatcagcaacattattgccgattatccgagagaaagttaagtctgatggcattgtgtatacggatacctttcgtagttatgatgtacttgatgtcagtgaatttagccatttacgcaagttttccagtatttgactggcaatttaaaacagtcggattttgtcccatttgttggccaagtctttacttgcttggccgtttgaatttaaaaagcagtctttctactttccgacctttttttctgttgtaaggtctataatccaatagcattcccaaagagcattttggacggtggcggattcgcatttgaagtgcaactttccctaacagaaaaaggccagtatgcggtagcatacggcctttcctgcaagaaagattgccatgagctacacgcaactgacccaaggcgaacgataccacatccaatacctgtcccgccactgcaccgtcaccgaaatcgccaaacagctgaaccgccacaaaagcaccatcagccgcgaaatcagacggcaccgcacccaagggcagcaatacagcgccgaaaaagcccagcggcaaagccggactatcaaacagcgtaagcgacaaccctataagctcgattcgcagctgattcagcacatcgacacccttatccgccgcaaactcagtcccgaacaagtatgcgcctacctgtgcaaacaccaccggatcacgctccaccacagcaccatttaccgctaccttcgccaagacaaaagcaacggcagcacgttgtggcaacatctcagaatatgcagcaaaccctaccgcaaacgctacggcagcacatggaccagaggcaaagtacccaaccgtgtcggcatagaaaaccgacccgctatcgtcgaccagaaatcccgtatcggcgattgggaagccgacaccattgtcggcaaaggacagaaaagcgcattattgaccttggtcgaacgcgttacccgctacaccatcatctgcaaattggatagcctcaaagccgaagacactgcccgggcagctgttagggcattaaaggcacataaagacagggtgcacaccattaccatggataacggcaaagagttctaccaacacaccaaaataaccaaagcattgaaagcggagacttatttttgtcgcccttaccattcttgggagaaagggctgaatgagaacaccaacggactcatccggcaatacttccccaaacaaaccgatttccgtaacatcagtgatcgggagatacgcagggttcaagatgagttgaaccaccgaccaagaaaaacacttggctacgaaacgccaagtgttttattcttgaatctgttccaaccactaatacactagtgttgcacttgaaatccgaatctaaggtcatctgaaattaaatttagttttcagacaatctttttcttcaattggaacgtggagttacattttcacctaaactatgcacgctagatttatagataaaccattcagacagtccaataaacattatggttgggattaccaaataccaaaaactaccgactctttcagatgaattaaataaagaaaagtacccatatgtataaaaaacaatgaaggttaatatgacagatacagcaagttgattttgaaatacccatctgaataaagttgataatatcactggaattagaaaccataacataactataaacccaccccctaccatcccaaatataaaatctattacccctaaaaaagatagtttaaaatcattaccccataaacctgaaaaaattaaaaggccaaaaaatactccacctattaagaaaatagatttaatattttgaataagataaaataaataatttttattcatggcttgcatccctgtttctcagaatatcccataagcttacaaccatatttaattctagatttgtaatctaacatattaattccatcctctatttttttcctctcatctaaaggatttggaattattgaaaatatcttatttgatgttacccctttaatcaatgacaaataatccttctcattactcaaatatttttggtgaataggctgtaataacttttgctcgcttttcaactgttgaatatcccactccctaggattagtttttttattgaacaagtctctaaaattataaaatccatttactatcagtgcattgcctgacgcagccctccattcataaattggaggattaccaacaactttacctgccgcaaaagttatataagaagcttctccgtctgcccctaacccagttatagcagcacgcgatacaaaatcagctccaccaaaccatcgtgcttttgaacccaaattttgctcataaagattgctggcagcaaagaaatctgcacgattgtcaatggtgttgaaatacttgtcaaatcttgtagatgccccttgtgagttatataaatagccaaaaacttctttggcaacccgtgatacatccgtaggcatatacttccacgcagcaggcatggcaatatatttaatagacatattaatgccgtttctgcaaccatcgcccaatgggttcctagaacagactttttgaatttccgtatcaattactttgctaaattgttcatcctttttgatggcatttactttttccatcgtagtagaacaagttttaccggaaaggcattttgtcaatttatccattctttccttgctaagcgcattactctctaccgccacagcagccgcattcgccgcagcattcacatcccccttactcaacgccgcaaccgtccctgctgccagcttcgccttagcaatgatttttgcccggtctttcacattcaggctgcccgggtctctgccgtccagcagggcttcgccgaggatttcaccgaccgccgctcctatcgcgccatcctgacacttgcccttattcgccgccgcagccgcacagcccgctatggcatgggcaatcttgtgggtaatgtagtgctgatccaactgtttgattttactggctgcttctccatgcgcagtattcaccaaagccgcaaggatattcgcttccagattgtctttcaggctgccgccgttgacagcggtattaatcagtgcggcactgcccgcattggccaggttgacggtcaggttgttgatccactgcttatcgctgacattgttcagtgccgaagcaccgattttgtcggctacgcctgcggtagcgacggcaaccatcagatttttcaccgtgctgcttctgcccagctctttcagggtgttaccgatattgcctttgttgttgatgagcgatacggaagcctggctggccagcgaggcgaatgcggcatcggttgccgctgcggccgcgccgtttaagcccagtgcggctccggctcccgcgcccgcagtaaccacggtaacagccagcgcaataatcgctgctccggctccggttaagccttcctgtttatagtcccatttgtcgtacgccagttgtacctggttccagttgacgtctttggtgacttggagctgtttcaaatagcaagcgtagggggtgtcttcagcacgcacgcatctgggcagtatatagggaatctgaatatttacttgcataacaaatgccgtctgaaaaattgtgagcttttcagacggcattgagccgtaaatcatggaacgcgtgcgtgctgaagcacacaccttacgcatggattttaggtttcatgcaggctacagcttgctgctattcatcaaattgcggccattgaaagtctgttgttttactttcacctctcaacagtctaatcatatcgcttttgagaaactcaaaaaaatttttaatattaccaacatagagcatagcttcacatagtgaactacatgcagatttaatgtcttcattgtcaatagcatattgatattccttcatatgctgaaaaaaagaatcaaagtcttcttctaattcatcattccaatcagatgaatagttagaaagccattgtaagtcaagaggatcttcactattcaatttttcagttgtggctttctcataaagatcaaatccttgtttaattcctaactctcttaaactttcttttactacattaaaatttttcatctgaatcaccttatttaagattcaattttcgcccttgccctgctaatgtcttagcttaattttgagcgagttttaggtttcatgcagactacagcttactcagcacacacgagtctaaacagtatacagggaatctaaatatttactttcataacaaatgccgtctgaaaaaattgagcttttcagacggcatatggccgtaaatcatggaacgcgtatactgaagcccacaccttatgcatgggttttagatttcatgcaggctacaacttgctttctattcatcaagagatggccatgaaaaactattctttttatactcagcactcaataatgttgatatatcagtttttattgaatcaaatataagagatagattacctgcgtaaatcatagccataaataaagaattactggcaattttgaaatttttatcgtttagggctaattggcatacttccatataatctaaaaagttttttaaatcctccttaaattcattatcccaattcccgtctgaagtataatctttaatccatttcatattagctgtttcatgattaacttcttctgatacttttggatctgtcaaatcaaacccttgataaagccccacattaatcaagattttttttatatcattcaatgtttccataaaatttcctattttaagtttaatttacgaccttttgctgccccagttttcatttggttaagcgaaccatccatatttagaacaaacttaaagttcccatttttatcaaaaacctctaaatgatttttatgttggccatctaaataaaacctatcaccggtttttaataacccttggtttctttttaccaagaagacagactgcccttgctgcgtcggaagcgttgtcttttctgaaatttgagccagctgttttccaaaaggattatttttcatgtatgtactcatattcggtacagcacctttattagggatataaggacgatttttttctaaaacttccttgaccttttgtgccgcttcccctttattagcgcgattcagctctgttccgacgacaatatcaataacggctttggcatcgttccaatccaatgtttcgtcgaataaggtggtcaggttgtcggctaaattataaccttcgtctttcaacgtctgttttaaatctctaacgttgattttcccgttttttaatccttttctggctaccttataaaccacttttgcagcagttacaacagctttaaccgcattattttctaccgcgttttgtgcggtttgtgcagcagtattgacatctcctcccgttacgcctgcaactgtacctgccgcaagtttggcataggcggtaattttcttaacttccagatctaattgttccggggtcatatcgctaaaatcggtatttttaaccaaagcctccccgacaatctcacccacagccgcaccgatcgcgccgtcctgacatttgcccttattcgccgctgcagccgcacagcccgctacggcatgagcgattttgtgggcgacatagtgctgatccagtcctttgatcttactcgccgcctccccatgcgcggtattcaccaatgccgccaggatatttgcctccagattgtctttcaggctgccgccgttaacagcggtgttgatcagcgcggcactgcccgcattggccaggttaacgttgaggttgtttacccaaggggtttcgctccaagtggcaagggaagaggcaccgagtttgttggatacgcctgccgttgccgccgctacaaccagattttttaccgtgcggcttctgcccagttccttcagggttttgccgacatcgcctttattgttgatgagcgatacggaagcctgagaagcgagtgaggcaaaggcggcatcggccgctgctgcggctgcgccgtttaagcctagtgcggctccgactcccgcgcccgcagtaaccacggtaacagccagcgcgataatcgctgcaccggctctggttaagccttcctgcttatagtcccatttatcgtaagccagttgcacctggttccagttgacgtttttcgctacttggagctgtttcagataggcatactcgggctgtttggccagcttttcgatttcggttttcagattgcctttggggatgtcgacaatgtagccgccgggagcagagagtacgggcgcaacggagcctgtgaaacttggcagttgcaaggtttcgatattgctgccgcgtccggcctgtttctgccagagggcagatttgctactgcttactgtttcagtgcgcacactacttttgatgccttcaagaataatcttggcatctgctcgtgcctgatcgcctacacctgcacggatggctgcgccgcccagcgtggtttcaaactgggtgccttgcagtttggcgtcccagcctgattgcaggttggccgattctgcaactacccttgagggcagggcggttttcatggtgtgggtggtggtgtcgtgcaccttgtcgtaggtaatgccgataaatttgcgcttggtacgggtgtcaagtttgtcgtagttgagatcttccacggcatagagaaccagcccacgtccggcttcgattttaacggagccgcggggtgcatcaaacaaggtggcgtgggcaccgatattgccgccggatttgatttcaataccttgtgacgcactgaggctcaccgggtcggctttggcgtttttatgctctttgatttcagtaacatgttttagtttgtaccacttaccggttttatagctgcgtttatcgaaggtgtagagctcaccctgtccggcgtagtagaactggtcgccgtaggattgcagtttgattttgccgttttccgaactgatatccgtggtgctcagcaggatgcggctgttttcattggcatacggcgcgctaatgctcacaccggttttacccgaaagttctgcagcaagcgtaggaggtgtcttcagcacgcacgcgtctgaacagtatacagagaatctgaatatttacttgcataacaaatgccgtctgaaaaattgtgagcttttcagacggcattgagccgtaaatcatggaacgcgtgcgcgctgaagcacacaccttacgcatggattttaggtttcatgcaggctacagcttgcttccataaatcatttttatcagagctcgtaggtacggttagccgcctttagcggcgtaaccgtacgaatgaaatgccaagttgcaaggccgtctgaaaaagttgaaaaacagatttcagacggccttgttattttataaagtttgctgatatgcgtacggttacgccgctaaaggcggctaaccatacctacgcttgctcataaatatcaatattcggcaaatcggccaaatctattggacacgcaatatcccaccaaagccattctaagtaataccaagggtcttcaggccatattgcttgggcatcttccaaagtaggccatatgtctttcaatttctgcacttgttcttttgaagttccagttagaggaattccgataccgtcggtataatcatgtaaacggattgaaccgtcatttaacagttcttccataaaagaacagaaattgttttttaagttttcatcttgaatattaatacccatttgatttttataagagttaaaaattgaggataaatcgatttgaaaatcaagaatcttaattttttgtttctcatccacggtaaaatcctttgtaaattattggaatttaagctccaatttagtacctttaataaatgatggaggattctgcaaatctaatgtccatcgtgcttgagttgaattctctgtttttgaaaaatttcttaatgcaatttttgttcctgcccattctccagtactgataatgccatttgctaatcttccgtcaggcaaaactctaaaattcggattctggccagtcatctgccgataaagcgcaaaaatctcctgttcgcttacgccgctgtaaacgggtgctccctttaagcttatggcttgtacaggtttgatggtttttccgttaatggttatcggaatattacttgcatcaagcaagcctgctcctttccttactctattgttaaatcccgtcttccatgcatccagttgcgtatcgcgttgggcaatacggaataaaatctgctgttctgctttggctaaatttgccaaattgtttattgtttctttaggagcagcttgcttagccgccttcgctttcgacaacgcccccacaggcgcttcccaagcgttgcctaccgttaccgcacccgtggcgattcccgcgcccgcttcggcagcctgagtgaccatgacagtacaaccagaaggattagccatgcaggtgctgatagctaatttacccgctgtaccgatcagcggagctgtccaacctgcagcataaaccccatagctggtaatcacaatcgggcctgtgatgccattacggatattgcttatccaaatggcagcatccttatcctgcggattagtcatcgcacctgctgcatgtgcaggcataataccttggataattttttccagtgcggttttgtcgggcttctgcggttgatgctttttcgcattggtaggggtactgtcaaaattcaaagcattattcactaccgccacctcagccgcattcgccgcagtattcacatcgccgccgttgagtgccgccacgctgccggcaataatcttcgagtaactgataaccttatgcttttccgcatcgctgagtgtagcagggtttctgccgccaagcatggagtcggctacgatttccccaactgctgcgccaattgccccgtctttacattttccttgtaccaatccgctaacacacccagccaaagcgtgggcgaactgtttggcaacataatcgtcgctgaaggttgttttgattttgctggcggcttctccttggaagctattaaccaatgctcctaatgcggcattgcctaagttgtctttcaggctgccgccgttgacggcggtattgataccagctgagatacctgcattactgagattggtagccagtctgcctccaaggttggcaatagtttgattgcccgtactgctgaacagttcggttcttaccttgctgttcaattgggcaatatctgcgcccatctgatttaatgcacccgccgtcagggcagaagtgacaatctgcttgaccgtatcactggtgccgagatctttcaacgctttgccgacatcacctttattattgatgatggatacagctgcttggctatacaaggaggctaaagcagcggtttgcatggcagtcgctgtagaaacggtagtagctgctgctgtcgttgtggcggctgttccggcagctgcggctgtactacttcctgaagcggctacaccgcccgctgcggttgcgccgtatccataagtcagtgcggttacgattatggtaacaatcgctgcaccggctctggttaagccttcctgcttatagtcccatttatcgtaagccagttgcacctggttccagttgacgtttttcgctacttggagctgtttcagataggcatactcgggctgtttggccagcttttcgatttcggttttcaaattgcctttcggaatgtcgacgatatagccaccgggggcggtcagtttgggcggagtagggctttcgaagctgggcagtttcagcgtttcgatagtgctgccgcgtccggcctgtttctgccatacggttgagttggtttctaatttttcttccgactggatacggttcacaatgcctttgaggataattttcgcatcggcacgggctttttcgcctacacctgcctgaatgtccgcaccggccagcgtggttttgaattcggtaccttcgagcacggtatcccagcctgaacgggtggctgcagtttgggcgacgacgcggacaggcaatttggtttcgttcagttcgtttttactgtaattgctcttgcctaccttgatgccgataaagcggcggcttttttggacatccaactcgtgcttgtggatgccttcttctgccagcagttgcagctcttcacccgcaaccagggtaactttacctgcaggggcattgaagcgggtggtattagcttcgatgttgccgcctgcctgaagcgttatgccgttggcggtcagctcgacgggggctggcataatcaggtggtcgcgggtgctggtaaacttggtttttctgatgattttgccgcttttacctttggtttttaagaaggtataggcatcgttttgtccagcctccagtacaatatcactatgggctttgatgtctatgctgcctgagggagctttgatttcggatgcaccgataataatacgtgcatcatcgagtgccgcagctgcatgaatacttacccctgtacgtccggtcaaacgtgaaggcttgttcagagcagctttgtcgtagtgactcttgtaggtgggcttgccaatttcatattggtcggttatgccgtcaatcagaatagcagccgcctctgaatctgctgcctttggcaatacgcctgcggcgtgaaggttcagttttttggaagcggtaatatcggaaccgctgatttcgatgccttgtgcggaaatcaagtcaatattttgtgcagaaagcttggcttgcaggtattctttgcctttgggttttttacctttaacttccttgttgatggcttgaatatagaaagcgagacggtcgcgttcttcttgcagggttggaatcagcttgcttttaggcgagctttttttcaactgcgcaatctgctgttccaattctttggatttttggttgagttcagccgctttttgtgtaggaaaataattgctgaatgagttgtttacggcttcgatattcaacttgcctttggtggtggcgacaaccaagtttttaccggctgtaattttagaacctcttaaatctgtttctcctgtaaccagacggatattgccttttgcttccaatgaggaaacttgagcactaggcgcacctgcatttcctccttttgcagacaacagcaattttccgcctgttttgatgctcaggtcggtatgcgcactgatgcggttggcaggttcgatggttaatgtgccgctacctgcttcaatattcagccgtccggccaatggttttaattcggcattatcttccaaagttttggtcgaaacggtactccaattgatgttgccgcgcttgactagggcggtaccggcagtaaggttgattgcacccgctctcagcgtggtgttgtcggcaatttgggaatagcgcgcattgagtgccaatacaccgttagccaccagcttgttggcagaaggcagtttgtcgttttgccaaatctggctgccggtaatgcttagatgacggtgtgcgtaggcatctacttggttgagcgttacccgctcgtgttgtgcattaagatgcgtattatgggtagactccagcttggtattttctatgctcaatgcccggtcggaatgaatgttcaatgccccgcttttggcatggacgttaaggttttttaagtcggcattaccaccgttgtttttgatgctgatgtgttttccgttgattgaattgcgttgttttccgtcaccaagctgaataccgttgccggcaaccaacgtaatatctcctgaagatgaagtgatattggtattgtctgctttcagacggcctttaccaaccgatcctgcattgacatcggccttggctgtcagggtattgtgaccggtaaagtcggcattaccgttggccaataaggatacatgaccgtctgcagaaacagcatgaaggccgtctgaaacgatattgccctgcaatgcggtggtttcgagagccttggctgcgttcagcttggtattgcgaagctgaatattgcctttggctgcctgaatgtgcagattacccgagttggtacgcagattggtattggtaacattcagcgagcctgcctccacacccatgtcttttgaggcagtgagggttttactggtgccggtaatatgggcagcgttatccgatttcaaatggatgctggcggcagacaaatctttatcaacattcaaattcagatctttacctgtatgaacatacagattgccgggagtattcagattggtagttttggcagtaatgttatcgtctgccagtaaagcaagctgcttgccgcccttgatactgcctccgtttaagcggatatcggaggtaactgttgaagcttccaaagaaagcggtttgcctgcttcgatgtgtgcggtgtctttggcatctattacggcggaactgctgatggtgccgttggataatacggtaacatctgccccggtaatgcgtgtgttattgcctaattcggcgttgcctttgctggaactgtatacggtagtgccagtctgaatactggcctccttgatgacggtacggccgtcggccgacagagtagccgggcctttggcattgttcacattagttttgctctcaatcaccaaattatgaccagcatttaataccgtggtagctgggcgactgccgttattctgcaccacggctccgttacgcaagctgatatcttctcccgtctcaataaccaataagcctttgctctcgatccgaccaccattggagataaatgtgcctgccgctcctttttcggtggtttcgatggagagataagtcggtgaagcttcggtgccgtcggcagtggtggcgatgcggccgctgttttcaatgcggcctgacgaagtcacaatcaattgcttggccgcttcgagtgtgccggcatttttgacgcctacgcctttttcattggcaatcagtgtgatgctgtcggcgtacataccgcccagtgcggcagtatcaagggcaatagtcggtttcgtacccgctgccgtacctgcactgatttcgccgctggcgtaatctactttctgaggaccggtagaaaccgccaggtttttaccctgtaatttcccctgcaaagcaactgcacgagcaagtaccccggtgtagtcggctccgcctttatcattccaacctgctgctcctacggtcaatgtgccttgacgcacatcaaatcctgtcagtgcaccgtctttgccgatttggggcgcaccggtagttaagatgccccgaccgacatttttaaagccgccgccattaacggtaatgccgttggggttggcaataatcacgtcggccttttgaccgcctacggtaacgatgccgttgagtttgctagccgtaccgcgtacctcgttcaaaatcaattgcgcactgcctttgaccacaaacggattattgttacggtcgttgtttaacactgcccctttgttgtcaacatcaaactgcgtatagcggttgtggctcaatccgcgtccattcggagtttggatattcaccaagggggcaccagtgttggttttaaggataacgacctgctggtttttaggtgctgatttgtcggtggtaatttgggcatgggcaggcaataccatactcagggaaaccaaagagcagaccaaagttttaagggtggttttgagtttgccgcaaaggtcgcctgaagttttcagtgaaacagaaaccgaactgcctgcctgtttacctttgccctggctgttggcagtttcggctactgcaaccatggtgctgtgctttttactaaagataatgcgatgtaaacctttattcatgtctattccattttgaagatgaacgtactgcgcgccaagtacgtaggtaaagtttgacggtctgaggataaggaaagaccgtctaaatatcagtaaaaaattcagaggttagaaactgtaattcaagttgaagccgtaaacggtgttggtcgtctgaaagcctttgggtttatgaagcggcttgccggcaaacagatcataagcaaacataccgcctactttatgccctcctctgaagccgaccactgcacccatcagctgcttgcccgatacatattgtgcactttcgccagatacgcggccatagtccgcaccgagatagaactgatggttcggatgaaaataccaagttaaagtattctgccagtagaaacctcgctctccgaaaagactctgctccccatcaaatccgcgaacggtgtagcggctgccgattgacaatttatcttgggcaaccaacggcgttttgttccattgagcttgaatggcggttgcgtagaaaaactgctgtttgcctaaaataaatggggcggctgcgtccaaactggcagtaatgattttcatacgagatgtacctggaagaatatcgccgccgttttcttccggtgcaggcatactttggcgcatgccggtcccgcgtttgtaagacaacttgccgtcaagctgccaacggttgaggtaagcacggtggcgcaattcggcttcccagcctgcagagcggcggcgttgtacttcgatttcggcatcgtcgatgtatttataggtttggcgtgtccataatttcattccgactgaagttttatgaagtctgttacgccaaagcatgcgctcggcggccaggctgctctgatattgtttgccgttgtaatcgtaattgacggaatagccttcggttgcttcgtggtaacgatgtccattgtgattaaaagaaaacagccatttttttacgggcaccgaataatgcacgctgtaacttctggatccgctttcagtttccgtaccggtggcatcagtcaagtccgttttgtgcgccaaaccgcgtccatatgaaacataaaacaaatcgcttaagcccaaagggttatcgaacgataaagcgacatttccttgatatttgccggtcgttttgccgcccgcatcatctataccgatactgaaccgtatgggtttattctgctgccatttgatctgtaaatcgcttttgccttcttcttcggacggtataatctgaatatctgttttaacactcggcaaacgacgcaggttttccaagccctgctctacatcgcgaagattgagaattttgttcctatataagggaaatttgttattgaatgcactaatactgccctcggcagacttcccatcccgtttttcttcatagcggatatcccctatttcgcctgctgatacccgtaatttcagaattcccgaatccatattctgtggttggataatagcttgggaagtgaggtagccacgcacgatcagtatctgttgcgcggctttttgtagcctgctcaaattattggaacctaaacacatcccagttttaaaagctgtttctttcatgagcacagaaggaagaaaagaaaatttgcgcaccgtcttatcatctaaactaatgtaatttacccgagtacacggtgtttcatcttcactcaggacataattgttcttctccaatggttgctcgaaacggacatttgcatcagttaacaattcagcatctatgtgctgctgacgctgcatggaacggataagttctgcatcgttttcatcggcagctaaggttttaaggggtatgacagccaggataaccaacagacatggagcaggaaaaaatttcatgacatcaatattattttagcaatatttactattttgtcataaatttaaaagtatttacagttatagaatgagacctttgcaaaattccccaaaattcccaccaagacatttaggggattttggggaattttgcaaaggtctcggacagtattttgaacgcagtgcgcgtaaattcgtatggaaaccatgaaatcccgccacagccgccagacatgccaagccgcattctgatatttctgtttgcaggataacaggcagctttttctttaagcccaaagacaggttttgcagatggggcatagatttcctttttgaaaaatagggattaggaagttggatgtattttagaaaggccgcctgaaaaggtttcagacgaccttttgcgactagctgctattttatttaaagcttttctctaacaaacgagctaatatttttcctgtaataaaacagataaaaaacagcatccaatacgtcagattggaaaaatcggtcgtatagagaatcaacatataaagaagcagcatgatgccgagtgcgatgaattgataatgtttggcaaacatcatgacctcctcaactattaaggcaaaccgcctgaatattctcgttcaatcgtttcggcaatttccctataacgtcgataccatgaccagtcgaaattttcaatggcatggctcgcaaacgtaccaaattcaggcatccctatgcggctacctgctaaagctccgattgtagctccccaaccaggcggattactgaacgtattgtttggcaatcctaaagatttatcaggatttcccgtatcgttaagccctgcagattcgcaaatttcgcaataatatgagctttgttgcgcattacctgagcctccgacccaagtcatttcatgaacacatatagtggattaaatttaaatcaggacaaggcgacgaagccgcagacagtacaaatggtacggcaaggcgaggcaacgctgtactggtttaaatttaatccactataaaactctcattttgaaactccttgtatcgttaatcaaacaatcaaaagggcagatgccctatccttgcttttacaaacggagtgcctgtaaaaggggatggtttcaggcagttttgaagtttgtgtttttatatattgtcttctggtcgtctgaaaaggtttcagacaacttctttatctttacagcctcaagtcttacagtttgcccgacatactataaatcagctccaatacccattcgtacaatcaccgtttctcgtgtaggatgtctgcttccaacgtcatgccgatttgcagcggtttttcctcaccgtatgcagtgatggttgatttgtcgggttttattttcacaagataaacaggttcgttgctcttcgccaaatcggaggataccatgcccaatcccgacaattcctgtctgcccagtgccgtttttgctactgatacgacactgccggaagcaagcccgaatttttgatagggatatgcctgataacgtaggacaaccttgtctttcggcttgataaagcctgctgcactgctggggatatatagatgggcatatagctcggtacgttcgggaacaatgctcaagagcagtttggaaggatcaacctgctgtccgacttcgacgttcggtattgctatataacccgaccgtcctgcacggatgatttgttcagagcgcatttcaaaatccaaaacttcttgagaaatatcggcaatggtgcgttcaagccagctttgttctgtctcatgccgcttgggggaggctggccaatgtcagattctgcgtgcggatttcctgaagcagcccgacttcttctcggcggtaggcatcaagtttggctttctgctctaaaagctctgccttgacattcatcatttcttgttttggcactgcatcattggcggataggaaacgatatttctgcaacatttcttccgcaagtctaatgcgccttttctgaccgtctatctgttgcgaaatatggagttcctggttttccaaacgttcgacagttgctttaaggctgcgcgtttcattcccgtgtatcagcttcagacgacccagttcctgttctgccaacgttttcttcaaaactgcctccgttttcaactgctgctgcacgctacctcctgcgccgaaacgtgaggtcgaaagcgcaaatagcttgtcgccagccttaaccttttctccatcttccacgaatttcgctgtaattgtccccgtatccggtgcatacaccctgattacgcccgatgcaggtaaaatttgtccctccactgttgtctttcgcgtatagttaccaaatatcaaaaacaggataatcaataacgcagatatcgatgcaaatgtcgtccatagggaaaatgacaacggtcgtgtcagaatcactttacccgtcaggctggtttggcgggcaacggcgacttcgggacggaagaagggttgcttgggtctattcataaaattgaagttaagaaagtttcagacgacccctagagattgtctggacgatgagaaatatcagcagtaatctgtaccgtcagtgtagccgtttcctgatttatctgcttttgttgcgggagcagttaatccatgttcaatctcaaagattggtcttccgttataaggaggtgcattaacggcatcatttacccaattacgagtcacattgtatacaccatttgcaccagcagcaccgtaagcatttttcggcagataataaactgccgctgcggcagcaggtattgcaaccaaatccccccatgtgggacctcctttggttgtggcagcattagctacatttccagctatattgtctgttacaggacctccccctgaaaccagcttcaattcatgaagttgaagttcaatcatttttatactccttttcttggttggtattcctaaaaattcggctaacaaaaacatatggcagatatattgaaaaaaaattcaaagtaccctgaataaaattcaaattccaactatatttgttaatgtagtcgagaagaaacatatctgataaaaaatatagcacttgataacaagctattactaatattacgaaaaatgtaaattgcttccagtttttcatagaatccctcacaaaatttccagaaaatctaactctatcaactgataaatcaacttcctaacttcttcatattttccctgattgaagttaaccagtagatttttcaacaataacggttcattcttaccgatgtgttctaacacttttttccccaactcatctacgcttatcttcatcccattcccaatcaaatatcccttttccaacgtatccaaattattggcatttaatctcaacctgacgtcgtctgaaagcggagtagcgttgggattcgcgaactgttcgagatgaaaagcggtatcggtacgttctttgccgagaaagtcttcactgaaggcttcataattgacggggtcggcaatcatggcagcaatttgtgcggcagtatcgttgatacgcgtcctatcttgctcccagtctgagaaactgtggcgcagactttctatggtgggaaatttcttcattagccactcgaggtaattatagccgttgggtggaaaggtaccgacagcgaagtggaaggtttcacagccgagcgggataggtctgtgccaccaaccgcgtgggatgtagaggacatcacctgcttcaaggataatatccatatcgatatgttcaggaatggaaatatcagtatctttagtctgttgcatatacaatggcatagggaaatcaggggcagtaagttgccaacgtttcttgccgaaaagctggatggcatacacatcgcgggggtcccaatggtttttataagattcgtcgctgccaaaagcaagatatccactaacaatagtatgtgcgccggcaaagcgggcgacttgacgggcgatatggtctgaaaacggctcgttgttaatatggttatagactaacgacgcaccattcttcatatgttcgtagataacggatttaataaaacggtagcgagttttgcccaaatcgtcgaaactttcgacgtattcttctttaggaacgattgcgccttttttacgcagatgaaacagcggtgcggttgggtctgctcgttggtatatctcgttgatatctttccaagatgcggattcgagattccgaaccgctcctttaaagagcttgggcttttgatacagataagtctgtcggaacgttttaggactaatgccgaagtcgagatggatgctcattacttccccttactcagaaaatatttaaaatttataatgttacatatatttacaaatattaaagtttttttttgtgtgtgcgtcaaggaattgttgacaattttagttaaaaatttgtctccaaacggaaaaaagcggtttgttttttgttgttaacatttttattgtaattaaataaaaggtcgtctgaaaacggttttcagacgaccttttgctataatcgggcttcatcgccccgttcggtttggaaccttatgaaaaccctcgtcctcctcctgctttccttctccacgaccaccgctttcgccgcatacggtttgggtttggggcaggcaccgaaatatcctgccggctttcgcgcctacggttatgtttattccggacggcagggctaggttttaaaaacagaggcggatgccattaaattagacacgcttttcaaacgctttgtgtaccgtccttccgccgccaatcaaaaccccgtcggacagcgttcggacggcatacccgccaaccacacaaaggaaaaaccatgagtaaaaaaatcaaagtcggcattgtcggcgcgacgggctacaccggcgtggaactgctgcgcctgcttgccgcccatcccgatgtcgaagtcgccgccgtaaccagccgcagcgaagcgggaaccgcagttgccgattactttccgagtttgcgcggcgtgtacggcctcgccttccaaacgcccgacgaggcaggtttggaacaatgcgacatcgtcttcttcgccacgcccaacggcatcgccatgaaagacgcgccgcgcctgattgaacagggcgtgcgcgtcatcgacctttccgccgacttccgcatacgggacattccgacctgggaacactggtacggcatgacccacgccgcccccgacctcgtttcccaagccgtgtacggattgagcgaactcaaccgcgaagccgtcgcacaggcgcgcctcgtcgccaaccccggctgctacccgacctgcgtatccctaccgctcgtgccgctgttgcggcaatgccgtctgaagcccggtatgccgctgattgccgactgcaaatccggtgtgtccggcgcgggcaggaaaggcaatgtcggttcgctgttgtgcgaagccggcgacaacttcaaagcctacggcatagccggacaccgccacctgcccgaaatcaggcagaccatcgccgggcttcaggacggcatcgccgaaggattcgtgttcacgccgcacctcgcgccaatgatacgcggtatgcacgccaccgtttacctccacctttcagacggcagcgaccccgaaaccgtcctgcgcgactactaccgcgacagcccgttcgtggacatcctgccgaccggttccgcccccgaaacccgcagcgtgcgcggcgcaaacctctgccgcatcagcatccaacaggcggcgcaatccgatgtgtgggtcgtcctttccgtcatcgacaacctcgtcaaaggcgcggcgggtcaggcagtccaaaatatgaacattatgttcggactggaggaaacacacggcttggacgcaatccccctgctcccctgaagcgcaaacagcaaaccgcaggcatcgtgcctgcggtttttgatgccgtctgaaagcgacgtttttttgggttcggacggcttttgacccatccattcacacgaaaacaaaaatctaaaataccgtcattcccgcaaaagcgggaatctagtttatccagcttcagcaatttccgacacatttccacacgcttcgattccgtcatttctccggtttcagtcattgccgataacaccgtggtttttcatttctagattcccgcctgcgcgggaatgacggcggagggcttgccgtttttcccggtaaatacctgcaatttaaaatcccatcattgccgtgaaaacaaaccaaaaacctaaaatcccatcattgccgcgaaaacaaaccaaaaacctaaaatcccgtcattcccgcaaaagcgggaatctagtttatccggcttcagcgatttccgacacatttccgtacgcttcaatttcgtcatttctccggtttcagtcattgccgataacaccgtggtttttcatttctagattcccgcctgcgcgggaatgacggcggagggcttgccgtttttcccggtaaatacctgcaatttaaaatcccatcattgccgtgaaaacaaaccaaaaacctaaaatcccgtcattcccgcaaaagcgggaatctagtttatccggcttcagcgatttccgacacatttccgcacgcttcaatttcgtcatttctccggtttcagtcattgccgataacaccgtggttttttatttctagattcccgcctgcgcgggaatgacggcggagggcttgccgtttttcctggtaagtctctgcggcttctcattgccggtttccgcctacttgggaatgacgtgatttaaaatcatgaaaatgtgtcaaaaataatatagtggattaacaaaaaccagtacggcgttgcctcgccttgtcgtactatctgtactgtctgcggcttcgtcgccttgtcctgatttttgttaatccactataaaaatcagatttccgttacacttttttccaatatttcagacggcattttgctcacacgcccaaatacccttccctgccggaaagccaccttgccaaatgcgcttcgacgatttcggggttttgttcaatcagcatcggggcggtttcgcgcgcttgttccaagaggtgcaggtcttcttcgagcttggcgaaacgcagcataggcacgccgctttggcgcgcgccgagaaattcgccggggccgcggatgttgaggtcttggcgggcgatttcaaagccgtcggtgtgttcgtagatgactttcagccgcgctttggcgagttcgcccaagggttcggcaaacaggaggacgcacacgctttctgccgcgccgcgcccgacccgaccgcgtaattggtgcagctgcgccaagcccatgcgctcggcgtgttcgatgaccatcagggcggcattgggcacatctacgccgacttcgatgacggtggtggcgaccaagacgttcagcccccccgaagaaaaccgcgccatcacttcggccttttcggcggccttcatgcgcccgtgtaccagtccgatattgagttcgggcaatgccgtctgaagccgggcgagggtttcggcggcggtttgcagttgcagggtttcgctttcttcaatcaatgggcagacccaatacgcctgccgcccttttcggcaagtgccgaggacgaagccttcgacttcggcgcggcggacgttgttgacgaggcgcgttttaatcggtgtgcgcccgggcggcaattcgtcgatgacggacacgtccaaatcggcgaaaaaactcatcgcaagcgtgcgcgggatgggcgtggcggacatcatcagctgatggacttcgcgccctttgtttttgagggcgaggcgttgggcaacgccgaaacggtgctgttcgtccacaatggtcaagcccaaattgtgaaacgccacgccgtctgaaaacagggcgtgcgtgccgacggcgattttgacgctgccgtcggcgagtttggctttggcttcgtctttggcttttttacgcaaactgccaaaaaggcggacaacttcaatgcccaaaggttcgagccattgtttaaatttaataaaatgttgttcggcaaggatttcagtgggcgccattacagccacctgcgcaccggattcgatagccgtcaaagcagacaaagcagccacaatggttttgccgctgccgacatcgccctgcagcaggcggtgcatcgggtaggtttgcgccatatcgcggcagatttcggaaacaactttttcttgcgcatcggtcagggcaaacggcagggcttggcgcagggcttgggtcaatgtgccgtcgccgcccaatgccgccgccgtgccgccgatacgcttctgtcgcgccaagcgcatcgaaagctgttgcgccaaaagttcatcgaatttgagccgttgccatgcaggcagcgtgccgtctgaaagctgatgaatcgtgaaactcggcggcggcgaatgcaaaagacgcaggctttcggcgaggtgtggcagcttcagacggcacagcagggcatcgggcagcgtgtcgtgcagcggcgtaacgtccaacgccgtctgaataatacggcgcaaagtgggctggttcaaaccgtttacggtcgggtaaaccggcgtgaggctttccgccaaaccgccgccctcggcatcgcggattttgggatgaatcatctcgtcgccgtaaaagccgtgtttgatttcgcccacggcgcggatgcgtttgccgaccgccgtctgtttctgatggctggcgtaaaagtggatgaagcgcagaaaaaggacgctgccggagccgtcggcgatttggacaatcagctgcttgcgcggtttgaacgttacttcctgatggataacctccccctcgacctgacacggcacgccaatcggcgcgtccttaatcggcataatgtgcgtctcgtcctcgtaacgcagcggcaggtgcaacaccaaatcccacgcggtatggaggttgagtttgtcgagcttcttggcggaaacatcggtgattttgagctgttttcgggtttcgggcgacatcataggcagattcctttggacgcgcctattttatccgaaaacaaaaatgccgtctgaaacggattcagacggcatcgacaggcaggaatcaagccccggcggcttcggcttcctgctgttgttggtaaatcgcctcaaaattaatcggcgcgagcaggacgggcgggaagccggcgcgcgttaccgtaccggaaacggcttcgcgcgcgtaagggaagaggatgttcggacacgccacgccgagcagcaggtcggcatcttcttcggggatgttttccaaacggaaaataccgctttgggttacttcgttcaaaaacatcgtgcgctcgttatccaatttggcggttacggtaacggttacatccacgttgtagtagccgtcttccagcttttggctgccggtggaaacgcgcatctccacttcgggctcgccctgttccaaaaagatttgcggcgcgtgcggcacttccaaagacaagtctttgacatacagtcgctcgatgctgaatacgggttgcagttcttcgctcattttgttttcctagttgggggttaagggttcagcagtccgtccagcccgccttcctgctggaggcggtagaggtcggtaaatccgccgacgtgcgtttcgccgatgaaaatctgcggcacgctgcgctgtcccgaaagctgctgcatttcggcaaaggcttcggggcttgcatcgacacggatttcgtcgatatgtccgacacctgccgcgtgcagcagccttttcgccatcgcgcagtaggggcaaaacggacctgtgtacatggtaacggtctgcatattgggtttccgaaagttttgcaatgataatcaatataggggcatttcccctgtttggcaagtgcggaacagatgcacgttcaaacggcatgtgcggaatgtgtcaaagtttcttttttaaagtatgatagacattgtgaaaaatatttttgcacccgcgctgcgcggcggaacggatgcaaaatatttttattacattttcaggaaaaaccatgttgtcaggactccccatccccaaagacatcgcgcgcccgcccgaaacgatattggtcaacatcacgccgcagaaacgcgcgtagcggtgttggaggaaaacaatatctgcgagctgcacatcgagcgcaacagcgaacacagcctagtcggcaatatctatttgggcgtggtgcgccgcgtgctgcctgggatgcagagcgcgtttatcgacatcggcttggaacgcgcggcgtttttacacatcgtcgatgtcctcgaacaacgccgcaaccccgaagaaacccagcgcatcgaacatatgctgtttgaagggcagtctgttttggtgcaggtcatcaaagacccgatcaacaccaaaggcgcgcggctttccacccaaatctcgctggcggggcgtttcctcgtccatcttccgcaagaagaccacatcggcgtgtcccaacgcatcgaagacgatgccgaacgcagcagcctgcgcgaacgcctcgacaagctcctgccggaaaatgcctgccggggctacatcatccgcaccaacgccgaaaacgccaccgacgaacagctccagtccgacatcgactacctgaccaaagtgtgggaacacatccaagaacaggcgaaaatccggccgcccgaaaccctgctttatcaggatttgcctttaagcctgcgcgtgttgcgcgatatggtcggctgcgacacgcaaaaaatcctcgtcgattccaccgtaaaccacgggcgcatgacgcgttttgccgaacaatacgtccacggcgcattgggcaggatagagctgttcaaaggcgaacgcccgctgtttgaaacccacaacgtcgaacaggaaatcagccgcgccctgcaaccgcgcgtcaacctcaacttcggcagctacctgattatcgaatccaccgaagccatgaccacgatagacgtgaacaccggcggcttcgtcggcgcacgcaacttcgacgaaaccatcttccgcaccaacctcgaagcctgccacaccatcgcccgcgaattgaggctacgcaacctcggcggcatcatcatcatcgacttcatcgatatggcacaggaaagccaccgcgaagccgtgttgcaggagcttgccaaagccctcgccttcgaccgtacccgcgttaccctgcacggttttaccagcctagggctggtcgagctgacgcgcaaacgctcgcgcgaaaacttaaaccaagtcctctgcgaaccctgcccttcctgccaaggcagaggccgtctgaaaacgccgcaaaccgtatgctacgaaatccagcgcgaaatcgtccgcgaagcgcgccgttacgatgccgaaagtttccgcatcctcgccgcccccaacgtcatcgatttgtttttggacgaagaatcgcaatccttggcaatgctgatagatttcatcggcaaaccgatttctctggcggtcgaaaccgcttacacgcaggaacaatacgacatcgttttgatgtaaaaaatgccgtctgaagccttcagacggcatctgtctatttcagggtttccttgtccaacaacgcgcgtatcagcagaccgcgtccgaaacgtcggctgtcggacaattccaaatatccgccgtattttttggcaagcgtgtcggcgatggacagacccagccccgtcccctgctgctccgttcccaaaatacggtaaaacggatcgaggacacgggcgcgttcggattcgggaatgcctttcccgttatcttccacccacacggcaagatatttcccttcgtccgtgaaacccaaatctatcctgccttcgggcggcgtataacgtaccgcgttgtcggcaaaggttttaatcagcgtatagatttccgtttcgtcggcagacacttcgacatcgcctccgaccgccacgccgatgtcctgacatttttccaaagccagcggcatcagttcctgcaacacttggcggaaacggctttgcagaccgaatgtcgttttcgtcagagggatttcatccgactgcgaacgcgccaatgccaaaagctgttcgagcaggtgtttgttacgccgtatgctttgctgcaaaacggcaggctgccgcgccgcatcgggtgggagcggcatattgttgagccgttccgcctgaaggggaagggcggtcatcggcgtacgcaattcgtgtgccgcgtcggcgacaaaccgctgacggtggcggatgtcttcatccgcacgtttcaaaagcaggttgatggcggttacgaaacctctgatttcactgggaatattgtccacactcaaagcagacaggtcattgattcggcgttgttcgagactttgcgacaatttgcggacggggcgcatggctttgtgcgtaatccacacggtcagcaaaatcatcagcggcagtgccgccaacaggggcaacacgctttgccgtgccgcatccgccgccaaatcttcacggtattcgttttcctgcataacggcaatccgtccctgctcggtcgtgcggatatagacgcggtaataatcgtcgtcatcgtccgcctgaagcgtgtgcagaccgtccgccagatgcgcaggcaggctgacaacagggtcttcctgctgcggcatctgtaccaaaatacgcgtatcgccgtcgccctcgggcaaagtttcgggtttggaatcgggggcgacgtacaatgccgcctgacggagcaggtcgtcctgcaacgcttccgtttcgtggaaggtttcgtagtaggaaaacatacctgcaagcattgccagcggaacaaacatccaaaccgtcccgccccggcaaacccaaatccagcagcatcaagtcataaggctgggcagcggcagccgcgcgccgtttttgacccaatccaccgcatagccgccgtctttcaaacttgccgacaccgcctccgcaatcatcgcatcgtcttccaccagcaaaacacgcatcaactttcccttcaaaataaaccgtgcctattctaacaccccaaaattagccgcaatttagcggtctttacgcttgccggtatttttcaaaactgcagcacaaaaaaaccgcgccggcaactgccttcagacggcattggggcgcgattgcaacacacgggcaggcaggcagagcctgcgacagaccacaggaacgattcaggcttcagacggcttcgccgtttacggcagaggcacgattcctgccgctatcgaactggccaatatcgccagcgacaaaccccacgcccagaaaaacgaataacggatgtgtttgcccatcgacaatttcgccaaacccaagcccatccacaaagccggcgaaagcggcgtaacaaaagtgccgacgatactgccgatcaacatcgcataacctgctgcttcgggcgccacgcccgcctgcgaggtaatctgctccacaatcggaaacagtccgaaataataagcgtccgtactcaaaaccaactcaagcggaatgcccaacacaccgatggcaatatgcagataaggcagcagcgcgtccggcaggatatgcacaatgtctttggaaatcgcgtccaacatccccgcacccttcaaaatccccaaaaacgtacctgccgccaaaataatggacgccatcatcaccgcgccgccggcgtgggcataaatccgctccatctgttcctgcgggctgcggtaattcaaaagcaacgccgccgttgcagccagcataaatacataacccggtgggaagatgcccgaaaaaagcaggctcatcgccgccaaaaacagcaggacattccaccaaaacagtttcggacgcgccaatttttgttcttcttccgacaaaggcaccggctttatcaaatccgccacggcgggcaacgcgcccaactcccggacaatccgccttttttcacgcacacccaaaagcagggacagcgcaaggataaacaccacaccgataatttgcaccgtcaacaaaggtttatacaattcgcccacatctgcgcccaacacgcttgcaacccgcccggtcggcccgccccacggcagaaggttaatcaatcccgcactggaagtcagcagcaaaaacagcaggtaaggattcatatgcagacgcttgtaaagcggcaaaagggcggggacgaccaataaaaacgtcgtcgcacccgccccgtccaactgcgccaccaccgacaccaagaccgtccccacactcactgccacgatattaccccgagtcagcttaatcaaaccgcctatcatcggacggaacagccccacatcgttcatgattccaaaaaacaaaatggaaaacataaacataatcacaatctgcatcaccgatttggtgccgcccgaataaaattcttttaattgggatacatcaaaccccgccagcaacgccccaaacagcggcaccaagattaatgcgatgatgggcgacactttttccgtcagcagcagccatacgatgaccccgataatcagcagtccgataaacgtcagcatcatttctcctttattttattttaaacagaaaaccgaccgtgcaggcaaaaccgcccacagacgcgggataagccctgcattctacttttttattttgaaacaagtcaatcggtcatttcctcccatttacgcctgccgccattcctgcatccgtccgtcatttcacagcggcaaccgatacggaacaaccggtaaatcggtatcgggacggcgcgggggcattcatcccggtgcgccgattcaaacgaaaccgcccctatcattgcggagcgcggggcgtgccgtacacgcgggattttatagtggatgaacaaaaatcaggacaaggcggcgagccgcagacagtacaaatagtacggaaccgattcacttggtgcttcagcaccttagagaatcgttctctttgagctaaggcgaggcaacgccgtactggtttttgttaatccgctataaacacgccggtcatttgccgcgcattatccggcaaacggcaaaccttgacgctgcccagcccatataaaaaagccgcaaaacccgaaccggttttgcggcctttcgacttggtttgtttatttggcatttctttcaatcaaaccgacaaactgattaatatatgactgaacaaaatcccttgccgagtcaatcaatttgccgttttcatcaaacagcgtcggcgaattgcccaaaaacacttccggctgtccggttacgggcatatcgaaataagacagcgcaaggcgcaggtttttttgggaactgtaaccgcccatcttgccgacggaatggctgatgatgcctgccggtttgtttttccacgccacgtcggcattcggtttcgagccgatgtccaccgcatttttcaaacaggcgggaatggtgcggttattttcggacgtaacgaacaaaatgccgtccgaagccttaatcgtttcgcggaaagccgtgtagctttcgggtagcggcacatcttccaccgcagggtcgtcataatcgaaattgtaaagcggcagatgtccgatttcaacgatttccgcctgccagccttcggggaacatctccgccgcattcaatgccactttgcgcgcaaaagaagcacggcgcaggctgcccaccaaaatactgattttcttagccataatcattcctcctgaatattaagtttgtgcgtctcaatcatttcataatgatagcgattattatatatgtgatttcccctgcaaacaagccggcccgccgccacagcgttcccacttatccggctttgccttataattgctttttttatgtaacagatttacctatgaatttccccaaaacagcggcctccctgctgctgcttctcgcctccctcgccgcacacgcgctcgataccggccgcattccgcaaaacgaaatcgccgtatatgtccaagagcttgacagcggaaaagtcatcattgaccaccgctcggatgtccccgtcaaccccgcctccacaatgaaactcgttaccgcgtttgccgccttcaaaaccttcggcagcaattaccgctgggcgaccgagtttaaaagcaacggtacggtaaacgacggcacgcttgacggaaacctatattgggcgggcagcggcgaccccgttttcaatcaggaaaacctgcttgatgctcaaaaacagttgcgcgaacaaggcatactcaatatcacgggacacctgatgctcgaccacagcctgtggggcgaagtcggcagccccgacgatttcgaagccgacagcggttcgccgtttatgacgccccccaatccaactatgctgtctgccggtatggttatggtgcgcgccgaacgcaatgccgccggcagtaccgacatcctcaccgatccgcctttgccgcatattttcgcccaaaacaacttgaaaattaccgcctcccaagctgcctgcccttcgatcaaaaaactgatgcgtgcatctttttcggacaatacgctgaaattgcgcggcaatattcccgagagctgtttgggcaagcctgtcggtgtccggatgttcgcgcttgacgaactgatccggcaaagttttaccaaccactggctgctcggcggcggacggatttcagacggtatcggcatagccgacacgccggaaggcgcgcagacacttgccgttgcacacgccaaaccgatgaaagaaattttgacggacatgaacaagcgttcggacaatctaattgcgcgttccgtcttcctcaaactcggcggcgacggcaaactgcccgccgtttccgaacaggcggcgtctgccgtccggcgcgaacttgccgtatcgggcatcgatgttgcggatttggttttggaaaacggttcgggcctgtccagaaaagaaagggtaacggcgagaatgatggcgcaaatgttggaaacggcttatttcagcccgtttgcacaagatttcatcgacacgctacccatcgccggcacagacggaactttacgcaaccgcttcaaacaaagcggcgggctgttgcgcttaaaaaccggcacgctcaacaatgtccgcgcccttgcaggttattggctgggcgacaaaccgatggcggtggtcgtcatcatcaacagcggccgcgccgtttccctgctgccagacttggacaacttcgttgccaacaacatcatctccggcggcgatggctggctggatgcgaaactgatgtgcaaagaacgccgagcctgaaacaggaaaatatagtggattaaatttaaggggctgtcctagataactaggacaaactcgattttactaattgttttaaaatggaacaagaacttttatctcactgttgttaaaacgccattcgcactcctttaaatacagctcaaaatgcgctttgggaatgccgttaaacttgcgtaaatgacgttttgcctgattccaaaagttctcaattccattaatatggttttgtcgttcggcaaaatgtgtgctgtgattgatacgaaaacgaagtttcagcgaagctaaaatggctaaattcgcgcacatctaatacatcatagctacgataacaatccgtataaacaatactgtcaggtttcacttgttcacggataataggaaataaagtagcggtttgagtattcggtactgtaaccgtataaaccttaccatttcgcttcaaaagaccgaatacggcgactttaccggcagcaccgcgaccgcgtttgcctttgcgttgtccgccaaaataactttcatctgcttctacttcgccatcaaacatttccaaatgcggactgttttgataaataagtaatcgtaaacgatgaaaataataggctgcggtatttttattaacgcctactaactctgctgccgttcttgcagttacacctgcgacaaacagttcaatgagtttattttgtttataccggcttagacgactttttctcataggggcaactctaacttaatttgaatttccctagttatctaggacagccccaaatttaaaccagtacggcgttgcctcaccttagctcaaagagaacgattctctaaggtgctgaagcaccaagtgaatcggttccgtactatctgtactgtctgcggcttcgtcgccttgtcctgatttttgttaatccactatataaaaatgccgtctgaactgttcagacggcatttttgattttcaaaccggaattacagccccgctgccgccctcaatgcagcagctttgtcggtgcgctcccaagtgaactcaggttcttcgcggccgaaatgtccgtaagcggcggatttactgtaaatcgggcgcaagagatcgagcatttggacgatgcctttggggcgcaggtcgaaatgttcgcgaactaaggcaatcagtttttcttcgctgattttgccggtgccgaaagtatcgatggaaatcgaagtcggttcggcaacgccgatggcgtaggaaacttggatttggcattgggttgccaaacctgcggcgacgatgttttttgcgacatagcggcaggcgtaagcggcggaacggtccactttggacgggtctttgccggagaatgcgccgccgccgtgcggagccgcgccgccgtaggtatcgacgatgattttacggccggtcaaaccgcagtcgccttgcgggccgccgataacgaagcggccggtcgggttgatcaggtatttggtttcgtcggtcagcagttcagacggcagaaccggtttgatgatgtgttcgattacggcgtttttcagctcttcgtaagcgatggacggatcgtgctgggtagacaggacgacggtgtcgatgcgttttactttgccggtttcgctgtcgtaaaccacggtcagttgggctttggcatcaggacgcagccaaggcaggcggccgtctttgcgcaattcgctttgacgctgcatcaggcggtggctgtaatagatggcaaacggcatcagggtaggggtttcgtcacaggcatagccgaacatcaaaccttggtcgcccgcgccctggttcaagtcgatgccttcgccttcgttcacgccttgggcgatgtcgggggattgctggtcgtagtacacgccgactgcgcagccgttggcatcaaagcccagctcggaggagttgtagccgatgcgtttgatggtttcgcgtgcgactttgatgtagtctacttgggcggtggtggtaatttcgcctgccaatacgcacaagcctgtgttgaccaaggtttctgcggcgacacgtgcttttgggtcttgcgccaagatggcatccaaaatcgcatcggatacttggtcggcaactttatccggatggccttcggataccgattcggaagtaaacagatattcgctcattgagattttccttgaaaaacaaaccatcttcttcagacggcatgttgtatgaacataatgtcgacagcgggaaatatagcaaaatttccctattcataccattcagttgagaaatattcccatttgaatagcactttggaatctctgcccgtacgtttcttacaggcaaaaaaattcccgcatcaagcgggtttggattgctctggtgagccacatcggcttttcaaccgtccaccttacttttccttttgaaaagcaggttggcatggaattcccaactcttaatgcagcacgcatcgtagcagaaaaggcatattgccgcaatacttccctttttcagacggcatgtttcgtttacaattcaggctgtttccccctttgcgaaccgccatgcacatcctgttgaccgccctgctcaaatgcctctccctgctgccgctttcctgtctgcacacgctgggaaaccggctcggacatctggcgttttaccttttaaaggaagaccgcgcgcgcatcgtcgccaatatgcggcaggcgggtttgaaccccgaccccaaaacggtcaaagccgtttttgcggaaacggcaaaaggcggtttggaacttgcccccgcgtttttcagaaaaccggaagacatagaaacaatgttcaaagcggtacacggctgggaacatgtgcagcaggctttggacaaacacgaagggctgctattcatcacgccgcacatcggcagctacgatttgggcggacgctacatcagccagcagcttccgttcccgctgaccgccatgtacaaaccgccgaaaatcaaagcgatagacaaaatcatgcaggcgggcagggttcgcggcaaaggaaaaaccgcgcctaccagcatacaaggggtcaaacaaatcatcaaagccctgcgttcgggcgaagcaaccatcgtcctgcccgaccacgtcccctcccctcaagaaggcggggaaggcgtatgggtggatttcttcggcaaacctgcctataccatgacgctggcggcaaaattggcacacgtcaaaggcgtgaaaaccctgtttttctgctgcgaacgcctgcctggcggacaaggtttcgatttgcacatccgccccgtccaaggggaattgaacggcgacaaagcccatgatgccgccgtgttcaaccgcaatgccgaatattggatacgccgttttccgacgcagtatctgtttatgtacaaccgctacaaaatgccgtaacgaaaataaaaatgccgtctgaacaatttcagacggcattttgtcatctgacgatttccgacagcggccagcgcggacggacattgaacgcaccgacctccctgcccttgcccaggtgcatcgcaccggcaaaggcaatcatggcaccgttgtccgtgcagtatgccgtcggcgggaaaaacacgctgactttttcggacggatgtttcggcttgcctttgggggtcgggatttgcaccgtcatgttgccgaaagtttcacggagcttgcggtttgcaccgaccccgccggcgaccactacggttctgaaccctgtctgcaacagggcttttttcactttcgccgccaacacatcgactaccgcatcttgaaacgcacggcagatgtcgttgcgtgtctgctcaggaatgtcatccgccccgttttccgcgcgcactttctcgacggcggtcaatacggcggttttcaaacctgaaaaactcatctgcaaatcgtcggaatgaatcatcgggcgcggaaaaacaaacgcttcgaacctgcccgattccgcaagttccgacagtttcgcaccgcccggatacagcaagcccagcagtttcgccgttttgtcgaatgcctcgcccgccgcatcatcgacgctctcgcccaaaagcgcgtagtcgcctatgcccctgaccgccataatctgcgtatgcccgcccgaaaccaacagcgcgacaaaaggaaagtcgggtttttcctccgccaacagcggcgacagcagatgtccttccaaatgatggacgggaataacaggcttgtccaacgctaaagccagcgcgttggcgtagctcgaacccgccagcagcgcgccgcccaaaccgggcccctgcgtaaaggcaaccgcgtcaatgtcgccatacgatgcgcctgcctgcgccagacagccttccgtcaacggaacaaggcggcggatatggtcgcggcttgccaattccggcacaaccccgccgtattcggcgtgcattgccatttgagtgtgcaggcagtgcgcccgcaatccacgttccgtatcgtaaagcgcaacacctgtttcgtcgcaagaagactcgattcctaataccaacatggtctgatgccgttaaaaactgaaaaacgtattttagcggatttcggcacgactgccgtatcccaaaaacggaacatgccgtctgaagaccgttcagacggcatcgtcgcaccgtatcaaagcgttccgtaagaatgcagcccgctcaaaaacatattcacgccgataaaggcaaatgcggttacgaacaaaccgataatcgcccaccacgccagcactttgccgcgccaaccggcaaccagccgcaagtgcagccaaacggcgtaattgagccagacgatgaacgcccacgtctctttcggatcccaactccaatagcgtccccaagcatctgccgcccacagcgcacccaaaatggtggcaatggtaaagaacagaaagccgacggcaatcgccttatacatcacctcgtcgatcaatgccgacggcggcagccacagttttccgccttttccttccgcacgcagggaaaccagttcggcaataccgagcatcgcggaaatgcaaaacgcgccgtaaccgataaagtttgccggaacgtggattttcatccaccaggactggagcgcgggaatcagcggctggatggtatgcgcctcgcgggacacgctgtaccacaagacaaatccaaccacgaccgccataaagccgaacacgaagccgcccaatttctgtatggcgaacttaccttcataataaagatacatcagcgcggtaatcaccaaaaacaggatgaacacttcatacaggttggaaaccggaatatgccccgcatcgggacggagcagatagctttcgtgccaacgtaccagcagaccggtaaagcctgctacggcagacacccatgcaaacacggttcccatacccaacagcgtgttggtcggcacattttttacgcttgccaaaaccgcgcccgaaatataggcgaacagggcgaaaaagacaaaggcgcactgccacatgatcgccgactggctgctgaggaaataccgcaacaggaaaatctctgccgatttgatgtcgcctccgtacaaaccgacggcggcataggcaagcaatacgcttaaaggaacaaaccagcgcatcggtttgaaaaaccaacccaaaaacacggcaataccggcacttgcccacaacatgaccgtttcgtaaatgtccatatgcataccggaacgggtctgtacgaaaaccgtagccgcaaaaaccagcacggcaaatacccaatcccaaagattcagattgctgatcaaagacttctgaatcagcagctcgtgttccggaagggttttatagtgttcagtcatgattcaagtccttgccgagccgttgcagactctcgacgtgttttggaaattccttctgcaaatcccgttcgctgcgggccgaagacatggcaaaacggattttgccgtctgaaaacaatacccacgcccgtttttcgcgcacataaaacatcaataccgtacccaataccaacagcaccgagccgagatagaccaaaagcgcacccggggaacgggtcatctgcaaacccgacgaacgcacctcggaaaacccatcaagttgcagcagcataggcgcgggatattcggtcaaacccgtgtacgcatccatactgtgcagcaggaaacgattccgcgcttcatcctgctgccattcgggcaagccgtaccggcgtatggtttcatccaaagcagcgttcatcacgccgtaaagcatttcgtagaaatagccctgcatcttatcctgctgctctttcgggatattggacgtaataaattcgtccaatcccaaatagcctttttgtgcaaagatgttcagcgtgttttccgcagccagcatgaattgttcgcggatttcggcaggtgcgcctttggttgcgtcggcaaccagacgtttgcgcccttccccatctttcaaaaactcacgcaatgccataaaggtgtccgctttcaactgcttgtccaaggggatacgcagccagcggtattgctgctgcaagccgctgcgcgtgccggtaatccaaaaataatcctgttcctgcaaaaccggcagcatatagtttttatattcgaccgcctgccctgccgcatcacggatacggtaaacaatggaagggccgatattggtgtattttttaccttcctgagtaacggcgcggacatcgttcagcgtggatttcaggcttttttcccgttccgcgccctcgctcatgtcctccacattcatagaagtgaactgatcgaactcaagacgatatttgtgtttgccaatttccaacggaaactggtgtatggatgttgccttcaacacgacaggctcgcgcgaagcatcacccaaattccacgccttgaatgtcaaatccgaaccgccgtcggcaaaactcgcctgataaatcgtgatgccgtgcaaggtcaaaggatggttcacgcggatggtgcgctcgagtttctcaccggttgccttgtccgtcacttcaatatcgctggcgaaatcacgcggcatacccgtattgtaaaaatcgatatggaattttttcagtttgacttcaaaaggcaagtcctgaaccaatatcccgttgtcggcattcaggaaaaccacatccgcactctgcccctcggaaatattgacgttgcccctaaatgagagattggacgcacccaaaatactttcgggcttgaaatccttggcataaaccgcctgattgtccggaacaatccgaccggtcagcatacccagtttcaacagcaggttactgtctatcaacccgcccaggcaaatgacaatcaaagcaacatgggcaaagatatagccccatttgttcattgtgccttttttggcggcaatcagaaccgacccgtcttcacggttaatggtttttccctgaaaaccttgtacttccagataacgtttggcaacctcgggcgcaatttttacatccaacagcgaagaatggcgcatcgccgccagagatttttctttaaccttttcccgaaaagacttcatttcgcgccagaacggcggcacattgcgaatcaggcacaaactggtagaaaccaccaaaaacatcatgataacgacaaaccatgccgaagcatagacgtcatacagtcccagaaaaccaaaaatctgcgcccaaaacgatccgaatttgaccaaataatccgtctgcggctggttttgctgcaacaccgtaccgataaccgatgcaatacccagcagactgagcaaagcgactgcaaagcgcatggagctgaaaaaagcgaaccacggacgggaaagaagtgggggagatctacgggatttactcattgtgtgtttattccgccatcaggaatatgggaaagcagaattgggcaaacagaaaacaacgtcccgattctactgtcttgatgctttttatttcaagacaatgaagacagcctgcatcgattccaacggttgcgattgaaaaaacttatcgcagaattgcctgaagccgtctgaaaacttttcagacggcctctaaaacagactattgcggaattaacgcaaaccttggataaagttggcgaccgctttcaaatcttcttcagacatacggtttgcaatatcttccatgatggtatttttacgctgaccggacttgtaggcattcatctgttcaacaatatatgcctgatgctgaccgcccaaacgcggataagcctgaatttcgcttccgcctcccggcatacccgcaccgctcggaccgtggcaggacatacacgccggcacttttttatcgctcaaaccgccgcgatagattttcgcacccaattcgggattttccttaggattggcttcaccggatttgggctgctgtttggcatagaatgcggatacgttcaaaatatcctgatcgctcaaattcattaccaccggtttcatcacagctgccgaaccgtgggtgcgtttaccgtcgcggatgccgatagtttgatgatagatgtaagcagtatgctgtgccgccaaacgcggatacatcgcaatgccgctgttaccgtctgctgcatggcaagccgcacaaaccgttgcggcaacctgtttgcctttttccacgtctgctttgggagaggcggaaaccgcaccggcagccaaaacaaaggccaataaagtcaatcgtttcatggagtgctcctgattacagcattggataacgcaacaatgctctttttatattcaaatacgggatttttgacccgattaaaaccgatgattctgtaaacgtgttattctatactaaatttacattaaattaccactgtgtttcacataaaaccaaccgcatatttttgctgtcggacaaacggcggcggaaaacaaggatatgcccatgaacctttttcaaaacgccaaattcttcacgacgatcaaccaccttaaagacctgcccgacacccctctcgaaattgcctttgtcggcaggagcaatgccggaaaatccagtgccatcaataccctgaccaaccatgtccgtcttgcctacgtttcaaaaacacccggacggacgcagcatatcaacttcttcgagctgcagaacggcaattttatggtcgatttgcccggctacggttatgcccaagtccccgaagcagtacgcgcacattgggtcaatctgctcggcgactatctgcaacagcgcaaacagcttatcgggctggttttgattatggatgcccgccatcctttaaaagaactcgacatccgtatgctggattttttccacacgaccggcagaccggttcacatcctgctgtcaaaagccgacaaattatccaaaaacgaacagataaaaaccctgtcccaagtcaaaaaactgctcaaaccttattccgacaggcaaaacatcagcgtacagctgttttccagcctgaaaaaacaaggtattgacgaggccaaccgaactgtcggaagctggttggacgcagcagatgccgccgcttcctctccagaggaaaactgaccccaattatacggaaaccgtattccccccacttgaccgaccgcaaacatttaaaaaattgccactgccaaatctaaaatgccgtctgaaaagtctttcagacggcattttgcggagtctttaaaacagagaatccaactgctgctgtttggaaccagtattactcggaagcaccggcgtttcctgcatatcttggcggacttcgtcatccgccgcctgccgtccgccttctgccgcgcccccgtcatcttcttttgcccgtcgggaaggttgcggcgcaataccgctgttgtccagcgtcaagcccggatcggttaccatacgttccttcatatagtattcgccattgctgctgaccacaccttcaggcattttcatccccttgccctgctttcctttcaacgcaaaacgcatatagtccacccaaaccggcaccgcaatcgtaccgccgtagccgacacgccccatactcttaggtttgtcgaagccgatatatacggcagtaaccacatcagggttaaaaccgacaaaccacgcatccttattgtcattggtcgtacccgttttaccggcaatatccgttcttcccaacgcagctgccccccttgccgtaccaacacggaccacatcctgcataatcttatacataatataggcattgcgcggatcgattgcctgaggcgcattttgcccagccaccaaaggttgcatttgggcgcgcaacctgccgtctctgtcataaatcttatcgattacgtgcgaagaaaccctatatccgccgttcgcaaatacgctatatgcctccgccactttcaacggcgttgtctcgcccgtacctaaagccatagacaggcttgccggcagctcggacgacctgaagccgaaacgccggatatactgttgcgcgtaaccgacaccgatagacatcaaaatacggatggaaaccatattcttggaagccgtcagagcctgtctcaaagtaatgtagccggaatatctgccgtctgaatttttaggtgtccaaaccgaaccgttcggccctttccccggcagggaaatcggcgcatcgttaaccactgtggacgcggtcatccccttagataatgccgccgaatagacaaacggcttaaaggtcgaacccggctgccgcattgcctgaacggcacgattgaatgttttgctgtgaaaatcataaccgccgaccagcgcgcgcacagctccggtttttgcatccagcgaaaccaaagccccctgcagcaacggctcttgaaccaccgcccaacgcccgccgttgtttttgacacggatgaccgcgcccctgcggatacggtcctcccccattttttcattattgaccgcgcgggccgcaaaacccaaggcgcgcctgtcaagcgtaacccgcctgccgccgggcagctgtatgacgacatttttctttttagtcacatccaacacaacggcgggaaccattttatcgacggtatagagtcccgacagatactggctgacagtctcctcgacatcttcactcttactcaaatcgatatagttttccgcaccgcggtagctgctgccgcgatcgaaattccgtagagccttgcgcaatgcctcggttgccaccttctgatgatcggcgcggaccgtggtataaaccttaaaaccctgcgtataggcatcttcaccgtatttctcatacagttcctgacgcaccatttccgccacatataacgcactctgatcgattttccgaacaaaccgctcgtaatgcagttcctcattcaacgcctgatcgcgctgttgcacggtaatcatcttctcctcgagcatattgttcaaaatatacttctggcgcaacttggcacgttctggattaacaatcggattataggcagacggagccttgggcagtcccgcaagcatggcggcttccgccaaagtcaaatctcggacattcttattgaaatagatttgcgcggcagatgcaaaaccataggcgcgctgaccgaggtaaatctgattgaaatacaactcgaggattttgtctttgcttaaagactgctcgattttataggcaagcaacacctcattgaatttgcgtgtgaacgttttttcactgctcaaataaaaatttttcgccacctgctgcgtaatcgtactcgcacccgactgcacgctgccggacacgacattgccgacggcagcgcgggcaacaccccaaacatccaccccccaatgccggtaaaagcgtttatcctcggcggcgataaccgcattccgcaacacctctgggaaatcgccgatttttgtaaattcgcgccgctgctccccatacataccgatgacttccccatccgccgaataaatagtcaacggcattttaggctggtaatgctgcaaagaatccaaagacggcagtttcggatacgttaccaaaatagcaatggcaaccaaacccactccaaatacacaaaacccaaaaaccaaaccaaaacaagtcgttaaaatctttttaatcatagctgaataataatttaccattattggtattaaataaagtaaaatagcaaccgatttctacaaagcacggtttcaatgtgcaaagaacaaggaatccattacggataccgaaacggttactcactgtacaaataaagcaggaactttcatcatgcgcttgtttaaaagcttgaaaaaccctaaaaaaacagatgccaagctccctaaaaaatcttcgggactcaataaccgcgcggcaatcggcatcgatatcgaccagcattccatcaaaatggtccaattgtcaggacgtagtttaaaccaaattcaattggaaaaatacgtcattgccaaattaccaaagaatatcattcaaggcaataaagtccaaaattacgatcaacttgttacatatttgcaacaagcctatgccaaactgggtacttcgtgcaaaaacatcatcgcgtccgtcccgcaaaatttggcaaccatcgaacaattgacctacacagacaaagatgcagaattagacctgcaggggttcgtggagtcctccatctccgaagtcagctcgatatcgctcgaagaagccaattacgactatcaggtcttgtcccaatcggccgccggcgaagctgtgttggccgtcgcatcgagaaaggatgaaatcgaacccctgattgacgcattcaacgccgccggtatgaaattatccgcgcttgatgtggacattttcggacaatacaacgcctacgcgctatggataaaccatttcgcccccgagcttgcagccgaaaaagtcgccattttcggcgtatatgccgcacagacctacgccttggtcatccaagacggaaaaatcctatacaaacaggaaacctccgtcagcgaagaacagctcaaccaactcatccagcgcacctatcaggtaacagaagaaaaagcggaagaaatcatcaactccccgcaaaaaccttccgattaccaagaaagcgtggcaaactatttcaaccagcagattacccaagaaatacaaagggtcttgcagttttattacaccacgcagaccgcagacgatatgaccgacatcaagcatatcctgctgaccggggaagcggcgcgccaggaaggcatcgcccaaaccgtcgcctcacaaaccaatgcagatgtacaatgcgtccatcccgcgcgttattttgcggacaacctcaaaacagacaaacaacaattcgaacttgatgcgccgacactgaccagggcgttcggtttggcggtacggggattataattatgaacaatttaatcaaaatcaacctcctcccctacagggaagagatgaacaagcgcaaacagcagcagtttaaaacgctgatgtacggtgccgtgctgacgggcgttgccgccgttgcggcaacctacctgtttatcgacaatatgatcaataaccagtcggaaagaaacacgctgctggaaacctccatcgcacacttggataccgagctgtcggaaatacaaaagctcaaacaggaaaaagatgccttcctgattaagaaaaacaaaatcgaggagctccagctcaaacgcctccaagccgcaaaaatcctcgacagcctgaatgaggccgtccccggaagcacctacctgacctcgctggatgccgttaccgccgactcttatcggctcagcggcaggacatccagcgacaaccgcgttgccgccatgatgagggcgatgcccaataccggcatattcaagcaacccgaattgttaagcatcaagaaaaacaattcgcatcaagaatttacccttcaggcaacattacaacccatcgtaaaggcggccgaatccaaagagaatccggcttcgggaaacgcacaggaggcaaactgaatggcttctaaatcatctaaaaccaacttggatctcaacaaccttcacctgctcaaccttcctgccaggctttttatcgccctgctggccgttgccgccgtgctggggctcggttatgccggattgttcaaaagccagatggaatcccttgaggaatacgaagcaaaagaaaccgaactgaaaaacacctacaaacagaaaagtatcgacgcggccagcctgaacaacctgagggacgaacttgcctcaatccgctctgccttcgatatcatgttgaaacagctgccgacagatgcagaaattcccaatctggttcaagagcttcatcaggcaggttcgagcaacggtctgcgcttggacagcgttatgccccaacctcccgtagatgacggccccatcaaaagattaccctattccatttccattaccggaaattacgaacagatcagccaatttacccgcgatgtcggcagcctctcccgaatcattacccttgagtcgctgaaaatcgcccaatctccggaaaacggcggcaatcctgacggcaagagcagcatcctgaacctcagcgccattgccaccacctaccaagcaaaatccgtagaagagcttgccgcagaagcggcacaaaatgccgagcaaaaataacttacgttagggaaaccatgaaacactatgccttactcatcagctttctggctctctccgcgtgttcccaaggttctgaggacctaaacgaatggatggcacaaacgcgacgcgaagccaaagcagaaatcatacctttccaagcacctaccctgccggttgcgccggtatacagcccgccgcagcttacagggccgaacgcattcgacttccgccgcatggaaaccgacaaaaaaggggaaaatgcccccgacaccaagcgtattaaagaaacgctggaaaaattcagtttggaaaatatgcgttatgtcggcattttgaagtccggacagaaagtctccggcttcatcgaggctgaaggttatgtctacactgtcggtgtcggcaactatttgggacaaaactacggtagaatcgaaagcattaccgacgacagcatcgtcctgaacgagctaatagaagacagcacgggcaactgggtttcccgtaaagcagaactgctgttgaattcttccgacaaaaacaccgaacaagcggcagcacctgccgcagaacaaaattaagaagaggattactccattatgaataccaaactgacaaaaatcatttccggtctctttgtcgcaaccgccgcctttcagacagcatcggcaggaaacattacagacatcaaagtttcctccctgcccaacaaacagaaaatcgtcaaagtcagctttgacaaagagattgtcaacccgaccggcttcgtaacctcctcaccggcccgcatcgccttggactttgaacaaaccggcatttccatggatcaacaggtactcgaatatgccgatcctctgttgagcaaaatcagtgccgcacaaaacagcagccgtgcgcgtctggttctgaatctgaacaaaccgggccaatacaataccgaagtacgcgggaacaaagtttggatattcattaacgaatcggacgataccgtgtccgcccccgcacgccccgccgtaaaagccgcgcctgccgcaccggcaaaacaacaggctgccgcaccgtctaccaagtccgcagtatccgtatccgaaccctttaccccggcaaaacaacaggctgccgcaccgtttaccgagtccgtagtatccgtatccgcaccgttcagcccggcaaaacaacaggcggcggcatcagcaaaacaacaggcggcagcaccagcaaaacaacaggcggcagcaccagcaaaacaacaggcggcagcaccagcaaaacaaaccaatatcgatttccgcaaagacggcaaaaatgccggcattatcgaattggctgcattgggctttgccgggcagcccgacatcagccaacagcacgaccacatcatcgttacgctgaaaaaccataccctgccgaccacgctccaacgcagtttggatgtggcagactttaaaacaccggttcaaaaggttacgctgaaacgcctcaataacgacacccagctgattatcacaacagccggcaactgggaactcgtcaacaaatccgccgcgcccggatactttaccttccaagtcctgccgaaaaaacaaaacctcgagtcaggcggcgtgaacaatgcgcccaaaaccttcacaggccggaaatctcccttgacttccaagatgtcgaaatccgcaccatcctgcaattttggcaaaagaatccggaatgaacattgttgccagcgactccgtcaacggcaaaatgaccctctccctcaaggatgtgccttgggatcaggctttggatttggttatgcaggcgcgcaacctcgatatgcgccagcaagggaatatcgtcaacatcgcgccccgcgacgagctgcttgccaaagacaaagccctcttacaggcagaaaaagacattgccgatttgggtgcgctgtattcccaaaacttccagttgaaatacaaaaatgtggaagaattccgcagcatcctgcgtttggacaatgccgacacgaccggaaaccgcaacacgcttatcagcggcaggggcagcgtgctgatcgatcccgccaccaacaccctgattgttaccgacacccgcagcgtcatcgaaaaattccgcaaactgattgacgaattggacgtacccgcgcaacaagtgatgattgaggcgcgtatcgtcgaagcggcagacggcttctcgcgcgatttgggcgttaaattcggcgcgacaggcaagaaaaagctgaaaaatgatacaagcgcattcggctggggggtaaactccggcttcggcggcgacgataaatggggggccgaaaccaaaatcaacctgccgattaccgctgccgcaaacagcatttcgctggtgcgcgcgatttcctccggtgccttgaatttggaattgtccgcatccgaatcgctttcaaaaaccaaaacgcttgccaatccgcgcgtgctgacccaaaaccgcaaagaggccaaaatcgaatccggttacgaaattcctttcaccgtaacctcaatcgcgaacggcggcagcagcacgaacacggaactcaaaaaagccgtcttggggctgaccgttacgccgaacatcacgcccgacggccaaatcattatgaccgtcaaaatcaacaaggactcgcctgcgcaatgtgcctccggtaatcagacgatcctgtgtatttcgaccaaaaacctgaatacgcaggctatggttgaaaacggcggcacattgattgtcggcggtatttatgaagaagacaacggcaatacgctgaccaaagtccccctgttgggcgacatccccgttatcggcaacctctttaaaacacgcgggaaaaaaaccgaccgccgcgaactgctgattttcattaccccgaggattatgggtacggccggcaacagcctgcgctattgatgcgtcaaaataagggcatatgttttacggcatatgccctttctttatgctttttgccgcgaccgaaatgccgtcattcccgcgcaggcgggaatccagtccgttcagtttcggtcagtttcggtcatttccgataaattcctgttgcttttcatttctggattcccacttttgtgggaatgacggcggaaggggtaaatcctcacaacccaaagcctcgtcatttccacaaaaaacagcaacccgaaacagcaacttaaaaccccgtcattcccgcgcaggcgggaatctaggtctgtcggttcaggaacttatcggataaaacggtttctccaaccctgcgttctagattcccactttcgtgggaatgacgggatatgggtttccgtgcggacgtgttcggatttccgcctgcgcgggaatgacggcgacagatgcccaacggtctttatagtggattaacaaaaatcaggacaaggcgacgaagccgcagacagtacaaatagtacggaaccgattcacttggtgtttcagcaccttagagaatcgttctctttgagccaaggcgaggcaacgccgtactggtttttgttaatccactatagtattgataaacatattatcttcaatatattcaattggataattgtttacctaagcaaagataattgccttttcctgacaaataagtgaaatcaacggattgtcaaaacacagcctgaaataaaaaacctccctgatttcttttatttgtccttaaaatcagaaaggttcgggatggtcgggttatttttccaaacgtaccgccgccctgccgatttcgtataaaattccgccgtaacccgacaagcccgaaccctgtcgccccgaaaggcggggtgtcaaacattaaggaattgtgatgaaaaactttaacggcaaactcatcctcatcggactgatgggcgcgggcaaaaccacgctgggccggcaaatggcgcagcggctggattaccgtttttacgacagcgatcacgaaatcgccgcagccgccggcgttcccatccccaccatatttgaaatggaaggcgaacagggattccgttcgcgcgaaaccgccatactcaaaaagctggttatcctgccccatatcgtcctgtccaccggcggcggcgcggtgttaaaagaagaaaaccgcgcccttatccgcaaaagcggcacggtcgtctatctgcacgccccgcccgaaaccctgctcgaacgcacgcgctgcgacaacagccgtcctttgctgcaagttgccgatcctttggcgaaattacgtgaactctacgccgcacgcgaccccgtttaccgccaaaccgccgactttaccgtagaatcggcaaactgccgggaaaccgtgcaaaccctgctcaaacgcttatcccgataaaccggcatatgcgccgcgcccagaaaaccaaaccgcgccccgcccggcgggccggcggttcaaactttaaggaacaacaatgaaaacactgaccgtacacaccccgtcccacagctaccccatctttatcggcaacggactgctgccgcaggcaggaagcctgctcaaaccgcatttgggcaaacgcgccgccatcatcgccaacgaaaccgtcgccccgctctacctcggcacgcttcagacggcattggatgcggcaggcgtatcccatttcagcatcatcctgcccgacggcgaggcgcacaaaaactggcagacgctcaacctcatctttgacgggctgatgcaaaaccgcgccgaacgcaaaaccacattaatcgcactgggcggcggcgtgatcggcgacatggtcggctttgccgctgccacctaccagcgcggcgcaccgttcgttcaaataccgaccacgctgttgagtcaggtcgactcatcggtgggcggcaaaaccgccatcaaccacccgctcggcaaaaatatgattggcgcgttttaccagccgcaggcggtgcttgccgacttggacacgctgcacaccctgcccgcccgcgaattgtccgccggtatggcggaagtcatcaaatacggcgcgctcggcgacatcggcttttttgaatggctggaacagcatatgcccgaactgatgacgctcgatcgggaaaaactcgcccaagccgtgtaccgctgctgccaaatgaaggcagacatcgtcgcccaagacgaaaccgaacagggcatacgcgcatggctcaacctcggacacaccttcggacacgccattgaaaccgagatgggttacggcacttggctgcatggagaagccatcgccgccggctgcgtgttggcggcgcgtttgtccgaacaactgggcaaaacctccgccgcagataccgcgcggctcgccgccctgctcgaagccgccggactgccgtccgcgccacccgtgtttgcctttgaaaaatggctggaacacatgagccacgataaaaaagtcagcggcggcatcatgcgctttatcggtctgaaccggctgggcgaagccaacatcaccgaaattaccgacacggacatcctccgccgcaccctgcaaccgtatctctgatttcctctgccgatgtgctgccgcgcgggtttgacgcacgatgatgattttccatcatctttctccgcaaaagcgggaatccagtccgttcggtttcggtcgtttccgataagttcccgttgcttttcatttctagattcccactttcgtgggaatgacggcggagaggtttttgttgtttcggagaagtttctgcaaccctagaatctcgttatttccacaaaaaacagaaaaccaaaacagcaacttaaaacctcgtcattcccgcaaaagcgggaatccggtccgttcggtttcggtcgtttccgataaattcctgctgcttttcatttctagattcccacttttgtgggaatgacggcggaagggttttggttttttccgataaattcttgaggcattgaaattctatagtggattcacaaaaatcaggacaaggcgacgaagccgcagacagtacagatggtacggaaccgattcactcgtgcttcagcaccttagagaatcgttctctttgagctaaggcgagacaacgccgtaccggtttttgttcatccactataacagcaaccctgtcgccgtcattcccgcaaaagcgggaatccagtccgttcggtttcggtcgtttccgataagttcccgttgcttttcatttctagattcccactttcgtgggaatgacggcggaagggttttggttttttccgataaattcttgaggcattgaaattccagattcccgcctgcgcgggaatgacggctcaaaagttacggaacgaaaaacaaccaaaaccggacaagtcggattcccgcctgcgcgggaatgacggaatcttaagtttccgtctttgttttctgttttctgttttcgagggaataatggggaacaagccgtatttcagacggcattttcagttcggggtataatccgaatacttgcgaccatctgaatcattgggacaaaccatgtgtcaactgctgggcatgaactgcaatacgccgaccgatattatgttttcctttgaaggcttccgccgcaggggcggcattaccgaccaccatgccgacggtttcggtatcggctttttcgaaggcaaaggcgtgcgcctgttccacgacgacaagccgagcgtaaattcccccgtcgccgacctcgtgcgtgcctaccaaatcaaatcggaaaacgtcatcgcacatatccgcaaagcatcgcaaggacaaacctcgctggcgaacacccatccctttatgcgtgaaatgtggggcggctactggctgtttgcccacaacggacatttgattgattttttccccgaacagggcgaatttttccaccccgtcggcacaaccgattccgaacgcgcgttctgccacatcctcaaccgcctgcgcacccgctttgccgcccgtcccgacgacgacacgctgtttgacgcgattgcggggctgacgcacgaaatccgcaagttcgggctgtttaactttatgctttcagacggcattgccctgtttgcccacgccagcacgctgctgcactacatcgtccgccaagccccgttcggcaaggcgcgcctgctcgacgacgacgtgatggtcgattttgccgaagtaaccacgccctccgaccgcgtcgccgttatcgccaccctgccactgacccgcgacgaatcatggtcccaacttgccgtggacgaactggtcatgttccgcgaaggcaacatcgtccgacacgaccgtcccgaaaaccccgtctatatgagtgccgaagaaggtctggaaatcgcccgcgccgccggcgtcgccgtctgaacttcagacgacataggaggacgaacccgatgaaatgcccgttttgcgcccaccccgacacccgcgttgccgattcgcgtctgatggaagaacgcaacgccgtgcgccgccgccgccactgccccaactgcggcaaacgcttcggcacgctcgaaaccgccgaactcaaaatgcccgccgtcatcggtccggacaaaaaacgctcgccctttaatgcacaacgcctccgcaacgacctgaccgccgccgcccgaaaatccgccctgacacccgaacagatcgacgaaaccgtccgcctgacggaacacaggctctacacttcgggtcagcgcgacatcccctctgccgcacttgccgacatggtgctaaaagaactgctccgacaagatacggaagccgccgtccgtttcgccgccctgcacaaacgcttcgacaatccggcagactttgcctcgtggctggcgcaagccgtcaaaacaggcggcaaagcctgattcccccaacccatactgatacggtatccctatgttttcggacacagatatatccatgatggaaaacgccctccgacttgccgctttggggcgtttttccacttcgcccaatccgcgcgtcggctgcgttatcgcacacggcagccaaattgtcgggcaaggcttccacgtcaaagcgggcgaaccccatgccgaagtccacgccctgcgtcaggcgggcgaaatggcacaaggcgcgaccgcctttgttaccctcgaaccgtgcagccattacgggcgcacaccgccctgtgccgaagcactggtgcgggcgggcgtgtcccgcgtcgttgccgccatgcgcgaccccaacccgctggttgcaggcaaagggcttgccctgctcgaagcagcaggcatcaagacggaatgcggtttactcgaacatcaggcaagggaactcaaccgaggcttcctgtcgcgcatcgaacgccgccgcccctttgtccgcctcaaatgcgccgtttcgctggacggcaaaaccgccctttcagacggcagcagcttttggattaccggcgaagacgcgcgtgccgacgtacaggttttgcgtgccgaaagctgcgcggtgctgaccggcatcggcacggtgttggcggacaatccccggctcaacgtccgcgcttttccaactttgcgccaacccgcacgcatcgttttagacagccgcctgcgcctgcccccgaacagccatttggttaccgacggacaatctccgacctacatcgccacactcgaacgcaacgaagacagactgcacccctatcgggaacacgcacacgtccgcatcctgatgccgtctgaaacggcagacagcaaaatcgacctgcaccacctgatgcgcctccttgctgacgaaggtttcggcgaaatcatggtcgaagcaggctccgaactcacatccgcatttttggcagaaaatctggcagacgaaatcgtcctgtaccgttcgcccaaaatcctcggcagcggcaaagacctgttttccctgctcgaaaaccgcgccgccctttccgcaccgcccttgtggacacccgtttcaagcgaaatcctcggacacaacatcaaaaccgtgttccgaaaaaacggcaacgccttttaaagggtttgcgccgtttcactatataataacgccgataaaaaacggccccgttcagaccgccgcccgcccgaaaaaacgcaacccggactgccgcaccccgccggcagccgcgacggtctgaaagccgtcaaattccgatcaagaaaggcttcagacggcacaggcagcatcccgccgccgcccggacatcaaaaatggacacaaaagaaatcctcggctacgcggcaggctcgatcggcagcgcggttttagccgtcatcatcctgccgctgctgtcgtggtatttccccgccgacgacatcgggcgcatcgtgctgatgcagacggcggcggggctgacggtgtcggtgttgtgcctcgggctggatcaggcatacgtccgcgaatactatgccaccgccgacaaagacaccttgttcaaaaccctgttcctgccgccgctgctgtctgccgccgcgatagccgccctgctgctttcccgcccgtccctgccgtctgaaatcctgttttcactcgacgatgccgccgccggcatcgggctggtgctgtttgaactgagcttcctgcccatccgctttctcttactggttttgcgtatggaaggacgcgcccttgccttttcgtccgcgcaactcgtgcccaagctcgccatcctgctgctgctgccgctgacggtcgggctgctgcactttccagcgaacaccgccgtcctgaccgccgtttacgcgctggcaaaccttgccgccgccgcctttttgctgtttcaaaaccgatgccgtctgaaggccgtccggcacgcaccgttttcgcccgccgtcctgcaccgggggctgcgctacggcataccgatcgcactgagcagcatcgcctattgggggctggcatccgccgaccgtttgttcctgaaaaaatatgccggcctggaacagctcggcgtttattcgatgggtatttcgttcggcggggcggcattattgttccaaagcatcttttcaacggtctggacaccgtatattttccgcgcaatcgaagaaaacgccccgcccgcccgcctctcggcaacggcagaatccgccgccgccctgcttgcctccgccctctgcctgaccggcattttctcgccccttgcctccctcctgctgccggaaaactacgccgccgtccggtttatcgtcgtatcgtgtatgctgccgccgctgttttgcacgctggcggaaatcagcggcatcggtttgaacgtcgtccgcaaaacgcgcccgatcgcgctcgccaccttgggcgcgctggcggcaaacctgctgctgctggggcttgccgtgccgtccggcggcgcgcgcggcgcggcggttgcctgtgccgcctcattctggctgttttttgccttcaagaccgaaagctcctgccgcctgtggcagccgctcaaacgcctgccgctttatctgcacacattgttctgcctgacctcctcggcggcctacacctgcttcggcacgccggcaaactatcccctgtttgccggcgtatgggcggcatatctggcaggctgcatcctgcgccaccggaaagatttgcacaaactgtttcattatttgaaaaaacaaggtttcccattatgaaaatcgttttgaccacatctatggcaggcttgggcggcacgggcacgatatcatcgattgccaaatggcgtgcaaaaacgaccccgttcagtccgacgaaatcgtccgccgcttcaggcgcgacatttcctatcggaaaatcgtcaacctgattgaaagattggcaaatgagtaaattcttcaaacgcctgtttgacattgttgcctccgcctcgggactgattttcctctcgccagtatttttgattttgatatacctcatccgcaagaatctaggttcgcccgtcttcttctttcaggaacgccccggaaaggacggaaaaccttttaaaatggtcaaattccgttccatgcgcgacgcgcttgattcagacggcattccgctgcccgacggagaacgcctgacaccgttcggcaaaaaactgcgtgccgccagtttggacgaactgcctgaattatggaatatcttaaaaggcgagatgagcctggtcggcccccgcccgctgctgatgcaatatctgccgctgtacgacaacttccaaaaccgccgccacgaaatgaaacccggcattaccggctgggcgcaggtcaacgggcgcaacgcgctttcgtgggacgaaaaattcgcctgcgatgtttggtatatcgaccacttcagcctgtgcctcgacatcaaaatcctactgctgacggttaaaaaagtattaatcaaggaagggatttccgcacagggcgaagccaccatgccccctttcacaggaaaacgcaaactcgccgtcgtcggtgcgggcggacacggaaaagtcgttgccgaccttgccgccgcactcggccggtacagggaaatcgtttttctggacgaccgcgcacaaggcagcgtcaacggcttttccgtcatcggcacgacgctgctgcttgaaaacagtttatcgcccgaacaatacgacgtcgccgtcgccgtcggcaacaaccgcatccgccgccaaatcgccgaaaaagccgccgcgctcggcttcgccctgcccgttctggttcatccggacgcgaccgtctcgccttctgcaacagtcggacaaggcagcgtcgttatggcgaaagccgtcgtacaggcaggcagcgtattgaaagacggcgtgattgtgaacactgccgccaccgtcgatcacgactgcctgcttaacgctttcgtccacatcagcccaggcgcgcacctgtcgggcaacacgcatatcggcgaagaaagctggataggcacgggcgcgtgcagccgccagcagatccgtatcggcagccgcgcaaccattggagcgggcgcagtcgtcgtacgcgacgtttcagacggcatgaccgtcgcgggcaatccggcaaagccgctgccgcgcaaaaaccccgagacctcgacagcataagcgattaaaatacacccccgtacagaccgattttgacaacacctgcggcgcgcgcccgattcttcggaacacgccccccttcagacggcatagggtcggaaatgccgtctgaaaaccgacggacaaaccatcatgctgaacactttcctttccccgtggccctgcttcacccaagaagaagccgatgccgtttccaaagtcctgctgtccaacaaagtcaactactggacgggcaacgaatgccgcgaatttgaaaaagaatttgccgcctttgccggcacgcggtacgccgtcgcccttgccaacggcacgctggcactcgatgtcgcgctcaaagcaatgggcataggcgcgggcgacgatgtgattgttacctcgcgcaccttcctcgcttccgcgtcctgcattgtgaacgcgggcgcaaaccccgtgtttgccgatgtggatttgaacagccaaaacatcagcgcggaaaccgtcaaagccgcgctgacaccgactaccaaagccgtcatcgtcgtccacctcgccggtatgcccgccgaaatggacggcattatggctttggcaaaagaacataatctttgggtaatcgaagactgcgcccaagcgcacggcgcaaaatacaaaggcaaatccgtcggctctatcggacacgtcggcgcgtggtcgttctgccaagacaaaatcatgaccaccggcggcgaaggcggtatggttacgaccaacgacaaaaccctgtgggaaaaaatgtggtcgtacaaagaccacggcaaaagctacgatgccgtgtacaaccacgaacacgcgcccggtttccgctggctgcacgaaagtttcggcacaaactggcgtatgatggaaatgcaggcggtcatcggacgcatccagctcaaacgcctgcccgaatggacggcgcgccgccgagaaaacgccgccaagctggcggaaagtttgggcaaattcagcagcatccgcttggttgaagtcgccgactacatcggacacgcgcaatataagttctacgccttcgtcaaacccgaacacctcaaagacggctggacgcgcgaccgcatcgtcggcgaactgaacgcgcgcaaagtcccctgctatcaaggcagctgctccgaagtctatttggaaaaagccttcgacaacacgccgtggcgaccgaaagagcgtttgacaaatgctgtcgagttgggcgacaccagcctgatgttcttggtgcacccgacgctgaccgacgacgaaattgcgttttgcaaaaaacacatcgaagccgtcttgaccgaagccgcacgataacccttcagacggcatatgccgcctgaaaacacataccgccccacgatatgaatctggaaactctgatcgccctgccgcgcaacatcaagaaaatctgtttcctcatacacgattttctgatgattttcattgccttttggttcacccaaagcctaaaggccgactactcggacgaatggttcgattttgccaactggcagtcttttttgctgactgccttgctgaccatcacattatttatccgaatggggctttaccacgccgttacacgcttcgtcagcttccgcatcctcaccaccgcactggcgggcagcctcgcctccgccgtgttgtttttcctcaatacgctgatatttgaagaaaggctgcgcctcgccctgccgattgtctatttcttactgctgtttgtttccgtgaccggctcgcgtatggttttgcgcggactgttgtccgaacaccccaaaaaacagatgatccctgtcatcatttacggcgcgggacggtcgggcagacaactgcttgaggccgtcaaacaaatgcgcgaatattccgccgccgcctttgtagacgacgaccccaaactgtggcacaccgtcatctacgaccttgccgtttaccagcccgatgccatcgccttcctcatcgaacgctacggcgtggaaaaaatcctgctcgccatccccggcgcgacccaggaacaacgccgccgaatcatcaacaaactggaagcctatccgtgcgaagtgttgaccattcccggaatgaaagacctgatggacggaaaaatcagcatcggcacgctcaaaaaaatctctgtgtccgacctgctcgggcgtgattccgtcgcgcccgacgaccgcctgatgagtgccgacatcgaaggcaaaaccgtcatggtaaccggcgcgggcggctccatcggttcggaactctgccgccagattatccgccgccgccccgaaaagctgctgctgttcgagttatccgaattcgccctgtacgccatcgaaaaagaattgcgcgaaacctgcatccaaaaacgcctcgacaccgaaatcctgccctttctcggttcggtgcaaaaccgcacgctgctcgaacacgtcatgaccgccttttccgttgcgaccgtctatcacgccgctgcctacaaacacgtccccatggtcgagttcaacaccgtcgaaggcatacgcaacaacatcttcggcacactcgagtgcgcgcttgccgccacgacatcgggcgtaagaactttcgtcctcatctccaccgacaaagccgtccgccccaccaacaccatgggtgccagcaaacgcatggcggaactctgccttcaggcactcgccgccgaacccggacaaaaaacccgcttcagcatggtacgtttcggcaatgttttaggttcgtccggctccgttgtcccgctgtttgaaaaacagattgcagaaggcggcccgcttaccctgacccaccccgaaatcacacgttatttcatgaccatacccgaagccgcccaactcgtcatacaggcaggcgcgatgggtacgggcggcgacgtattcgtcctcgacatgggtgaatccgtcaaaatcatcgaccttgcccgccaaatgattaccctaagcggcctcaaacccaacacacccgaacaacccgacggcgacatcgaaatcctcattaccggactgcgtcccggagaaaaactctacgaagagctgctcatcggcgacaacgtccgcaaaaccggccatccgcgcatcatgaccgccaacgagaccatgctgccgtggcacgagctctccgccctgctcgaccgcatccgtgcggcctgcgaccgttacgaccagcaggcaatccgcaccctgctcatcaacgccccgaccggctttgccccgagcgacggcatctgcgacctgctttgggtacgagaaacacacagaaaaaatgccgtctgaaccttcagacggcataacgtacaaaccaacctaccttacacacacggagtttgacatgcagttctcagcattcggcgaaaaattcacgcaacacagcggcatcctccaactgatggacgacctcggcgacgcgctcaaaagcgacaagcccgtcaacatgctcggcggcggcaacccggcgcgcattccggaaatcgatcaggcgttcgccgacatattctccaaactggcggcagaacacgccgtcgaaaacatcggcaactactccaatccccaaggcgatgccgtgctgattgacgcgctgaccgccttcctcaaccgcgaatacagctggaatctgaccgccgacaatatcgcgctgaccaacggttcgcaaaacgcgtttttctatcttttcaacctcttcggcggcaaattcaacctttcagacggcacatccgcagaaaaagccattttgttgccgctcgcgcccgaatacatcggctatgccgacgtgcatgtcgaagggcagcacttcgtttccgtcaagcccaaaatcgaaaacgtcgaacacgaaggcgaagccggcttcttcaaataccgcgtggactttgacgcactggaaaacctgcccgaactcaaagcgggcaaaatcggcgcgatttgctgttcgcgcccgaccaacccgaccggcaatgtgttgaccgacggcgaaatggcgcgtttggacgctttggcgcgtgaacacggcattccgctgattatcgacaacgcctacggaatgccgttccccaacatcatttacagcgacgtaacgctgaattggcacgaaaacatcatcctctgcttcagcctgtccaaagtcggcctgccgggcgtgcgcaccggcatcatcgtcgccgcgcccgaagtcgtcaaagccgtcagcagcctgaacgcgattgtgaaccttgcccccacgcgcttcggcgcggccatcgcaacgccgctgctggaaagcggcgagatgaaacggcttgccgaccaagtcatccggccgttttaccgcaatcaggcgcaaaccgccgtctcgctgctcaagcgggagctgggcgcgtacccgatgaaaatccacaaacccgaaggcgcgattttcctgtggctctggtttgaaaacctgcccgtttcttcgcaaaccctgtacgaaatgctcaaagccgaaggcacactgattattccgggcgaacatttcttcgtcggcatcgacacgcaggattacccgcatgcgggcgagtgcatccgcatgagcatcgcgcaggacgctcaaacgctggaaaaaggcattgccgccatcggtaaaaccgtccgaaaactgtacgacaacgtttaaaacgcaaaaaatgccgtctgaaaagttttcagacggcatttttatctgcattcaatatcgggaaaaatgttcccaaaccggtttgcagttttccggcagctcgggacacgcgccgaggatgccgccgctgaagtcgtttaagcggtggaagtcgctgcccgcgctggcgagcataccgaagcgttctgccaaaagcgcgtagttgaggcggtcgtttttgcagcagtttccgctgtggacttcgatgcctgcgccgccgaggtttttaaattcttcaaacaaattgcgcttggcggtggcggacaaatcgtagcgcatggggtgggcgatgactgccatgccgcccgctccgttgacggcggagacgcagtcttccagcgtcgcccattcgtggcggacggcgcaggatttgccgtcgcccaagtatttggtgaacgcctgctgcttgtttttgacgtgtcccgcttggatgaggaactcggcgacgtgggtgcggctgaccatttctttgtttgccgccagtgccagcgcgccgtcgtatgcgccgccgatgcctttcttttcgagcttggcggcgatggcttcaagacgtttcagacggcctttccgcacttgcgccaacaggttttgcaggttttcgtcctgctcgtcgaaatccaaaccgacaacgtgtatggtgcgcccgcgccacgttacggagatttccacaccgttaatcaggcgcaaaccgagcttgtcggcttcggcgcgcgcttcggcgatgccgccggtgtggtcgtggtcggtcaacgccagcagcgtgcagccgttttgatgcgcgaggcgcacgacttcggcgggggagagcataccgtcggaaacggtggaatggcagtgcaggtctatcatggggtgttatgtgtgttgtgaatgaaggtcgggggttaatattatcggttggtgtggatacagcggtgatttcaacaaacaggtgtatggcaaatgcaaaggaaaagtccctatgccgtcattcccgcgcaggcgggaatccagaccttgatttgtcaaaaatatttaaggttaaccgctatttcgaacttccggattcccgcctgcgcgggaatgacgatatggacgttttcagttttaatctactataaaagactgtctgaaaacgtggttttatagtgaattaaatttaaaccggtacagcgttggctcgccttggctcaaagagaacgattctctaaggtgctgaagcaccaagtgaatcggttccgtactatttgtactgtctgcggctcgccgccttgtcctgatttttgttaattcactatatcaagccgaaccgtttcagacggcatcgtccgaccaacccgcttctttcaatttctgccgttgcacgtcgtatttggctttatccgcccagtaaatcgtctgaatgcacgcctcgccgcagtcgctgccgcagcattcccacgactcgggtcggacgggttcgtctaaaagcggctcgcccaaaagggcttcggctttatacttcagggtcgtatccatcggcgatttccaagcgagcgccgtcaaactcgatgacttcgccgccgcgtattttggcggttttacgggtttcggtttcgccgttgcgcaacaccagcccttcggcgataaacgctttcgcctgtccgccgctttcggcaagtccgaccaatttcaagaggtcgcacaaggcgatgtattcgttgtcttcgagatagacagtggcttccataatgttcccttgcagaaagaggccgttattgtagcacctgccgccgccgtacccaaaattaccgaaaaaccggcgatgtatccgcaccgcctgttccgtaaaagtaaaaatgccgtctgaaaccccatatgccgccatccgttcaaagaaatcctgcccaacggcagactgcaaatcctgttccccgacgaatccgcattgacgctgatgcacatcctcaaacgcgaactgcccgatacaccggcaatcggcatcaaaacgaaatcaaaaacctgtttgaacgtaaaattaatttaactgcttgccatccgtccgaataaggcatatagttctttataactagtttgatagtcctttatatctatcaatactccttgggaagcctccgccatacggcaggaggcatttttttgccgtagtaaaagctcaaaaacatttgcaggtcatgccgtctgaacccgaaacggcattacctacaccgccatctaaagacaaccctgctacaatacgccttttattgtccacgccgattttgccatgaccgagccgacctacattcccctgcgcctgcataccgaattttcgattaccgacggtatggtgcggattaaaaaactgattgccaaagcgcaggaatacggtttgcctgctttgggcatcagcgatttgatgaacgaattcggtttggtgaaattttataaagcctgccgcagcgcggggattaagcctatcggcgcggcggatgtgcggataggcaatccggatgcgcccgacaagccgttccgcgctatgctgattatccgtaacgatgcgggctatctgcgcttgagcgagcttctgacggcggcttatgtcggcaaagaccgcaatgtccatcatgcggaactcaatcccgaatggctggaaaacggcgacaacagcggcttgatttgtttgagcggcgcacattacggcgaagtgggcgtgaatctgttgaacggcaatgaagacgcggcgcgtacggcggcgttgaagtatgcggcgtggttccccgatgcgttctatatggagctgcaacgcctacccgaacgccccgaatgggaggcttgcgtttcgggcagcgtgaagctggcggaggaattgggtttgccggtggtggcgacgcatccgacacagtttatgagccgcgacgatttcaacgcgcacgaggcgcgagtgtgtatcgcaggcggctgggtattgacggacaagaaacgtccgcgcgatttcacgccgggccagtttttcattccgccggaaaccatggccgaacgtttcgccgatttgcctgaagccttggaaaacacggtagaaattgccaaacgctgcaacctgcacatcacattgggcaaaaacttcctgccccttttccccacgcccgacggtttatcactcgatgactatctcatcaaactctccaacgagggtttgcaggaacgtatggttcagctttatcccgacgaggcggagcgggcggcaaaaatgccggaatatcaggaacgtttggattttgagctgaacatcatcatccaaatgaaattccccggctatttccttatcgtacaagactttatcaactgggcgaaaacacacggctgtccggtcgggccgggccgtggttcgggcgcgggttcgctggtggcgtattcattgaagattaccgaccttgatccgctcaaatacgcgctgctgttcgagcgtttcctaaaccccgaacgcgtttctatgcccgacttcgacgtggacttttgccaaagcaaccgcggccgcgtgattgaatatgtgcgcgagaaatacggcgcggaggcggtcagccagattgttaccttcggcacgatgtcgtccaaagcggtcatccgcgacgtcgggcgcgtgttagagctgccgtttatgctgtgcgacaaactgtccaagctgattccgttggaagccaacaaacccctgagtttggaaaaagccatggagaccgagccacagattcaggaattaatcgaagcggaagaagcggacgaactgattacgctggcgaaaaagctggaagatttaacgcgcggtttgggtatgcacgcaggcggcgtgttgattgcgccgggcaagatttccgattacagccccgtgtatcaggcggacgaatccgcctcgcccgtatccatgtacgacaagggcgacgtggaagatgtgggtttggtgaaattcgactttttgggtctgcgcaacctgaccattatcgaaatggcgcagaacaacatcaaaaacactaccggcgacatcatcgatgtcggcaaaatcccgcttgacgaccaggtcgcctaccaaatcttccgcgatgcgaacaccaccgccgtcttccagtttgagtcgaccggcatgaaaaaaatgctgaaaacggcgcacacgaccaagtttgaagaactcatcgccttcgtatcgctctaccgccccggcccgatggacaacattcccgacttcgtcgcacgtatgaaggggcaagaattccaatacatccatccgctactcgaaggcatcctcgcgccgacctacgggattatggtgtatcaggaacaagtgatgcaggcggcgcaaattatcggcggctactcgctcggcggcgcggacctgctgcgtcgcgccatgggtaagaaaaaacccgaagaaatggtgaaacaccgcgaaatcttcgccgaaggcgcggcaaaacaaggcatttcgcgcgaaaaatccgacgaaatcttcaactacatggaaaaattcgccggctacggtttcaacaaatcccacgccgccgcctacgccctgatttcctaccagaccgcatggcttaaagcgcactaccccgccgaatttatggcggcgaccatgtcgtccgaattggacaacaccgaccagctcaagcatttctacgacgactgccgcgccaacggcattgagttcctgccgcccgacatcaacgaatccgactaccgcttcacgccgtatccggacatgaaaatccgctacgcgctcggcgcgattaaaggcacgggcgaagccgccgtcgaatccatcaccgccgcgcggcaaagcggcggcaagtttaccggtctgttggacttctgcgagcgcgtcggcaaagaacacatgaaccgccgcaccctcgaggccctgatacgcggcggcgcgttcgacagcatcgaacccaaccgcgccatgctcttggcgaacatcgacctcgctatggacaacgccgaccaaaaagccgccaacgccaatcagggcgggcttttcgacatgatggaagacgccatcgaaccggtgcggctcatcgacgcgccgatgtggagcgaatcggaaaaactcgccgaagaaaaaaccgtcatcggcttttacctgtccggccacccgttcggcccgtatgcccaagaagtccgccaaatcgcaccgaccaaattagaccgtctgaagccgcaagacagcgtgcgcctcgccggattcgttaccgccgtgcgtacgatgatgggcaaacgcggcaaaatcgccttcgtcagcctcgaagatttgagcggacaggttgaaatcatggtcggcggtcagacgttggaaaactgcgccgactgcctcaaagccgaccaagtgctgattatcgaatccaaagtcagccgcgacgactacggcggcggcgacgggctgcgtattctggcaaaccaagtcatgaccctgcaaacggcgcgcgaacgctacgcccgcagcctcagcctcgccctcgccccgcatcacgacatcggcggactggtacggctgctcgccgcccaccaactgcccgacacgccgcgcatcccgctgcaactgtcgtatgccaacgaaaaagcgtcgggcaggcttcaagtgccgccgaaatggacggttacaccgagctccgcattgttcggcgaactggaaacattgctcggcagccggtcggtgcgcgtcaactggtaacccaaaatataaatgccgtctgaagcccaaaaaccggtttcattcgtactttattcgaatgattgaataaaagtaactgccaagaaaaacgtattttttggttatttcgccagtctaaatagagcaaccgggacgattgatatccgtgtgcatgacacagacagcaccaaagggaaaaacggcattttccaaagtatcggtatcaaaaccgccctttcactccaaaaataccaaatcgacaaaccgggcaaagaaatcagaccgtgccgcctgaaaaaacgcccacccgtccgttaaattaacctatccctgtttcagacggcctgaagcagggatttttatatcaaaataaaatgagaaagggagcaataacccttaggtagctcttgttattttccgatgcaaaacaaagcagtcatatatttaattccccctacctctgccaagccttcctcaaatattcgacgcaatcggtcagcgagtagaacgggacattgccgtggtcggcattcggatattcccggaaaaagacggcggccccgtgcctgtctaactctgccgccatttgttcggcctgccctgccatatcgcgttcttccctgcgtttacaatcgctaccccgttctagcgcgccgatgttgaggcagacatcgatgccgtttagccggttttcagacggcataaagtcgagtatccgcctgttgtgccaccaaatcgatggggatacgagccaatgccgtctgaaacggcggtgggaaagcagggaatacagtccgaacagtgcgccgaacgagtgtccgaatacggcggtttcattgcggttgagggtgtagcggctttctaaaaaggcggtcagctcgctgtcgataaaggcggcgaagcggtctgcctgtccgaactgctgccgttcgtctgctgtggcgttgtctccaagcggcggcgtgtagtcggcggcacgttgtgccaaatcgcgcacactgcctgtcgtgtagccgataccgacaatcaggcagggggcgttgcttcgggtaacggggttgttcatcagcgactgcatgatgttgaaaagtgcggggaaaaaggcttcgccgtcgaggacaaagaggacgggatagccttcagacggtatttcgccgagtgttgccgtctgaatccgatagattcgccccgtgcaggtggatttgatttcggtttcaaaggcttggggcagtatggcaggttggaatgtgtcggtcggtatgggtttcatgatgttcggcttgtgggtcagactggcggcaagcggtaaaaccgaaccggcaaagcggtctgcctgccggttcggtctattttccttcgcaatgccatactccagttgtgagagcatagggtatgccgcgcagcttgttgtagtttgatgatgctgcggctgccgtttcagacggcatattggtctttaaaaactgtaacgcaggtttgccgtcaggctgcgctccgaaccgggaatgttaaaggtgctctcgctgccgacgcgggcgtagtaatggcggttgaagatgttgtcggcgttgatttgcagcttcagtttgggcgtgaagcggtatgccgccatcgcatcgaacgtggcataaccgcctgcatgtatccctgcagatgaagtaatgccgctcatcgcgttcacgccgccgccgatggtcagcccggacgtaacttggtaagtcgtccacaggtttgcgctgtgtttgggcatcagcaggaagatgccttcgtcgcgcgaattggaggcggttttgatttggctgtgcaggtagctgtaacctgcatggatttgccatttcggtgtcatcgcgccgctgatttcggtctcaacaccttccatcacgcgtttgcccaatgcggcgtaacgggtttttttgttgtttgagtccagcggtgcggcggcgtttttatccttcatgcggtagaacgaaacccgggtattgaggcggtcgtccatgtagctgcctttgtagccgatttcaaactggttgccttcgcgcggtttgagcagcttgccgtcggtgccgatgctggtttgcggtgtgtagagttgggaggcggaagcgtacaggctgttgctgccgtctatatcgtaaaccgcgccggcgtagcttgtaaatttggttttcgaagctttatgcagggttttgccgtcgcccgactcgattttgtgatgtcctacacgtccgcctgcaatcaacgacaaaccttccagaggacggaacaccgtcttggcatacaaaccggtttcgtcgaggttttcttcggtaacggagtgattgaaacctttgtttccggcgcgggcgttctgaagtatgccgttataaggcaaagcgcggaaaccatctaaagcgacgctttttgacaaagtcgaacgcccttgttcattagtactgcgcaagcggttgtagtctgcaccaatcacaaattcgttggcggtgttgcccaaggcaaacggacggctgtaacttgcgtcaaccgcaaaggctttttgtttaatgtccgtacccaaacccgctacgtcggcttgtccggtattgttgagtttgctgcccgcaaacgtataattggaatcggctttccgatcggaatagcgcataccgactttgccgtagccgccgttgccgaagtaatgtttcaaatcggcgaacacgtcgtggctgtgcattttaaatttgttccaatccgcgccgacaaatacgtgttgcggcagggacggtaatttgttattggcatcggcaggcaggccgttgtacggcgcgaggcggcgttgctggtaaagatagcccgcgcccaaaaccgtatcggggttgatgtcccaatccgccgccgcgtagaaggtttcgcgccggttgtttttctcggcgggacgcggagacgcgccgacggtctgcgccatcacgcggccgcgcacgctgccgtctgaattgaggctgcccgatacgtccgcctcggctttatattgtttgtgcgtaccgaaccctgccgccgcatgaccttggaacgctttggtcgggcgtttgcgcaccagattcacgatgccgcccatctcgccgctgctgtcgaacagtccgctcggcccgcgcatcacttccacgcggtcgaaggcgaacaggttgggcagcgtgccgttgatactctgcatctgcgcgggcaggccgtcgatgttgtattcgctgtattcgtaaccgcgcgcgtaaaccgaagagcgtccgtcgtcgttgctcaacacgcgcaggccgggcgttttgcgtgccaactggtcaaacgtatcaacattgcggtctttgacctgctggttggtaatgatgctgacggattgcggaatttcgcgcaaagaagcggggatttttgtaccgacggtggcggcaaacgagctgtaatcgccgtttttctcggtggcaatcgcgttgtaagaacgctgacccttaatatggacggtttccaaaccttccgtttgtgcggcaaaaaccgaagacgagagtgctgccaaaaccgtggcggcggtcatattgatgcggaaaactgacataaactgtcccattcacataaatgataatggttctattttaataaagcgcaacgcggcttgttcggaaaaacatatcgcgcagccgacaaattttgtcgaaaatgcgacacgtctgcgttttccgcataaaatttgcttttttactgcaaccaacctgctatgaccacgcccaaactcatcatcttcgactgggacggcacgcttgccgatacgacccaacccatcatcgacaccatgcgccgcagcttcgccgaatgcggttttccgccgcccgaagcggaacgcgtccgcagcctgattggctacagcctgcccgaaatcatccgcaccctgctcgaaatgccgtctgaaaccgccgttgccgacatcacacgcacttattccgcacattacctcaatcccaacaaccgcaatatgtccttatttcccgatgccctgccctgtctggacaagctcaaagcacaaggatactggcttgccgtcgccacgggcaaagggcgggcgggtttggacaacgccatcagtcaaaccgccaccggcggctattggctcgccaccgcctgcgcgggggaatatccctccaaaccctcgcccgaaatggtattcggaatctgcggcgaactgggactcgacccgaaagaggcattggtcgtcggcgatacggcgcacgacctgcatatggcggcaaacgcaggcgcggcggcagtcggcgtggccaccggcgcacattcgcgcgaacagctccttagcgcaccgcatctcgccgtattggacggtttgtccgaactgcccggttttcttgcacaacattacgcctgattggtttccgcatccggcacacggcaaaaatgccgtctgaagcctgttcagacggcatttgtgttgcccaaacattcaacgcctgcgtcaacgtttgcacaaatcgggtttggtttcgccctcgcggcgcaactctttgggcaggacgaacacaatgctttcttccgcaccctcgccttcgcgtacggtttcgtgcccccatccgcgtatggttgccagtacttcccgcaccaacacttcgggcgcggacgcgcctgccgttacgccgactttgtttttgccctcaaaccatgcgcgttgcaggtagcctgcattatccaccatatacgcatcgattccgcgcgatgccgccacttcgcgcaagcggttgctgttggacgaattgggcgaaccgaccacaatcacgatgtcgcactgttctgccaactctttgacggcggtttgccggttggtcgtcgcatagcagatatcttccttgtgcggattgcggatattggggaaacgcgcgttcagcgcggcgatgatgtctttggtttcatcgaccgagagcgtggtttggctgacataggcgagtttgtcggggtttctgacttcgagttttgccacatctccgaccgtttcgaccaaaagcattttgcccggcgcaagctgccccatcgttccttcgacctcgacgtgccccttatgcccgatcatgatgatttcacagtcttgggcatccagtcgggcgacttccttatgcactttcgtcaccagcgggcaagtcgcatcaaacacgcggaaaccgcgctccgccgcttcttgccgcaccgccttcgatacgccgtgtgccgaataaaccagtgtcgcgcccggcggcacttccgccaagtcttcaataaacaccgcacctttttcacgcaggttgtccacgacgaatttgttgtgaacgacttcgtggcgcacataaatcggcgcgccgaactcttccaaagcacgttcgacaatactgattgcccgatccacaccagcgcagaagccgcgcggattggcaaggatgatggttttctcgttcataagcccggtatttcgttttcagacggcatcaatatttttcttcttgggttttacggtggacgatgttgtccaacaccgccaacaccgcaccgacgcagataaagctgtcggcaatattaaaggcgggataaaaccaattttgccaataaaacaataagaaatcgacgacatgaccgtgtatcaggcggtcgatgacattgcctaacgcaccgccgataatcattgccgcacccgttttgccgagggttgcaaactcatcgcgcaagatggcgcgtaccaaatacgcgctcaccgccaccgccagcaccaaaaaaaagtatttttgccagccgccctgatcggcaaggaagctgaacgccgcacccgggttgtacaccagcgtcagatcgaaaaaggaaggaatgacattgacgcgttcccgatactgaaacgacgacagcaccgcccacttcgaccactggtccagcacgatggcggcaagtgccaatacccaatagcgcgttttacttgaaacagatgaagacatatttttcaacagccggtaaaagagtaccattttacccgaaaaccccctttcctgtacccgaaacggcaaatgccgtaatcttaaaacccgtcattcccgacaacaccgtaatctcgaaacccgtcattcccgcgtaggcgggaatccagacctgtccgcacagaaacttatcggataaaaacagttgcccaaaccccgcgttctatagtggattaaattcaaaccagtacggcattgcctcgccttgccgtactatttgtactgtctgcggcttcgttgccttgtcctgatttaaatttaatccactatagattcccacttccgtgggaatgacggttcagttgcattccgacaacaccgtaatcttgaaatccgtcattcccgcgcaggcgggaatctatcggaaatgactgaaacctcgagattctagattcccactttcgtgggaatgacggttcagttgcgttccaacaacaccgcaatctcgaaatccgtcattcccgcgcaggcgggaatccagacctccgacgcggcgggaatctatcggaaatgactgaaacctcgagattctagattcccactttcgtgggaatgacggttcagttgcgttccaacaacaccgcaatctcgaaatccgtcattcccacacaggcgggaatccagacccctgacgcggcgggaatctatcggaaatgactgaaaccccgagattctagattcccactttcgtgggaatgacggttcagttgcgttccgacaacaccgcaatctcgaaatccgtcattcccgcacaggcgggaatccagacccctgacgcggcgggaatctatcggaaatgactgaaaccccgagattctagattcccactttcgtgggaatggcggttcagttgcattccgacaacaccgtaatcttgaaatccgtcattcccgataacagcgcaatcttgaaacccgtcattcccgcgcaggcgggaatccagacctccgacgcggcgggaatctatcggaaatgactgaaaccccgagattctagattcccactttcgtgggaatgacggttcagttgcgttccgacaacaccgtaatctcgaaatccgtcattcccgcacaggcgggaatctatcggaaatgactgaaacctcgagattctagattcccactttcgtgggaatgacggttcagttgcattccgacaacaccgcaatcttgaaacccctccgccgttataaagacaaatcgcggcacaaaaaatgccgtctgaaatgctgttcggcggtttcagacggcatttgctcaaactttatcaggcgtaatggcgcgtttcgccttctccgccgacattctctgcacagcgtttgcagacggtttcatagcctgcaaccgcgcccacatcgcgggtgtagtgccagcagcgttcgcatttttcaccatcactggctttagcggcaacggcaagttcgctgcctactttcacttctgctttagacaccagcaaagcaaagcgcaattcttcgcccaaagcattcagatagccggccatttcttccggcgcggtaatttcggcttcggcttgcaaggacgaaccgacggttttgtcggcgcgcaaaggctcgatggcggcggttaccgcttcgcgggcttcgcggattgccgtccattttttcaccagttcggcttcggttttttcgttgatggtcgggaactcgtgccaagtatggaagaggacgctgtcttcttcgccgccgccgatgatgtcccacgcttcttcgccggtgaagcacaaaatcggtgcaatcaagagaaccaaactgcgtgtgatgtgatacagggcagtttgtgcgctgcggcgtgcatggctgtctgctttggtggtgtagaggcggtctttcaggatgtcgaggtagaacgcacccaagtcttccgagcagaaagaaacaatgtcttttacggcaaagtggaaggcataacgcggatagtaatcgcctgccagacactcttgcagctgacgtgccaataccacggcgtagcggtcgatttccaccatatccgcctgttgcacggcatcttcaatcggattaaagtcgctcaagttggcaaacaaaaagctcaaggtattgcggatacggcggtagctttcggttacgcgtttgaggatttctttggaaatcgccaattcgccgctgtaatcggtagatgccgcccacaggcgcaggatgtctgcgccgaattcgttataaacctcttgcggtgcaacgacgttgccgatggatttcgacatttttttgccttcgccgtcgacaacgaaaccatgggtcagcagctgtttatacggcgcgcgacccattgatgaggcgcagccggtcagcatggacgattgaaaccagccgcggtgttggtcgctgccttcgagatacaaatcagccggccattccaattcttcgcgttgtttcacaacggaataatgggtcgagccggagtcgaaccatacgtccattgtgtcagaaagtttatcgtaattttcgcaatcttccgcgctcaagagttcgctcttatcgagggagaaccacgcttcgatgcctttttcttcgattttcagggcaactttttccaaaagttcggcagagttcggatgcagctcgcccgtttctttgtgaacaaagaaagtcatcggcgtgccccaatagcgttggcgtgaaaccacccagtcaggacgaccttcaatcatggcttccaaacgcgcgcgaccccaagacgggaagaattcggtgtcgtccacggccttgatggctttgtcgcgcagggttttgccgtcggcaccggctttgtccataccgacaaaccattgacctgtcgcgcggtaaatcagcggcgttttgtgccgccagcagtgggcgtagctgtgttcgattttactgcttgccaaaaggttgccggtttcttccaaccattgcaggatgacggggttcgcctcccaaacgcgcataccggcgacacgcggcgtttcgccgatgtatcggccttcggcgttgacggggttgtaaagctcgatgccgtatttattgcagacggcgtagtcttccaaaccgtgcgcgggggcggtgtgtaccaagccggtaccggcatcggtggtaacgtgttcgccgttgagcatgggaatatcgcgttcgaggaacggatggttcatgtgcagattttccagcttgtcgccggtggtttcggcgagaatagcaatgccgtctgaaaaaccgtaacgtttgagcgcgtcttctgccaaatctttcgccaataccaatttgcctttcggcgtatcaatcagttgatacaccacgtctgcacccgcagacacggcttggctcgccggtagcgtccaaggcgtagtcgtccaaatgacggcaaacgctttgccttcgaaaccagccaaaccgaatgcggcggcaagcgcggcagtgtctttaaacagataggcaacgtcaatcgcgggcgagattttgtctttgtattccacttccgcttcggccagcgaagaaccgcagtccaagcagaattgaaccggtttcgcaccccggtagagatagccggatttgtagatttcgccgagcatacgcacggtatcggcttcggttttgaaatccatagtcaggtaaggatggtcccagtcgcccaacacgcccaagcggataaagtcttttttctgacgggcaatctgttcggcggcgtattcgcggcacaattcgcggaaacgtgctttgggcatatctttgccgtgcagtttttctaccatcacttcgatgggcaggccgtggcagtcccaacccggcacataaggcgcgtcaaaaccggcttgggttttgctgcggataatgatgtctttgagaattttattgacggcatgaccgatgtggatgtcgccgttggcatacggcgggccgtcgtgcagaataaatttcggacggcctttggcgatttcgcgcagtttttggtagcgtttttgctcgtaccagcttttcagccatgcaggctcgcgcttggcaagattgccgcgcatcggaaacgggctctcgagcaggtttacggttttactgtaatcggtcattttttaatctctattgttacaatatttcggtctcagacggcattgcgccccaaacagcatttcacaacgggaaaaccctgtgccgtctgaacagttaaaagattgattgtagcccaatcggatggtttgtataaggtttttctaccaacgccttgcggcttccatatcggcttcaatctgccttttcagttcttccataccgtcaaacttttcctcatcgcgcagtttgtgcaggaagcggacgttcagcccttgtccgtacaggtcgccttgaaagtcgaacaggtggacttcaagcttttgagaacagccgctatcaacggtgggattgaagccgaaactcgccacgccgcgccgcgtgccgaatgcgccgtctgcttcgacgacaaacacgccgccgagtgcataacggtggcggggcaggcggatgttggcagtcggggcgtttaaggtgcgtccgagttttctgccgtgcaccaccctgccgctcaagacgtagtcgtgtcccaaaagttttttcgcataggcaaggttgccgtctgaaagggcttgtcgcacggcggtactgctggtgcggatgtcttcgacgatgacggaaggcgtacgctcggtctgcatatcgggctgttgtgccaaaagttcaaaacagccttcccgccccgcaccgaaacggaaatcatcgccgacgagcaaataacgcgtattcaaggtttgacgcagcaggcggtcgataaacccttgcgcggatatttcggaaaaattttgatcgaaacgcaaaacccagacggcatcgacacagcctgtgccttccaataattcgagcttggtgcgcagggggctgatccgacacggtggcatcctgccggtgcggagtgcgaaaaattctttgggttggggttcgaaaacgacggtcacgacgggcagtccgcgcgcgtcggcttcgaggcggagtttttggaggatgtgtttgtgtccgaggtgtacgccgtcgaaattgcctatggttacggcggcaccctgtggaaagtcgggcgcgttgtgccgccccagcctgattctcattgttgcattcgggtatgtggtgaaacaggcggtcattgtaaacggtattgcggtttatagacagtgtgccgcccgttacgcccgcccgacgcgggaaaagtaggcaaatttcccgccgccgaacgcgccaaacgcacaaaaacgcgcagcaggcgcggtgctatgtgttgaaacatcgccccaaacctgatgcaacatcagtgaaaatcgttcttttttaaccaggtaaaccgagacaaacaaccctccgccgtcattcccgcgcaggcgggaatccggacctgtccgcacagaaacttatcggataaaaacagttgctcaaaccccgagattctagattcccactttcgtgggaatgacggttcagttgcgttccgacaacaccgtaatcttgaaactcgtcattcccgctcaggcgggaatctagaacgtggaatctaagaaaccgttttgcccgataagtttccgtgcggacaggtccggattcccgcctgcgcgggaatgacggcatttctgcggcaatcggattatttccaaaccaaaagcgcgtggttgcgtttgccgcgccgaaggatagtgtatttgccgaaacgtttgtgttcgccgttcagcaggcaggcatcgtcggggcgttcggcggcgtggttggggttgttggcttcggcaggtttgccgttgagcaaaaccgctttgctgttcacaaagccgcgcgcttctttattggaggatgccaaaccggtttttaccaaggcttcgacgacattgatgccgtctgaaacttcaaatgcaggcaggccgtcgagggcgagctgctcgaagtcgctttcggtcaggctgctttggtcttcggcaaacaggctttcggaaatgcgttgcgcggcggcaagggcttcttcgccgtgaatcaggcgggtcatttcttcggcgaggatgcgttgcgcttcgggcttgctgccgcttgccttgtctttggcttcgatggcatcgatttcttcgatggacaggaaggtaaagtatttcaggaatttatacacatcggcatcggcgactttcagccagaattggtagaactgatagggcgaggtttttttcgcgttcagccataccgcgccgccttcggttttgccgaatttggtaccgtctgatttggttaccaaaggcagggtcagaccgaatacttgtttttggtgcaggcggcgggtcaggtcgataccggcggtgatattgccccattggtcggagccgccgatttccaaaaccgcgccgtggcgtttgttcaactcggcgaagtcgtaaccttgcagcagggaataggcgaactcggtgaaggaaatgcctgcgccgtcgcggtcgatgcgctgtttgacggattctttgttcagcatggcgttgacggagaaatgcttgccgatgtcgcgcaggaagtcaaggcagttcatgctgccgaaccagtcggcattgttcgccataatggcggcatttccgccttcaaagctcaagaaaggggttaattggttgcggatactttccacccagccggcaacagtttcggcggaattcaagctgcgttcggcggctttgaagctggggtcgccgatcataccggtcgcgccgcccaccaaagcaatcggcgtatgccccgcctgttggaagcggcgcaatgccaatacgggcagcaggtgtccgatgtgcaggctgtcggcggtcgggtcgaagccgcaataaagggcaattttttgttcgttcaacaaagcgtctaaggcttcgatgtcggtggtttgcgcgataaggccgcgcgattgcaggtcttggatgacgctcatcggtctctttcaaaaaaaattagcgtttttgcaaaccgccgattgtaacaaatttaagcgaatcaatggttatggcgcgtatcgagaaaccgttgtttttcggaaaaacgctttgccaattccgtgccgccgtaagggttgatgtggtctttgtccgagtaaaccggcaatccgccgatttgaaaatctgcggggatataggcggcggcatcaataatatagacgttggggtatttggctgccaattccctgatgcgtgcattggctttcagggtgctttcgtcgtccgggcgcagggcttggcggtaacccggtatgcgtgaagacaagatataggcgcgctggacgttgtaagacgaggcaaggttgtccgccatcaggtaaacggcttgtttttcggacgagagtttatgcagcatacggtcgaatttttggaaaaaaccggcatcataggcaagggagcggctgttttcgggcatttggctgccccagcgcatcgccaaaaccacttttgaataccggggcaggtgttcttcggcatagcgataaacggcgcggcaggctgcccagttttggaacacacgggacgcgtagccttccacataggcgcaagcgtcggcggaaaccatagtggcggaccatttttcttttttgcccacggcatcgaagaatgttttgtaatggtcggcgtgggagtcgcccaaaaccagcagttccggctgtttttccgtatccccccataggcattgtttgccggtattgttgtggcaggaggtgttggaacgcgtcagccccaagcggtcgtattgcgccataaacggcagtctcatcgcaaaaaacgagcccgcccccaaaatgagcataggcaaggcataaatccataaaacggattgtgcgaacgaaccttgccattttttaaacggtttttcgatgcagtggtaagaaaacagggaaagcagcaatatcaggacgaccgccgccgccggcgaataaggcggcaggttgtccgggccgatatagcgcataaaggccaatatcggccaatgccacagataaagcgaataggaaatcaaaccggcggcaacagtgattttcgattggaaaaattttttaagcgggtgttcgtaatgattgaaataaatcagcgcggcaacagccagacagggaatcaaagcggcggggcccgggaaataggcggtttgttccgaataggaaaacaggcaggttgacaatatgcacacggcaaacaatgcgccgacggcggcacagcgtctgccgacggcaggttgccggcagcgcatccacacggcggtcagcgatcctatcagtaattcgcaggcgcgcaggtggggcaggtaatatttatcgagcgcggaaggtataaaggaggcggcaaggcttaaggcacacagtgcggcaaggaagccgaactgtacgcgcaggcttttgcgggcgacaagcagcagcagtatcggaaagacaaagtaaaattgttcttcgaccgacaaagaccagatgtgcagcaggggcttttcttcctgcgcgggatcgaaataatccttcccccttgcaaaatacaggttagaggcgaaacccaaggcggtcagcgcggatttccacaaaagaaagaaatcatctttggtgaataaaaagaagccgcctgccagcgttgccgccaatacggcgaaaaatgcgggcagaatccgcttgatgcggcggatataaaatgccttcagggaaaacctcccccccccccccgacatttcgcggtgaagaatcgtcgtcatcaaaaagcctgaaatcacaaagaatatatcgacaccgagaaacccgcccggcagccaatccttttcgatatggaacacgatgacggacaagacggcggcggcgcgcaatgtgtcgatgtccgggcggtagggtaaggcttggctcataatgtttttatagtggattaacaaaaaccagtacggcgttgcctcgccttgccgtactatctatactgtctgcggtttcgtcgccttgtcctgatttaaagttaatccactatactcgaaacgcggcggcgcaaatgccgtctgaaaggtcatttcgtatcggggatcgggatattcggaatgccggacggcttcccgtaacggcggggcaggcggtttgttttgcaggaatcggggagggcaaatcggaaatgcgggtgggagtttattttgatgcggctgcattccggcggtacgggaaacgccgaaaatcatcaaaatcggcttcagacggcatttccggcaagccgcctgaaacctgccgcatttgggttacacgttaaacaaaaagtgcatcacatcgccgtcttgcacgacatattccttgccttccacacgcattttgccggcttctttggctttggcttcgccgccgagcgagacaaagtcgtcgtaagaaatgacttgggcgcggatgaagccgcgttcaaaatccgtatgaatcacgccggcggcttgcggcgcggtgtcgcctttgtgtatcgtccacgcgcggacttctttcacaccggcggtgaaataggtttgcagccccaagaggtcgtaaccggcacgaatcaggcggttcaggcccggttcttccaagcccatttcggcgaggaactcggctttttcgtcgtcttccaattcggcaatttcgctctccatcgcggcgcaaacggcgacgacgggggcgttttcttttgccgccaattctttcaggcggtcgaggtgcggattgttttcaaaaccgtcttcggcgacgttgcccacatacatcgccggtttggcggtcagcaggaacagcggtttgagcatcgcgcgttcttccgcgtccaaaccgaaggaacgcacgggtttgccttcgtccagatgcggcagcagttttttgcacaaatcgaccagcttttgcgcgtctttgtcgcctgagcgggcgcgtttttcttcgcggacgatggctttttcgacacttgccaggtcggcaagtgccaactctgtgccgatggtttcaatgtcggcaatcggatcgacgcggcctgcaacgtggacgatgttgtcgtcgtcaaagcagcgcacgacattcacaatcgcatcggtttcgcggatgttggcaaggaactggttgcccaagccctcgcctttgctcgcgcctgcaaccaaaccggcaatatcgacaaattcgacgatggcaggctgcattttttgcggattgacgatttttgccaattcggccatacgcggatcggggacttcgacgatgccgacgttgggttcgatggtacagaaaggatagtttgccgcttcgatacccgattgggtcagcgcgttaaaaagggtggatttgccgacgttgggcaaaccgacgatgccgcatttcaaactcatgttttttcctgaaaatagagaaatttaacggcggattatagcataccgccgcccgcgttccgaaaaaatgccgtctgaaacggcttcagacggcatccggtttcagaaaaccgttcagaacaagccgtgaatcacgccttctgcgtccacatcgattttctcggcagccggaactttgggcaggccgggcattttcatcatgttgccgcacagggcgacgatgaaacctgcgcctgcggaaacggtgatgccgcgcacggcgatgcggaagtcttcggggcagcccaacagtttggcgttgtcgctcaaagagtattgggttttcgccatgcagatcggcattttgtccaagcccagtttttccagtgaagcgatttcggcagacgcttccgcgctgaaatcaacatcttccgcgccgtacactttttgggcaatcgcacggattttgtctttgatgcccaactcgacatcgtaggcgaaaccgaagttattggtttgactttcaatggcgttgacgactttgcgcgccaaatccgcgccgcccgcaccacctttgccccacacttcggtcagggaaacttcaacgccgtgttcggcacaggctttttcaatcatcgccaactcggcatcggcgtcggacacgaagcggttgagcgcaacgacgacgggcagtccgaatacgtttttcaggttggaaatgtgtttcagcaggttgggcaaacctttttccaaagcgtctaaattttcttcgccgaggttggcgcgttccacgccgccgttatatttcaacgcgcggacagtcgccacgacaacagccgcatcaggtttcaaaccggcaaggcggcatttgatgtcgcagaatttttccgcgcccaagtccgcgccgaagcctgcttcggttacggcgtaatcggcaaggtgtttcgccagacgggttgcggttacggagttgcagccgtgggcgatgttggcgaacgggccgccgtgtacgaaggcgggcgtgccttcgatggtttgcaccaagttgggcttaatcgcatctttaagcaatgccgccatcgcgccattcgctttcaaatctttggcgtaaacggggctgccgtctttggcgtaggcgacaaggatgttgcccaaacgctctttcaaatcgctgatgtctttggcaagacagaataccgccatcacttcggaagcaacggtaatatcgaaaccgtcaggacgcatcacgccgtcaacgggtttacccatgccgtcgatgatgttgcgcaactggcggtcgttcatatcgaccacgcgccgccacagcacgcgtttggggtcgatgttcaactcgttgccttggtagatatggttgtcgagcatcgcggcaagcagattatttgccgcaccgatggcgtgaaaatctccggtgaagtgcaggttgatgtcttccatcggcaaaacttgggcatagccgccgcctgccgcgccgcctttcacgccgaacaccggccccagagaaggttcgcgcagggcaatcacggcatctttgccgatgtggcgcaacgcgtccgccaaaccgatggttacggtggttttgccttcgcccgccggagtcgggttgatggcggtaaccaaaatcagcctgccctgtttttgcggcagtttgaacgcttcggcaggattgattttcgccttgtaatgaccgtaaggctcaatgttgtcggcattcagaccaagcttggcggcaatttcgccaatcgggcgcatggtggaggattgggcgatttcggcatcggttttgaagctcatgattttcctttagaaatgaggagggacatgccgtctgaaagcatcaggcgacaaacaggtggattgaaaataatatcaggcatattataacgttatccgcaccaaacccgcagtgaaatttttgacgcagcaacaaaaataccgttcatattgttcacaatccaaggagaaaacatgggcagcaacgcatggctgttttgggcattggcatcggcaggcttcgcctcattgaccgctattttcgccaaaatgggtttacagggtatagattccgatttcgccacctttatccgcaccttggtcatccttgccgctttgttattgtttttaacctacaccggcaaatggcagggtgtgaacggctttacggggcgcaactggacattcctcatcctatccggtcttgctaccggcgcatcttggctcgcctattttaaagccctgcaactgggcaacgcctcgcaagtcgcccccatcgacaaattcagcctggtcttggtcgcgctgatggcggtggttttcttggacgaacgcccgaacacgcaggaatggataggcttggggctggtaacggcgggcgtgttggtgctggcgttgaaacgttaaaccgaatccgccataccgtctgaaaccgggtttttacttccaagcccctgcaagggcttgagcctctttcagacggcataccgtgccgacatccagccacaagcccgtatgcttctgaccgctcacgcggttttgccgcatttcgccacgcaatacgggcgcgagtttcgccacactgcccgcttcgattccgtcaaacatttcaggacggtaaatacccacgccgctgaatgtcaatccgttgccgccatttacttccggccgcacgctgctgtcgggcagcagggaaaaatcgccgtcggggttgtgcggcggattttccaccagccacagatgggcggaaatatgttccggcagggacgatgccgtctgaaacgcggcggtaaaatcgatgtcggtcagcacgtcgccgttgaccaccaaaaacggctgcccacccaacagcggcaatgcctgcgcgatgccgcctgccgtttccaaaccgcctgcgggttcgggcgaataggcgatgttcacgccataagccgagccgtcgcccaaagcatcttctatctgccgacccagccaagcgtggttgatgacgatttcggtaaaccccgcctgcttcagacggcataggtgccaaccgattagaggcttacccgccacatcgagcagcggcttcggagtggtatcggtcaaagggcgcatacgctcgccgcgtcctgccgccagtatcatcgctttcatatatctgtccgaatatcagtctaaaaatctaaactgccgtctgaaatacagcagcgcggggcgtttgcacccgcagtttttgatttcgtcgagcctgacgtaaaacacaaaatgcgtgccgatttcatgtttgccgacaatatgcccgtgcaggtgcgccaacgcgccctctatttcaagttgtcccgttttgccgcgatgccagatgtggtaggcaaaccgctcttcgggcgacaggccggtcagcccggcaaaatgttcggcaacatcctgatgttcgtccgccagcgtattgatgcagaggctgccgttttccgacaggatcggaatgattcgcgcactccggttgatgcacagcatcacggtcggcggctcgtcggtaaccggcgcgaccgccgtcattgtaatgccgtaacgccctgccgcaccgtctgtcgtgatgacatgaacgcctgccgcgcaagatgccatcgcatcacggaacgaagtttgaaaatttttctgcaaatccgccatttttcccctttaaactgtcccctatataagaatgctgcacacaaggcatcccccatgtgcagcagttttgattcaaaaagccgtcggtcggacgtttccgcgcgttacggcgtattacgagttcaacgcatcctcgattttggcaagttctgccaacaggtctttaagcagcagcattttctcgcggcccagcacttcctcgatagcgtcgtagcgttcgtccacttcttcgccgatttcctcatacagcttctcgccctcggcagtcagcttcagaaaaacacgtcgttggtcgttggaaggtttcaggcggacaaccaaacccgctttttcaaggcgggtcaggataccggtcaggctggggcgcaaaatgcacgcctgattcgccaaatcttgaaagtccagcgtgccgttttccgccaaaagacggataatccgccattgctgatcggtaatattcgcctgattcagaataggcctgaattgggtcatcagggcttcccttgcctgtatcagaccgatattgatagacgcatgttttgattgggtaggcattgtttaagtctccaagttatcgaaaatcaaactttcaaaccgtcgggaaagcctgtgggcgtaaattttgatgcaaccgttatataacaaaacgaacatatagcaacaatacgctataaaccgcatcggacgactgggtataaaagactttaattccgataatcctatctaaaaatattttaatagttatatcttaatctatttttcccacaatcacaacaagggattacatcggcaggcgcgtcggctctttcccaaaaaacaaaagccgccgcatccgccgcgcaaggcatatgccgcttgattctctacatagcggaaaatttaataaaaacaaaagttaaccgaaaacatccgcctgaaaaattcgtgcgcgcaagccccaataactgctgattcccgtcgtatagtgaaccattttcccatttttgaccaaaacgacggcaggcgttgcgacaatccgccaagaccttgccaaacccccgtcctcatcgttgacagtcggaaagcccaagccgcgttttgccatatacgccgccacttccgccgaactgccggaacgtaccgccacgccgacgaccggcacgccgtccgccgccaaatcatcgattatcggcgactgataacggcacacgccgcaccagctcccccaaaaatacaccaaaaccgccttatctcggctaaactgtcccaaagtcagccgctgccccgacagcagggtcaaaggccgccctgccgcaccggccggctcttcgggcttgcgtatccaatccaaaaacagcgacaccaataaaaacaccaatgccgtctgaacggcaaatttgatgcccgaaagcagtttctttttcatacgctctctcaaacggtacgcccgcgcaaccggcaggcaaacaaaaagccaagtctcaaaacttggcttccggttatctggtgggtcgtgagcgattcgaacgctcgaccaacggattaaaagtccgctgctctaccgactgagctaacgacccgataagccgtgcattatacagcaccatcctacctcgtcaagcaaattttacaggcttaattgcagaccactgtttgcacgggatattttgacaacggattttcacaatccgccgcataccgtgtaaaagttcgcacaaggaaaagcaaaccgcccgaaatcaatgtacactttccgcccgtttcccttcccaacctgcacacagaaacacacattatgaacatacaaaacatccgcaccctcctcgacaccgtcgccgttccgaatacggcacgcacgctcggcggcgaaaaggccgtccgttcggtcgaacagcgttcagacggcatccatatcgccctgcatttcggcttccccgtcgcgcacattgcctcagaaacagccgaccgcatacaggaaatcctgatgcccgaaacaggcgacacacacatccatctgtccatggacactgaaatcggcacacacaaagtccagcccggcgttaccaccatcaaaggcgtgaaaaacatcatcgccgtcgcatcgggaaaaggcggcgtgggcaaatcgacaaccaccgccaaccttgccgccgcaatggcgcgcatgggcgcgcgcgtcggcgtgctcgatgccgacctttacggcccgagccaaccgaccatgttgggtgtggacgaccgcaaacccgatcagaaaaaccaaaaactcattcccgtcgaatcttcagacggcatacaggtcatgtctatcggctttctcgtcgataccgaccaagccgtcgtctggcgcgggccgatggtcagccaagccttgcagcagctgatgttccaaagcgagtgggacgaagtggactacctgtttatcgacctgccccccggcacgggcgacatccagctcacgctgtcccagcgcatccccgtaaccggttccgtcatcgtaaccacgccgcaggacatcgccctgatagacgcgcgcaaagccgtggatatgttccgcaaagtcaacattcccattttgggcgtattggaaaatatgtccgtccacatctgcaccaactgcggacacagcgaagcactgttcggcacggacggcggcaaagatttcgccgcacgcctcaacgtccccctgctcggacagcttcccctaagcctgcccgtgcgcgaagccatggacggcggcacaccggcgcaactgttcgacgaacaccccgccatcgcccgaatctacaccgatgccgcattccaaatcgccctgagcattgccgacaaaggcaaagacttcagcagccgcttccccaaaatcgtcgtcgaataaagccgcgtccgaaaccgcaacagcaatgccgtcccaagccccgcgcctgccggcgggcaaacttgccggataaaacggtttttttgagattttacgttccggattcccgcctgcgcgggaatgacgaattttaggtttctgattttggttttctgttttgtaggaatgatgaaattttgagttttaggaatttattggaaaaaacagaaaccgctccgccgtcattcccgcgcaggcgggaatctagaccttagaacaacagcaatattcaaaggttagctgaagctttagagattctagattcccactttcgtgggaatgacgggatgtaggttcgtgggaatgacgcggtgcaggtttccgtgcggatggattcgtcattcccgcgtaggcgggaatctagaccattggacagcggcaatattcaaagattatctgaaagtccgagattctagattcccactttcgtgggaatgacgggatgtaggttcgtgggaatgacgcggtgcaggtttccgtgcggatggattcgtcattcccgcgcaggcgggaatctagaccttagaacaacagcaatattcaaaggttagctgaagctttagagattctggattcccactttcgtgggaatgacgggatttgagattgcggcatttatcggaaaaaacagcaaccgctccgccgtcattcccgcgcaggcgggaatccagaccttgggataacagtaatattcaaagattataaaagacccgtcattcccgcgcaggcgggaatccagaccttagaacaacagtaatattcaaagattataaaagactcgtcattcccgcgcaggcgggaatccagactgtcgggcatctgcagcggtttgctaaaaaacgctttaccgtgatcagtgtgcaaagttaaaatggggaggtaagcttttcaatcagcaatccggcgggcgcgggatcgggcggtttaccgaaccccggtgttcgcggcgcgcctgccgccgacggtatcccgcgaagcaagatttaagggataaaatatgttccaacacgcagggcggcacataaggcgccgccctgattcggaagggcttgcacccctcccggacaaagcctgatcctgccgccccgaaggacggatgcccgaagggcggggggtttgaccgaaaaggaaatacgatgaataaaactttaaaaaggcgggttttccgccataccgcgctttatgccgccatcttgatgttttcccataccggcggggggggggggggcgatggcgcaaacccataaatacgctattatcatgaacgagcaaaaccagcccaaggtaaaggggaatgggcaatattcaacaataaaggacaaagacagggaacgcaaatttatctataataaaagcggccggggtggaggctctgtctttttcgacaataccgatacccttgtttcccgacaaagcggtactgccgtttttggcacagccacctacctgccgccctacggcaaggtttccggttttgatgccgacgggctgaaagagcgcggcaatgccgttaattggattcatacgacccacccagggttgataggctacagctacaccagtgtcgtatgcagagacagcacaggctgtcccaaacttgtctataaaacccgattttccttcgacaacaccggtttggcaaaaaatgcgggcagcctggataggcacccggacccaagccgcgaaaattcgcccatttacaaattgaaggatcatccatggttgggcgtgtctttcaatttgggcagcgagaataccgtcaaaaatggcaactcattcaacaaattgatatcttcttttagtgaagacaataataatcaaaccatcgtctctacgacagaaggctcccctatttcccttggcgaccagcagcgcgaacataccgccgtggtctattatctgaacgccaaactgcacctgctggacaaaaaagggattaaagatatcaccggcaaaacagtgcggttgggtgtcttgaagccgagcatcgatgtgaagacacaaaatacggggcttggcggcattctagcttattgggctaggtgggacattaaagataccgggcagattccagtcaagctcggcctgcagcaagtcaaagcaggccgctgcatcaataaaccgaaccccaatcccaacaaaaaagacctttcgccggccctgactgcccccgcgctgtggttcggacctgtgaaagatggtaaggcggagatgtattccgcttcggtttctacctaccccgacagttcgagcagccaaattttcctgcaaaacctttcccgcaaggatgacacaagcaaaccgggccgctattccctcaaacccttgagtacgtcggagattaaaagtaaagagccgagtttcacggggcggcaaaccgtcatccgattggatggcggcgtacggcatatccaactggatagaaacaatgaggccaccggtttaaatggaaatgacggcaaaaacgacactttcggcattattagagaagggagcttcatgcctgatgccagcgagtggaaaaaagtattgctgccttggacggttcggggttttgctgatgacagtaaatttaaagcattcaacaaagaagaaaacaacgacaacaagccaaaatacagccaaagataccgcatccgcgaaaacggcaagcgcgatttgggcgacatcgtcaacagcccgattgtcgcggtcggcgagtatttggctacttccgccaacgacgggatggtgcatatcttcaaaaaaggcaacggggacgcgcgcgactatagtctgaagctcagttatatcccgggcacgatgccgcgcaaggatattcaaaacaccgaatccacccttgccaaagagctgcgcacctttgccgaaaaaggctatgtgggcgaccgctatggcgtggacggcggctttgtcttgcgccgcattacagatgaccaagacaagcaaaaacacttctttatgttcggcgcaatgggctttggcggcagaggcgcatacgccttggatttaagcaaaatcgacaacagcaacccggccggcgtttccatgtttgatgtcaaaaacgacaatggcgtgaaattaggctacaccgtcggtacgccgcaaatcggcaaaacccacaacggcaaatacgccgccttcctcgcctccggttatgcgactaaagacattaacaacggcgagaataaaaccgcgctgtatgtgtatgatttggaaaacaacaacggtacgccgattgcaacaatcaacgtacccgacggcaagggcgggctttcgtcccccacgttggtggataaagatttggacggcacggtcgatatcgcctatgccggcgaccgcggcgggaatatgtaccgctttgatttgagcaacaacgatccgaccaaatggtctgtacgtactatttttaaaggcacgctggataagccgattacctccgcgcccgccgtttccaaactgaaagacaaacgcgtggttatcttcggtacgggcagtgatttgagtgaggatgatgttgataaaaaggatatacaatctatttacggtatttttgacaatgacacaggcacggatgtggcagaagaaggacagggcaaagggttgctcgagcaacaccttactcaggaagataaaaccttattcctgaccgattacaagcgatccgacggctcgggcgacaagggctgggtagtgaaattggaagccggacagcgcgttaccgtcaaaccgaccgtggtattgcgtaccgcctttgtaaccatccgcaaatataacgacggcggctgcggcgcggaaaccgccattttgggcatcaatactgccgacggcggcaagctgaccaagaaaagcgcgcgcccgattgtgccggaagccaatacggctgtcgcgcaatattccggtcataagcaaaccgccaaaggcaaatccatccctataggttgtatgtggaaaaacaatgaaaccgtctgcccgaacggatatgtttacgacaaaccggttaatgtgcgttatctggatgaaaagaaaacagacggattttcaacaacggcagacggcgatgcgggcggcagcggaacattcaaagagggtaaaaaacccgcccgcaataaccggtgcttctccggaaaaggtgtgcgcaccctgctgatgaacgatttggacagcttggatattaccggcccgatgtgcggtatgaaacgaatcagctggcgtgaagtcttcttctgatttgcacgcgaaaatgccgtccgaaaggttttcggacggcattttttgcgtttttcgggaggggcgggttcgtaaaaggcgggctatagggtaggcttcatctcgccaatctcactgaatccatcaatttccacaattcaattaaataccgtcaaaccgatgccgtcattcccgcgcaggcgggaatctagacattcaatgctaaggcaatttatcgggaatgactgaaactcaagaaactggattcccactttcgtgggaatgacgggatgcaggttcgtgggaatgacgtggtgcaggttcgtaggaatgacgtggtgcaggtttccgtgcggatggattcgtcattcccgcgcaggcgggaatccagacattcaatgctaaggcaatttatcgggaatgactgaaactcaaaaaactggattcccactttcgtgggaatgacgggattagagtttcaaaatttattctaaatagctgaaactcaacgcactggattcccgcctgcgcgggaatgacgaagtggaagttacccgaaacttaaaacaagtgaaaccgaacgaaccggattcccactttcgtgggaatgatgggattagagtttcaaaatttattctaaatagctgaaacccaacgcactggattcccgcctgcgcgggaatgacgaattttaggtttctgattttggttttctgtttttgtaggaatgatgaaattttgagttttaggaatttatcggaaaaaacagaaaccgctccgccgtcattcccgcgcaggcgggaatctaggacgtaaaatctcaagaaaccgttgtacccgataagtttctgcgccgacaaacctagattcccgcctgcgcgggaatgacggttcagttgcgtaggactggattgtgaaaaggggcggattcggtgaaaacggcggaaatgtgggattgatggaatcggtgggctgaagccctccctacagagctttcagacggtattgtttgcgttttcgggatgggggcaaatgaaacaccgacaaaccgataccgtcattcccgcgcaggcgggaatctagacattcaatgctaaggcaatttatcggaaatgactgaaactcaaaaaactggattcccactttcgtgggaatgacgattcggacattccttaaactacccgtgtatcgctgtaaatcttagagatggaggaataaagaccgttgggcatctgcagccgtcattcccgcgcaggcgggaatctaggatgcggaatctcaagaaaccgttatacccgataagtttctgcaccgacaggtctggattcccgcctgcgcgggaatgacgattcgggtatttctgacggttcgggcattcccgacaaggtggattttcaaggtgttgtatagggtgtaggaggattcgtaaaaggtgagttatagggtgggcttcagcccaccgattccaacgattccaccaatcctacaccgttcccatagactcaaatcaacacagaaacttatgcgccgtcattcccgcgcaggcgggaatctaggatgcggaatctcaagaaaccgttatacccgataagtttctgcaccgacaggtctggattcccgcctgcgcgggaatgatggttcgggtattcctgacgattcgggtattcctgacgattcgggtattcctgacgattcgggtattcctgacgattcaggtattcctgacgattcaggtattcctgacgattcaggtattcctgacgattcaggtattcctgacgattcaggtattcctgacgattcaggtattcctgacgattcaggtattcctgacgattcaggtattcctgacgattcaggtattcctgacgattcaggtattcctgacgattcaggtattcctgacgattcgggtattcccatagtttcgccgggcggacgtggggaaatgcgtaacgggcatagtgggcgcggagcgggcggttttatgccccggatttccgttttcgcgcgaacatatcagcccgcctgccgcgtttgcgcttgaaatcgggtatgtttcgtcttaaaatatgctgctttcagggtataggcacttgcccgaaaagcacgttacgcgtctatcttgcgcggcgtgtttttttttgaccggatttttccgaccggatgccccctgccgaagtcccttcagacggcattgtcaagaattttattaaaaacaggattcccatcatgagcacccccgccctcctcgtcctcgctgacggcagcgtatttcacggcacatcaatcggttacgaaggttcgacttccggcgaagtcgtgttcaatacttcgatgaccggctatcaggaaatcctgaccgacccgtcctactgcaaacaaatcgttaccctcacctacccacacatcggcaacaccggcaccaacgccgaagatgaagaaagccgcagcgtttatgccgccggcctgattatccgcgacctgccgctcttgcacagcaacttccgcgcctccgaaagcctgcacgactatctggtacgcaacaaaaccgtcgccatcgccgacatcgacacccgccgcctgaccacgctgttgcgcgaaaaaggcgcgcaaggcggtgcgattctgaccggtgcggatgccacaatcgaaaaagcgcaagaactcatcgccgcgttcggcagcatggtcggaaaagatttggcaaaagaagtttcctgcacggaaacttacgaatggacggaaggcgaatgggcattgggcaagggtttcgttacccctgacgaacagccttaccacgtcgtcgcctacgatttcggcgtgaaaaccaacatcctgcgtatgctcgcctcgcgcggctgccgcctgaccgtcgtccccgcccaaacgagcgcggaagacgtgttggcactcaaccctgacggcgtattcctatccaacggccccggcgaccccgagccttgcacctacgccatcaaagccgtacaaaaactgatagaaagcggcaaaccgatttttggcatttgcttgggacaccagctcatcagcctcgccatcggcgcgaaaaccctgaaaatgcgcttcagccaccacggtgcgaaccaccctgtgcaagatttggacagcggcaaagtcgtcatcaccagccaaaaccacggttttgccgttgatgccgacaccctgcccgctaacgcacgcattacccacaaatccttgtttgacaacactttgcaaggcatcgagctgaccgacaaacctgtgttctgcttccaaggccaccccgaagccagccccggtccgcaagatgtcggctatttgtttgacaaattcattggcaatatgaaagcggcaaaacgggcataatggttttcagacggcaacagtatgctgctgccgtctgaaaaacaaagctggaaatgaagattagcgcactcgaccatctagtactaactgttgccgacattgaccgaaccatcgcgttttatagtgaattaaatttaaaccggtacagcgttggctcgccttgccgtactatttgtactgtctgcggctcgccgccttgtcctgatttttgttaattcactatacacacaagttttgggcatggaagaagtttcatttggcagcgaccgtaaagctttgttgtttggcagtcagaaaatcaacctacacgggcgcggtgcggaaattcagcctaacgcgcaacacgccgcctgcggcacagcggatttatgcctgctgaccgatacgccactggaaacggttttacaggaattatccgcacacggcatcaaacctttaagcggcatcgtagcgcgcacaggcgcaatgggcaaaatccaatcggtttacctgcgcgatcccgatggcaacctgctggaaatcagcagttattgattttcagacggcttatgcaaaataaaaaacagcctgcacaagctgttttccttgcagcctctttaaccccaacagccgccccgtcctctctccctgtgggaaagcgttagagagagggcaacaagccgcaaggcttgtgtttgggcggttagggtgttggggaaggttgccgaaattcggggaatgccctctccccggccctcccccacgggggagggagaaggttgcagcagattttgcggttgcaggcggtttgaaaggcaacttagatttgcagctgttgtttcaggtcatctgaaaaataaaaagcagcctgcacaacctgttttccttgcaaaacccttaatcccaaccgccaccacgtcctctctcccatgggagagagtcagagagagggcaacaaactgtaaggcttacacaaacagtaacccgacaacagaatgagcacgcacgagaaacttttaaccgccgacaaccccgtcctgcatcaacgcgccaaagccatgcgccaagaaatgagcgaggcggaagcaaaattgtggcagcacctgcgggcaggccgtctgaacggctataaattccgccgccagcagccgatggggaattatattgttgattttatgtgcgtaacgcccaagctgattgtcgaagcagacggcgggcagcacgcggaacaagccgtatacgaccacgcgcggacggcatatctcaacagcctgggctttaccgtgctgcgtttttggaatcacgaaattttgcagcagacaaacgatgtactggcggaaatcctgcgcgtattgcaggaattggaaaagcagtatgcgcaataacaaacggttaattttgattagagttttgaaaattataggatacaggtagggtacaggctgcttgaattgagcgtttagaagaccgtctgaaaaacaaaaaacagcccgcacaacctgtttttcctgcagaacccttaattccaacagccgccccgtcctctctccctgtgggaaagcgttagagagagggcaacaagccgcaaggcttgtatttaggcggtgaaggcattggggaaggttgccgaaattcggagaattccatctccccagccctcccccacgggggagggggcaggttgcagcggattttgcggttgcaggcggtttgagaaagaatgcccgaaatatcaacagcgggaatttttcaggcagcctttatcgcaaggcaggtggaacaaacgccgcgaacgttttttcagacgacctttgaactcatcggcagagagtgtgccgcaaggcacgcacgcggtgggttggggttgcagggaaaatggagaacgcgtgcatacgtaccgcacataccctacatacgggctacggcttgctacgatacgggggtttcgatatacaagttaggttttagcaaacccaacattttagacaattaagcggtttgtgttgggttttcaacccaacctacgcttgctacgtttattgcaacatattcgcaggagtttaaatatgtcaatacctattaatttcaataatttaaagtatttgcttaatgatatgagaaacaaaaatagaataattgaagcatttccttttaattataatcaaaggcaatacgccgttattttgactaggtataaacctgatgaacctagaccagatgattatgcacaagcaaaattagagttttttaatttgaatagtgaaaattcaatatttgcgtatgctgatttttatgaagttcattttaaaagtgctactgattttattaatttttttaaaattaatgttcaggctggtgctgcgaaaatcagagaaatttttcagagttttagtaatctttttgcagatttcattccaacacaaactaaaaaagatttagacataatttataaaaagattgtagctactcgtttagaacctaattctcctaacactatttattgctatgatgtccgtagaaatgggaaagataaggctggcaagcctaatcgcaggagcgtggaaaatagtgaaaaagcaaaaattttgcgcccagagctatacgaaaaatttaaagccgatagtaattacagttttttcttttcagataatccaagcgatgaaaaaacagatgcagaaataattagagaagttaccaatcgtcaataatccaaattcttcaaaagaaagacccaccatgcccaaacgtaccgacctaaaatccatccttatcatcggcgccggccctatcgttatcggtcaggcctgcgaatttgactattcgggcgcacaggcctgcaaagccttgcgtgaagaaggctataaagtcattttggtgaattccaaccccgccacgattatgaccgaccccgaaatggcggatgttacctacatcgagccgattatgtggcagacggtggaaaaaattattgccaaagagcgtcctgacgcgattctgcctaccatgggtggtcagactgcgctgaactgtgcgctggatttggcgcgcaacggcgtgctggcgaaatacaatgtcgagctgatcggcgcgaccgaagacgccatcgacaaagcagaagaccgtggccgctttaaggaggcgatggagaaaatcggcctctcctgcccgaaatcttttgtctgccacacgatgaacgaagctttggcggcgcaagaacaggtcggcttccctaccctgattcgtccttctttcaccatgggcggttcgggcggcggcattgcctacaataaagacgagtttttggcgatttgcgaacgcggtttcgatgcgtcgcccacgcacgagctgttgattgagcagtccgttctcggctggaaagagtacgagatggaagtggtgcgcgataagaacgacaactgcatcatcatctgctcgattgaaaacttcgacccgatgggcgtgcatacaggcgactcgattacggttgcgccggcgcaaacgctgacggacaaggaatatcaaattatgcgtaatgcttcgctggcggtattgcgcgaaatcggcgtggacacgggcggctcgaacgtgcagtttgcggtgaaccctgcaaacggcgagatgattgtgattgagatgaacccgcgcgtgagccgttcttccgcgttggcttccaaagcaacgggtttcccgattgcgaaggtggcggcgaagctggcggtcggctttacgctggacgagttgcgcaacgacatcaccggcggcaaaacccccgcgtcgttcgagccttccatcgactatgtggttaccaaaatcccgcgtttcgcgtttgaaaaattccctgccgcagacgaccgcctgaccacgcagatgaaatcggtgggcgaagtgatggcgatgggccgcacgattcaagaaagtttccaaaaagccctgcgcggcttggaaacaggcttgtgcggcttcaatccgcgcagtgaagacaaagcggaaatccgccgcgaactggcgaaccccggccccgaacgtatgctgtttgtggcagacgcgttccgcgcgggcttcacgctggaagaaatccacgaaatctgcgccatcgacccttggttcttggcgcaaatcgaagacttgatgaaggaagaaaaagcggtttcagacggcattttgagtgatttggatttcgccgccctacgtcgtctgaaacgcaaaggcttctccgacaaacgtttggcacaattgttgaacgtaagcgaaaaagaagttcgcgaacaccgctacgcgctgaagctgcatccggtttacaaacgcgtcgatacctgcgccgccgagttcgccaccgaaaccgcctatctttactccacttacgaagaagaatgcgaatctcgtccttccgaccgcaaaaaagtgatgattctcggtggcggcccgaaccgcatcggtcagggcatcgagtttgactactgctgcgttcacgccgcgctcgccctgcgcgaatcgggctttgaaaccatcatggtcaactgcaaccccgaaactgtgtccaccgacttcgacaccagcgaccgcctgtatttcgagccgctgacgctggaagacgtgttggaaatcgtccgcaccgaaaacccgtggggcgtgattgtgcattacggcggccaaaccccgctcaaactcgccaacgcgctggttgaaaacggcgtgaacatcatcggcacgtccgccgacagcatcgacgccgccgaagaccgcgaacgcttccaaaaagtgttgaacgacttaggcctgcgccaaccgcccaaccgcatcgcccacaacgaagaagaagcgctcgtcaaagccgaagaaatcggctatccgctggtcgtgcgcccgtcttacgtcctcggcggccgcgccatgcaggtcgtccattccgccgaagagctgcaaaaatacatgcgcgaagccgtgcaggtttccgaagacagccccgtgttgctcgacttcttcctgaacaacgcgattgaagtggatgtggactgcgtttcagacggcaaagacgtggttatcggcggcatcatgcagcacgtcgaacaggcgggcatccactccggcgactccggctgctcgctgccgccctactccttaagcgaagaaatccaagacgaaatccgccgccaaaccaaagcgatggcgtacgcgctgggcgtggtcggactgatgaacgtgcagtttgccgtacaagacggcgtagtgttcgtattggaagtgaacccgcgcgccagccgcaccgtgcccttcgtctccaaagccaccggcgtgccgctcgccaaagtcggcgcgcgctgcatggcaggcatttccctgaaagaacaaggcgtggaaaaagaagttgtccccgatttctatgccgttaaagaagccgtgttcccattcatcaaattcccgggcgtggatacgattttgggaccggaaatgcgctccaccggcgaagtcatgggcgtgggcgcaagctttggcgaagcctactacaaagcccaactcggcgcgggcgaacgcctcaacccgaccggcaaaatcttcctctccgtgcgcgaagaagacaaagaacgcgtcattaaaaccgctaaaaacttccaagttttaggctacggcatctgcgccacgcgcggcacggcgcaatacctgaccgaacacgggctgattgtgcagaccatcaacaaagtacccgaaggccgcccgcacatcggcgacgcgctgaaaaacggcgaaatcgcactggtcgtgaacaccgtttccagcgatccgcaatccgtgtccgacagccacatcatccgccaaagcgcattgcagcaacgtgtgccgcaatacaccaccaccgccggcggcgaagcgatgagcgaaggcgcgaaaagccgagaccatctgggcgtgtacagcgttcaagaactgcacgggcgtttgaaaaaccgcaactgatgcctgaatcaggttgaaaatgccgtctgaagccgttttgcggtttcagacggcattttgtcatttggaaagccgatgttgccacacacaagccgtacataaggaacagccctatcacgctccccatatagattgccattgccgccgactatacattatcttatttattttttctcaaagttattaagtgagtaaaaacagttttatgacaggtttttatagaattatccacagagattgtttcccagttcctccactaaaaaatccaaaaatacgcgtaagcggagattgacggctttatcgctgtaataaacagcattaaaggggtgtgttttatcggaggtttgttcggcgagcaggggaattaactttccttcagcgatgtcgttgtcaaccaaaaaatctgataagcaaacaataccgcaacctgaaaggcacaacgagcgtaagatttcaccgctgctggcggtaaagtgcggtgaaatcttatagggatttccctgcgcatctaaaaccgcccatgtatttagagaaccgggttcggtgaagcctaaacattggtggccggcaagctcttctgtagattgcggcgtgccgtgttttgccaggtattcaggactggcgattacgcggaagcggctgtcaaacagatggcgtgcacgcagcccggaatcgtccaattctccggcccgtaaggcaatatcgactttgcgttcaatcagattgatatagccttcggaagaaacgagcgaaagtcggatatgcggatagcgttcgttgaattttgctgccagcggcgccagcagatgcagcaccatcggcatcgcggaatccacgctcaacacgccttgcggtatttcgtgcactgccagcatttcggtttccgccgctgccatttcttgcaggattctctgcgcgcggcggaaatattgcgcgccttcttccgtcagactgagttgccgcgtggtgcggttgagcaggttcacacccaacttttcctccagccgtttgacgatgcggcttacggcagaatttgccatcgccaactgctccgccgcacggctgaagctgccgctttccaccacttgaacaaatacggtcagttcttctgaattggttttcatcgtgtttccttttcggttggaaccccgccctttagggcggcaggatcagactttatttgggaggggtgtaaccccttccgaatcaggacggcacacagggcggtgctttatgtgccatcccgtgtgttggaacatctgattatttcatttgacgcaaaagtgttttcttatttttgcacttttaaattataaagtaaaacggcacaatacattcatcaattcacaaacgaggtaacaaatgaatattttattattagacggcggcaaggcgttcggacattctcacggcgggttaaaccgtacgcttcacaaaaaagcgaaagaagttttgaccgcgctcggacacaatgttcaagaaaccgtgattgatgccggctatgatgttgaggcagaaatcgaaaagttcgtttggatggatgctgtgatttggcagatgccgggctggtggatgcacgagccttggacagtgaaaaaatacatagacgaagtattaaccgctggacacggcaaactctaccaaagcgacggcagacacagcgtcaatccgactgagggctacggcacaggcggcttgttgcaaggcaaaaaacatatgatttcactgacttggaatgcgccgattgaagcctttacccgcgaaggcgatttctttgaaggcaaaggcgttgatgttttgtatatgcacttccacaaagccaacgagtttttgggtatgacccgcctgccgacattcttatgtaacgatgtggttaaaaatccgcaagtggaaaaatacttggcagattatcaggcacacttggaaaaagtgttcggctaaaaatttatcttataaacaaacaaaggcagcctgaaagattgaatggtctgcacccctaaggttggactaaccaaccgactaaggtgcagattattttttgttgctttttcagcttttcgttgggttagatattcttgcccactgttttcaggcagccttgaatacaaaaaaatggcgtatgtaatatgtttatacgaccaaaacggaatgaattttaacgtattgcgcgtcatcaacaatgactgagtttctcgcctctcgcgcctgaatctatagtggattaacaaaaaccagtacagcgttgcctcgccttgccgtactatttgtactgtctgcggcttcgttgccttgtcctgatttaaatttaatccactatatgtcatgcagttcctttcattcaaatcaacaaaagaatgccgtccgaacgtccgttcagacggcacttgtcttcccacaatagacttgaggctgttctaacgtaccaccccttcgttccgccccaaaaccatcgcatcgccgtagctgaagaaacggtattcgcgttcgaccgcatgacgatacgcggcgcggatatgacccatacccgaaaacgcgctgaccaacatcagcagcgtcgatttcggcaaatgaaaattggtaaccagtctgtcgacaacattaaaacggtagcccggcgtgatgaaaatatcggtgtcgccctgccccgctttcagacgacccgtcgcacgcgcggcagattcgagggcgcgcatggaagtcgtgccgaccgcccagactttgttcccccgggcttttgccgcctcaacggcggcggcggtttcagacggcacttcaaaccattcgctgtgcattttgtgctcttcgattttgtccacacgcacgggttggaacgttccggcaccgacgtgcagggttacttctgcggttaccgcgcctttgtctttcagacggtgcaaaagttcttccgtaaaatgcaggcccgccgtcggcgcggcgaccgcgccctgatatttggcataaacggtttgataacggctgtcgtcatccgcatcggcggcgcgttcgatataaggcggcaggggcaggtgtccgttctgttccaaaagttcgtaaacggtctctccgccttcaaaacgcaggcagaacagttcgccctcacgcccgaccgtcacggcgcggatgccgccttcaaacaccagccccataccgggcttgggcgatttggacgaacggatgtgcgccagtgcggtatggttgtccaacacgcgctcaatcagggcttcgatcctgccgccgctgtctttctgcccaaacagccgcgccttcatgactttggtgttgttgaacaccaaaacgtcgcccgcctcgacataatccggcaaatcgccgaacacccggtcttgcagcggcatatcgggcaacgcaaccaaaaggcggctgctgccgcgcacttcgggcggatgctgggcaatcagcttttcgggcagggtaaaatcaaaatctgaaatatccatttttacactctcgttcgggcaagccgccattatacgcactttagccctttttcagacggcatctttgtccgaaaaaccaacagattagaataaacactcttaacctggaacatcttgtgcgcaaaatcaaacttcctgcacatttcccccaaaaaccgccgttttttgatattttactggacatttaccgacaacttcgggaaaataaacacattctcacggtcgttttccaccacaggaaaaccgtatccgaacaccattccgcccggtttgcgccgttgccgcaagccggctgttttctgaaaaaccaacgcaacaacccgccggaacaccggcagcctttaaaggaacagaaatggatttgcgcaaattaaaaaaactgattgatttggttgaagaatcgggtatcgccgaaatcgaagtaaccgaaggcgaggaaaaagtccgcatcacccgaaccatcgccgccgcacccgtttacgccgcgcccgtacctgccgccgcgccggccgtaacgcctgccgccgcacccgttgcggcatccgcgcccgccgccgcacctgccgcccgcgatttgtccgacgcgcaaaaatcgcctatggtcggcacgttctaccgcgcacccggcccgaatgccgcgccttttgtcgaagtcggccaacaagttaaagccggcgacacgctgtgcatcatcgaagcgatgaagctgatgaacgaaatcgaagccgaaaaatccggcacggtcaaagaaattttggtcgaaaacggtacgcccgtcgaattcggcgaaccgctcttcattatcggataatcctgttttcagacggcataaacttccgatgccgtctgaaatgctttcccccttcagcgttcccgcacccttttttacggacgggttgccggaaccgcaggaaaggtcatcatgctgaaaaaagttttaatcgccaaccgaggcgaaatcgcattacgcgtactccgtgcctgccgcgaaatgggcattgccaccgtcgccgtgcattccgaggccgacaaagacagcctgcacgtcaaactcgccgacgaatccgtgtgcatcggccctgccgcttccgcgcaaagctaccttaacgtccccgccattatcgccgccgccgaagtaagctgcgcggacgctgtccatccgggttacggtttccttgccgaaaacgccgatttcgccgaacaggtcgagcagtccggctttacctttatcggcccgaaacccgacaccatccgcctgatgggcgacaaagtctccgccaaacacgcgatgatagcggcaggcgtaccctgcgtccccggttctgacggcgcattgcccgacgacggcgaagaaatcctcaaaatcgccgataaagtcggttatcccgtcattatcaaagcctctggcggcggcggcggccgcggtatgcgcgtggtcgagaaaaaagaagacctcctccaatctgtcgaaatgaccaaagccgaagcaggcgcggcattcggcaacccgatggtttacatggaacgctatttgcaacgtccgcgccacgtcgaaatccaagtgattgccgacgaacacggcaacgccatctaccttgccgagcgcgactgttcgctgcaacgccgccaccaaaaagtcatcgaggaagcaccggctccgttcatcactgaaaaagaacgcgccaaaatcggcaacgcctgtgccgatgcctgcaaacgcatcggctaccggggcgcgggtacgtttgagtttttatacgaagacggcgaatttttctttatcgagatgaacacgcgcgttcaggtcgagcatccggttaccgagctcatcaccggcgtggacatcgtgcaggagcaactccgcatcgccgccggcctgcctttgcaatacaaacaaaaggatattcaagtcgaaggccacgcgtttgagtgccgtatcaacgccgaagacccgtacaacttcattccaagcccgggcctgattgaaagctgccacctgcccggcggcttcggtatccgcgtggacagccacatttaccaaggctaccgcatcccaccgtactacgacagcctgatcggcaaaatctgcgtacacggcaaaacgcgtgaacaggcaatggcgaaaatgcgcgtcgcactcgccgagctggcggtaaccggcatcaaaaccaatacgccgcttcaccgcgacctgttcgccgatgcgggtttccaaaaaggcggcgtcagcatccactatttggaacactggctggaagatcgcaaagccaaacaggacaagtaaaccgccgccgatatgccgtctgaagccgcccgtccgcgttcagacggcatttcccttgccccgcgccgtctgaaaccgatttcgatatagtggattaactttaaaccagtacggcgttgcctcgccttagctcaaagagaaagattctctaaggtgctgaagcaccaagtgaatcggttccgtactatttgtactgtctgcggcttcgtcgccttgtcctgatttaaattcaatccactatatttccaagaaagcccgttatgccctaccaacaaatcaccgtcaacgtcaacgatgccgtcgccgaacgcctcgccgacgcgctgatggaacacggcgcactctccgccgccatcgaagatgcctacgccggcacgcaaaacgaacaggcgattttcggcgaacccggtatgcccgccgaacaaatctggcagcagagcaaagtcatcgccctgttcggcgaacacgacgaagccgccgccatcatccaaaccgccacacaagaatgcgggttaaaagacttggcatacaccggcgaaaccatcgaagaccaagactgggtgcgtctcacgcaatcgcaattcgaccccatccggatttccgaccgcctgtggattaccccctcttggcacgaagtccccgaaggcagtgccgtcaacctccgcctcgaccccggactcgccttcggcaccggcagccacccgaccacgcgcctctgcctcaaatggttggatacgcaactcaaaaacggcgaaagcgtcctcgactacggctgcggttcgggcatcctgaccatcgccgccctcaaactcggtgcaggtttcgccgtcggcgtggatattgacgaacaggccgtccgcgccggcaaggacaacgccgcgcaaaacaacgtcgatgcacaattcttcctgcccgacggtctgcctcaagggcaattcgacgtagttgtcgccaacatcctcgccaaccctttgcgtatgcttggcgaaatgctcgccgcccgcaccaaacagggcggacgcatcgtgttgtccggtttgttggacgaacaggccgaagaactcggcggcatttacagccaatggttcgacctcgacccggcggaaaccgaggaaggatgggcgcgattgagcggcgtaaaacgctgaaacggaaaggaaacaccgtgcaggataaaaacaacctctgctggctcgatatggaaatgacggggctgaatcccgaaaccgaccgcattatcgaagtcgcgatgattattaccgactcggatttgaatgtgttggcgcaatccgaagtttacgccgtccaccaaagcgacgacgtgctgaacaaaatggacgaatggaacaccgccacacacggcaggacggggctgacacagcgcgtacgcgaatcgtcgcataccgaagccgaagtcgaacagaaactgctggactttatgtcggaatgggtacccggacgcgccacgccgatgtgcggcaactccatccaccaagaccggcgttttatggtcaaatatatgccgaaactggaaaactacttccactaccgcaacctcgacgtttccacgctgaaagaactcgccaaacgctggaatccgcccgttgccaaaagcgtcgtcaaacgcggttcgcacaaggcattggacgacattttggagagcatcgaagaaatgcgccactaccgcgaacactttctgatttccgccccgagagccgaagcgcaataagaaacaaacaatgccgtctgaaacgcagtttgcatttcagacggcatttttacagcagattgaaatcaaaaatatacacgcccgtcattcccgcacaggcgggaatccggaaggtcgggcctgccgttattttcaatcattacagaaactgaaaggtctggattcccgcctgcgcgggaatgacgggcgtgtgcattcttatagtggattaacaaaaatcaggacaaggcgacgaagccgcaaacagtacaaatagtacgaaaccgattcacttggtgcttcagcaccttagagaatcgttctctttgagctaaggcgaggcaacgccgtactggtttttgttaatccactatacttcaatctgccaaacagatcgaacagagaaaccctgtccgtcaaaacatcattcagccatcgccttgaacacttcaaccgcaaccgcaaccgtttcgtcaatcagctcgggcgtatgcgcggcggaaacgaaacctgcttcataagcggacgggccgaaggcgacattgcggtcgagcatcccgtggaaaaactgtttgaagccttcaatattggaacgcgccatatcggcatagtttcgcggcgcgtgtgcggcgaaatacagaccgaacataccgcccacgctgtcggcggtgaactcgatgcccgccgcatccgctgccgtccgaaaaccttgaaccaactgttcggtacgcgccgtcaggttttcatagaagccttcgcgctggatgatttccagcgttttcaagcctgcggcgacagcaatcgggttgcccgacaaggtgcctgcctgatacacgccgcccagcggggaaatacattccataatgtctttgcgcccgccaaacgcggcaagcggcataccgccgccgatgactttgcccatcgtggtcaggtcgggcgtgatgccgtgcaaagattgcgcgccgccgagcgcgacgcggaagccggtcatcacttcgtcgtaaatcaacaccgcgccgtatttttcggtcaatccgcgcaaggctttgacaaaggcttcggtcgggcggacgaggttcatattgccgacgaagggttcgacaatcacgcaggcgatttcattgccgctttgagcaaaggcttcttcgagttgggcgatattgttgtactcgagtaccaaagtgtgtttggtaaagtcggcaggcacaccggcggaagacgggttgccaaacgtcagcagaccgctgccggctttcaccagcaggctgtcggaatgcccgtggtagcagccttcaaacttgatgattttgtcacgcccggtaaaaccgcgtgccagacggatggcggtcatggtcgcttcggtaccggagctgacgaggcgcagccgttcgacggacggcatgattttggcgatttcttcggcaatgacgatttcgccttcggtaggcgcgccgaacgacaaaccgcccaatgcggcttcgcatacggtttcgacgacttcggggtgcgcgtgtccgacaatcgcaggtccccacgagccgacgtaatcggtatagcgcgtgccgttttcgtcccaaacatacgcgccttcggcttttttgataaagcgcggtacgccgccgacgctgccgaatgcgcggacgggggaattcacgccgccggggatgatggctttggcgcggtcgaataaaatttcgttacggttcatatatatcctcaaatgccgtctgaacggcaggtttcgggcttggaagcagaaagccccattttatcatttttcaggttgcgacaaggatttgcccgcttctttgcggatcacgccaaccgcatcccggatgacggaacgctcgtctttttccactttatgtgtaaagcggtagtctcggacgactccctccccgtcgtaatccacacaccactcccaatgtcggcgttctgatttcatataaatgaaattggtcggcaaaaaattataaatcggcaggctgacttcatgataggcataacaaccgaaagggttgcgcttcccgaaacgtgcctctacacctccgcccgggtcgttttgcctttaacaaccgtttgtgcgattccctcttccgtctgatatagtggattaacaaaaatcaggacaaggcgacgaagccgcagacagtacagatagtacggcaaggcgaggcaacgctgtactggtttttgttaatccactataacgcaggaactgatgttccctgtcgccgaaattgctggtacacgcacacagcagcaatgccgcccatacagccggtttcatacacatctcccattaaagccaaacattatacagccgtcccgaccgattaaattcatattttaaaacaatatcctgcctccaaaacccacatcgtgctataatccgcaccgattttcagacggcatcgtcgtgccgtctgaaattttttcattccaacaacaatcagccccgcgattacggctgcctgagaaagacacaaaccatgaaaaaagtatttatccgcaccttcggctgccagatgaacgaatacgacagcgacaaaatgctcgccgtcctcgccgaagaacacggcggcatcgaacaggttacccaagccgacgaagccgacatcatcttgttcaacacctgctccgtgcgcgaaaaagcgcaagaaaaagtcttctccgatttggggcgcgtgcgtccgctcaaagaaaaaaaccccggcctcatcatcggcgttgccggctgcgtcgcctcgcaagaaggcgaaaacatcatcaaacgcgcgccttatgtggacgtggttttcggcccgcaaacgctgcaccgcctgccaaaaatgattgtggacaaagaaaccagcgggctgtcgcaagtcgatatttccttccccgaaatcgaaaaattcgaccacctgccgcccgcccgcgtcgaaggcggcgcggcatttgtatcgattatggaaggctgttccaaatactgctccttctgcgtcgtcccctacacgcgcggcgaagaattctcccgcccgctcaacgacgtattgaccgaaatcgccaaccttgcccagcaaggcgtgaaagaaatcaacctcttgggacaaaacgtcaacgcctatcgcggcgaaatggacgacggcgaaatctgcgacttcgccaccctgctgcgcatcgtccacgaaatccccggcatcgaacgtatgcgcttcaccaccagccacccgcgcgagtttaccgactcgattatcgagtgctaccgcgacctgcccaaactggtttcccacctgcacctgccgattcaaagcggttccgaccgcgtattgagcgcaatgaaacgcggctacaccgctttggaatacaaatccatcatccgcaaactgcgcgccatccgtcctgatttgtgcctgagcagcgatttcatcgtcggcttccccggcgagaccgaacgcgagttcgagcaaaccttgaaactggtgaaagacatcgccttcgacttgagcttcgtgtttatttacagtccgcgccccggcacgcctgccgccaacctgccggacgacacgccgcacgaagaaaaagtgcgccgcctcgaagccttgaacgaagtcatcgaagccgaaaccgcgcgcatcaaccaaaccatggtcggcacggtacaacgctgcctggtcgaaggcatctccaaaaaagaccccgaccaactgcaagcccgtaccgccaacaaccgcgtcgtcaacttcaccggcacgcccgacatgattaaccaaatgatcgatttggaaatcaccgaggcctacaccttctccctgcgcggcaaagttgtcgaagcctaaaccctcacgccgaaaaaatgccgtctgaagcgtttcagacggcattttgccttgtatcggcagacgacggcgcggccgggcggcttaatttgccgcatcccgatccgacagccacgcgcgcacacgccgttccaccgcttcggcactcaagcccaaatcgtctaaaagttttttcggatcgccgtgtccggttacggtatcggcaacgcccaaaagcaaaacgggtttgcagatgccgtgtttcgccaatacttccagcaccgcgccgcctgcgccgccctgttcggcgttttcttcaagggtaacgatgcggtcgtggcttcgggcaaggcggacaatcaactcttcgtctatcggtttgacgaagcgcatatcggcgacggtggcgttcagtttttcggcaaccgccaatgcgggggcgaccatactgccgaaggcaatgaatgcggttttctcaccttcgcggcggataatgcccttgccgatttccacggtttccatgccgtctgaaaccggcgcgcccgtacccgtgccgcgcggatagcggacggcggcgggcgcgtctgcctgatagcaggtcgaaagcaacaggcggcattcgttttcatcgctcggcgcggcgacaatcatgttcggcacgcagcgcaaaaagctcaaatcgtacagaccggcatgggtcgggccgtccgcgccgacgatgcccgcgcggtcgacggcaaacaaaacgggtaggttttgcagggcgatgtcgtgcaccagttggtcgtaggcgcgttgtaaaaaggtggaataaatcgccacgacgggcttcatcccttcgcaagccaaaccgccggcaaaggtaacggcgtgctgctcggcgatgccgacatcgaaatagcggtcggggaatcgttgttcaaactcaaccaagccgctgccctcgcgcatggcgggggtaatcgcaaccagtcgggaatctgccgccgcccggtcgcacagccatttgccgaacacttgggtataggtcggtttggcggcgggcttgggttctttttcagacggcatttgcgccgcgctttctttaggcaggttggcgacggcgtggtatttgacggggtcgttttcggcgagtttgtagccgttgccctttttggtgatgacgtgcagcaactgagggcctttgcggctgcgcaagtctttcaatacgtccaccagattttcgacgttgtgtccgtccacggggccggtgtagcggaagccgaagttttcaaacaaagacagcgactgtttggcgtgttcggcttcttcggcaagggttttgattttgtgttcgactttttgggcaaactccatcgcgccgggtattttgtctaataccttgcccgtttgcgctttgacggtactcaacaggccgtgcatatcgcgcacgacgttgctggcaaggtatttcggcagcgcgccgacgttgggggaaatcgacatttcgttgtcgttgaggacgaccagcaaatccacatccatatcgcctgcgcaattcaaggcttcaaacgcctgccccgccgtcatcgcgccgtcgccgatgatggcgacgctgcggcggtcgctgcccaagagtttgtctgccgccgccatgcccaacgccgcgccgatggaggtggaggaatgccccacgccgaacgcgtcgtactcggactcgcaacgtttcggaaaacccgccaaaccgccatattggcgcatggtgtgcatctggtttttcctgcctgtcaggattttgtgcggatagctttggtgtccgacatcccacaccagcttgtcttcgggcgtgtcgtacacatagtgcagggcgatggtcagttcgaccgcgcccaaattgctggcgaaatgcccgccggtctgcccgacagattccagcagaaaggtgcgcaactcgccggcaaggcgcggcagctgttttttgtccagacggcgcaaatcttgcgggctgtcaatcaggtcgagtagggggcttgggttcatggtgtgtcttttttatgtgtcgtccgggtgcaacggtcaattatatatcaagagcgtgcggctgacggctgattttgccgtatgtcattcgtcctgccgcttggcgcgcgggtgggcttcgtcatacaggcgggcgatgtggtcgaaatcgagcttggtataaatctgcgtggtcgaaaggctgctgtgcccgagcagctcctgcaccgccctgatgtcgcgcgaagcctgcaataggtgtccggcgtagctgtggcgcatcatatgcggcgaaacgtgcctgccgtcgccgttttgcgccgcccattgcgccaaacgtttttggatttggcgttggctcaggcgcgtgccgttcctgccggtaaacagggctttgccgtccgatgccgtctgacgcagcggcagatagtttttcagggcttccacgcttttgccgaccagcggcacctgccgctgcttgcgccctttgccgataacgtgtacccacgcctcgtccaaatagacatcatctgcattcaagccgtgtatctcgctcacgcgcaaaccgctgccgtacatcagttcgaacagggcgtggtcgcgcaccgccagcgggtcgccgccgtccacgggcaaatccagcatccggttcagccattcctgcggcagggctttgggtacgcgctcgggctgcttcggcggtttgatgtcggcggtcgggtcggcgtgcatcaggccgcgctttaccagccaaacgcaatactgccgccaagacgaaagcttgcgagccagcgtccgttcccccaaaccgcggccggacagccggcgtaatgcctgtacgaagtcgccgcgagtgcaatttgaagggtttgcagacggcatttcttccagaagggcaagcagttcctgcaagtcgcgccggtatgcggcaaccgtgtgctccgatttaccctcgcgcacgatattttccaaataagcgtccaagtatgccgcaagtccgtccaaacccattcccacacctaaaataacattagaaacattatcataaatcggaatatccgaatcccgaaacgtcaaaacccgacaaacctgcatactggcatcgttaatataaaatcaatgagctgtttatggttttttgctgtaaaaaacattataatccgccttatttacctattgcccaaggagacacaaatggcactcgtatccatgcgccaactgcttgatcatgctgccgaaaacagctacggcctgccggcgttcaacgtcaacaacctcgaacagatgcgcgccatcatggaggctgcagaccaagtcgacgcccccgtcatcgtacaggcgagtgccggtgcgcgcaaatatgcgggtgcgccgtttttacgccacctgattttggcggctgtcgaagaatttccacacatccccgtcgtcatgcaccaagaccacggcgcatcacccgacgtgtgccaacgctccatccaactgggcttctcctctgtaatgatggacggctcgctgatggaagacggcaaaaccccttcttcttacgaatacaacgtcaacgccacacgtaccgtggttaacttctcccacgcttgcggcgtatccgttgaaggcgaaatcggcgtattgggcaacctcgaaaccggcgaagcaggcgaagaagacggtgtaggcgcagtgggcaaactttcccacgaccaaatgctgaccagcgtcgaagatgccgtatgtttcgttaaagataccggcgttgacgcattggctattgccgtcggcaccagccacggcgcatacaaattcacccgtccgcccacaggcgatgtattacgtatcgaccgcatcaaagaaatccaccaagccctgcccaatacacacatcgtgatgcacggctccagctccgttccgcaagaatggctgaaagtcatcaacgaatacggcggcaatatcggcgaaacctacggcgtgccggttgaagaaatcgtcgaaggcatcaaacacggcgtgcgcaaagtcaacatcgataccgacttgcgccttgcttctaccggcgcggtacgccgctaccttgccgaaaatccgtccgactttgacccgcgcaaatacctgagcaaaaccattgaggccatgaagcaaatctgcctcgaccgttatcttgcgtttggctgcgaaggtcaggcaggcaaaatcaaacctgtttcgttggaaaaaatggcaagccgttatgccaagggcgaattgaaccaaatcgtcaaataacaggttgcctgtaaacaaaatgccgtctgaaccgccgttcggacgacatttgatttttgcttctttgacctgcctcattgatgcggtatgcaaaaaaagataccataaccaaaatgtttatatattatctattctgcgtatgactaggagtaaacctgtgaatcgaactgccttctgctgcctttctctgaccactgccctgattctgaccgcctgcagcagcggagggggtggtgtcgccgccgacatcggtgcggggcttgccgatgcactaaccgcaccgctcgaccataaagacaaaggtttgcagtctttgacgctggatcagtccgtcaggaaaaacgagaaactgaagctggcggcacaaggtgcggaaaaaacttatggaaacggtgacagcctcaatacgggcaaattgaagaacgacaaggtcagccgtttcgactttatccgccaaatcgaagtggacgggcagctcattaccttggagagtggagagttccaagtatacaaacaaagccattccgccttaaccgcctttcagaccgagcaaatacaagattcggagcattccgggaagatggttgcgaaacgccagttcagaatcggcgacatagcgggcgaacatacatcttttgacaagcttcccgaaggcggcagggcgacatatcgcgggacggcgttcggttcagacgatgccggcggaaaactgacctacaccatagatttcgccgccaagcagggaaacggcaaaatcgaacatttgaaatcgccagaactcaatgtcgacctggccgccgccgatatcaagccggatggaaaacgccatgccgtcatcagcggttccgtcctttacaaccaagccgagaaaggcagttactccctcggtatctttggcggaaaagcccaggaagttgccggcagcgcggaagtgaaaaccgtaaacggcatacgccatatcggccttgccgccaagcaataaccattgtgaaaatgccgtccgaacacgataatttaccgttcggacggcattttgtattgcaccgtccgacggcatgcccaaggggggaaatccctattttcaggccaaccgctatataatgccgtctgaaccaacgagagaatgccatgcaagctgattttaaccgtcccgtcctggccgtcgataccggtacttcccgtttgtcgctcgcgctgcgtgccgacggcgaaacccgtctgttccatcaggaagtcggcagccgccagtccgaactgattctgccggaaatccgcaccctattccgcgatgcaggcattaccgccgccgatttgggtgcggtcgtgtacgcacagggtcccggcgcgtttaccggactgcgtatcggcatcggtgtagctcagggtttggcaacgccgtttgatacccccttaatcggcgtaccctcgctcgatgccgccgcctcgctgccgccgccgcaaagctgcatccttgccgctacggacgctcgtatgggcgaagtgttttatgcatggttcgatacgctgaactgccaccgtttgagcgattatcaggtcgggcgggcggcagacatccggctgccggagggatgcgccttttcagacggcataggcagcgcgttcgcgctggaagaagctccgccgttctcaggcagaccggatatgccgactgccgccgactttctcgcattggcagccaagggcggttatcctgccgtccatgccgcacacgccggtttgctctacgtccgcaacaaaatcgccctgactgccaaagaacaggccgaacggagagcgcgcccgtgaacatccgccgtgccgtttgtgccgattgtgaggagctggccgcactcgatgccgtctgcaacccgtccgcatggacgcaacgccaatttgagtccgcactggtttcgccgtccgaacaggttttccttgcggaaaaagacggcgggattgccgcctttatcgtttggcagaacctgcccgacgaatccgaactgcacctgattgccaccgcgcccgaatgccgccgccaaggaattgcgtccgccctgctcgaatattggttcacacatctgcccgaagacacgcaacgcctgctgctcgaagtccgtgcaggcaacaccgccgcacaggcactgtacacggcgcacggcttcagcattacgggcaggcggaaaaactattaccgtacagccgacggtaaaaccgaagatgccgtcttaatggagaaaatatgttaagcgcgcgctacctccacctgcacgaagctttgggtttgggtccgatgtggctgaaacaggccgccgccgtcctgccgcccaaaaacacacccgcaccctcggcacaggcacgtccccaaaccgtccgcgccgccccgatccgcccttcccaaccccataacggtcaggcgcggctcgaaacgatgaaagcgttggaaaccgccgccgtacctacgcgcaaacccgcgcctgaaaccgaaacgcctctgcccggcctttcagacggcatcgcccccgttcccgccgcttcgggcatcaccaagcttgccgtcgtcagcctttgcccaccgatcgaggatgcggtttacgggcaactgttccacggcaaagcaggcatcctgctcgacaacatactcaaagccgtaggactggatgccgcctatgtccacaaaacctgttgggtgaaaaccgccgccgtcggcaacccgatgccgtctgaacaggccgtcgcgaatgcgctgggtcaaatcgcccgcgaactcgacggctgccgcgccccggctgtccttttcctcgggcaggcttttgtccagcctgaacggcaaacgatgattgaaactttgtgcggcagccgtcccttcttcatcatcgaccatcccgcccggcttttacgccaacccgaactcaaagcccgcgcctggcaggtgttgaaacagttgaaacgcgccttgcggcaaggcggcggcagttgaagcgcgccgcacggggcggtagaatcgcaactgcgtcccaatatctgacagaaagcacaaaatgaccgatttccgccaagatttcctcaaattctccctcgcccaaaatgttttgaaattcggcgaatttaccaccaaggcaggacggcggtcgccctatttcttcaatgccggcctctttaacgacggcttgtccacgctgcaactggcaaaattttacgcacaatccatcattgaaagcggcatccgattcgatatgctgttcggtcccgcctacaaaggcattattttggcggcggcaaccgcgatgatgctggcggaaaaaggcgtgaacgtcccgtttgcctacaaccgcaaagaagccaaagaccacggcgaaggcggcgtgttggtcggcgcgccgcttaaagggcgcgtgctgattatcgacgacgtgatttccgccggcacatccgtacgcgaatcgatcaaactgattgaagcggagggtgcaacccccgccggtgtcgccatcgcgctcgatcgcatggaaaaaggcacgggtgaattgagcgcggttcaggaagtggaaaaacaatacggtctgcccgtcgcccccatcgccagcctgaacgatttgtttattctgttgcaaaacaaccccgaattcggacagttcctcgaacccgtccgagcctaccgtcggcagtacggcgtagaataaaaacaaagcatatgccgtccgaaccgccttacgcctcagacggcatcaaacctgacacacacgaggaaataccatgcccgcctgtttctgcccccactgcaaaacccgtctctgggtcaaagaaacccaactcaatgtcgcccaaggcttcgtcgtctgccaaaaatgcgaaggactgtttaaagccaaagaccatctggcaagcacgaaagaacccatattcaacgatttgcccgaggctgtttcggatgtcaaactcgttcaccgtatcggcacgcgcgccatcggcaagaaacagatttcccgtgacgaaatcgccggcatcctcaacggcggtacaacccagcccgatattccgcccgcaaccgccgccacccctgctgccgcaccgcaggttaccgtaccgcccgccgcgcccgcccgtcaggatgggttcaactggacgattgcaaccctgtttgcccttatcgtcctcattatgcagctttcctacctcgtcatcctatgagcgcgcccgacctctttgtcgcccacttccgcgaagccgtcccctacatccgccaaatgcgcggcaaaacgctggtcgccggcatagacgaccgcctgctcgaaggtgataccttaaacaagctcgccgccgacatcgggctgttgtcgcaactgggcatcaggctcgtcctcatccacggcgcgcgccacttcctcgaccgccacgccgccgctcaaggccgcacgccgcattattgccggggcttgcgcgttaccgacgaaacctcgctcgaacaggcgcagcagtttgccggcaccgtccgcagccgttttgaagccgcattgtgcggcagcgtttccgggttcgcgcgcgcgccttccgtcccgctcgtatcgggcaacttcctgaccgcccgtccgataggtgtgattgacggaaccgatatggaatacgcgggcgttatccgcaaaaccgacaccgccgccctccgtttccaactcgacgcgggcaatatcgtctggctgccgccgctcggacattcctacagcggcaagaccttctatctcgatatgcttcaaaccgccgcctccgccgccgtctcgcttcaggccgaaaaactcgtttacctgaccctttcagacggcatttcccgccccgacggcacgctcgccgaaaccctctcggcacaggaagcgcaatcgctggcggaacacgccggcggcgaaacgcgacggctgatttcgtccgccgttgccgcgctcgaaggcggcgtgcatcgcgtccaaatcctcaacggagccgccgacggcagcctgctgcaagaactcttcacccgcaacggcatcggcacgtccattgccaaagaagccttcgtctccatccggcaggcgcacagcggcgacatcccgcacatcgccgccctcatccgcccgctggaagaacagggcatcctgctgcaccgcagccgcgaatacctcgaaaaccacatttccgaattttccatcctcgaacacgacggcaacctgtacggttgcgccgccctgaaaacctttgccgaagccgattgcggcgaaatcgcctgccttgccgtctcgccgcaggcacaggacggcggctacggcgaacgcctgcttgcccacattatcgataaggcgcgcggcataggcataagcaggctgttcgcactgtccacaaataccggcgaatggtttgccgaacgcggctttcagacggcatcggaagacgagttgcccgaaacgcggcgcaaagactaccgcagcaacggacggaactcgcatattctggtacgtcgcctgcaccgctgaccgcaacggaaagccgccgcagaaatgccgtctgaaccccgtttcagacggcatttccccgattatatagtggattaaatttaaatcaggacaaggcgacgaagccgcagacagtacaaatagtacggcaaggcgaggcaacgctgtactggtttaaatttaatccactataaagacctgcccaaccctcaaggaccccgatgaaatcctaccccgacccctaccgccattttgaaaacctcgattccgccgaaacgcaaaacttcgctgctgaagcgaatgccgaaacgcgcgcgcgttttttagaaaacgacaaggcgcgcgcgctttcagacggcattttggcgcagttgcaggacacgcggcagattccgttttgtcaggaacaccgcgcgcggatgtaccatttccatcaggacgcggagtatccgaagggcgtgtaccgcgtgtgtaccgcggcgacgtatcgttccggctatcccgagtggaaaatcctgttttcggtggcggatttcgacgaattgcttggcgacgatgtgtatttgggcggcgtgtcgcacttggtggaacagcccaaccgcgcgttgttaacactgagcaaattgggcagcgatacggcgtacacgctggaagtggatttggaagcaggggagttggtcgaaggcggttttcactttccggcaggcaaaaaccatgtgtcgtggcgcgatgaaaacagcgtgtgggtgtgtccggcttggaacgaacgccagttgacccaatcgggctatccgcgcgaagtatggctggtggaacgcggcaagagtttcgaggaaagcctgcctgtgtatcaaatcggcgaagacggcatgatggtgaacgcgtggcgttatctcgatccgcagggttcgccgattgatttgattgaagcgtcggacggtttttacaccaaaacctatttgcgggtctcagccgaaggcgaggcgaaaccgttaaacctgcccaacgattgcgacgtggtcggctatctggcggggcatcttttgctgacgctgcgcaaggactggaaccgcgcgaaccaaagctatccgagcggcgcgctggtggcggtgaagctgaatcggggcgaactcggggcggcgcagcttttgtttgcgcccgatgaaacgcaggcattggaaagcgtggaaacgaccaagcgttttgtggtggcgagcctgttggagaacgtacaaggccgtctgaaagcatggcggtttgccgacggcaaatggcaggaagtcgaattgccgcgcctgccttcgggcgcgttggaaatgaccgaccaaccttggggcggcgacgtggtttaccttgccgccagcgatttcaccacgccgctgacgctgtttgcgctggatttgaacgtgatggaactgaccgtcatgcgccgccagccgcagcagtttgattcagacggcattaacgtgcagcagttttggacgacttcggctgacggcgagcgcattccttatttccacgtcggcaaaaacgccgcgcccgacatgccgacgctggtctatgcctacggcggtttcggcattcccgaattgccgcattatctgggcagcattggcaaatattggctggaagagggcaatgcctttgtattggcgaacatccgcggcggcggcgagttcggcccgcgctggcatcaggcggcgcagggaatcagcaaacataaaagcgttgatgatttattggcagtcgtgcgcgatttgtccgaacgcggtatcagttcgcccgaacacatcggcttgcagggcggcagcaacggcggactgattactgccgccgccttcgtgcgcgaaccgcaaagcatcggcgcgctggtgtgcgaagtgccgctgaccgacatgatccgttatccgctgctctccgccggttcaagctggacagacgaatacggcaatccgcaaaaatacgaagtctgcaaacgccggttgggcgaattgtcgccgtatcacaatctttcagacggcatcgattatccgcccgcgctcattaccaccagcctgtccgacgatcgcgtccatcccgcccacgcgctcaagttctacgccaaactgcgcgaaacctccgcgcaatcttggctctactcgcctgacggcggcggccataccggcaacggcacccaacgcgaatccgccgacgaactcgcctgcgtcttgctgtttttgaaagagtttttgggctaagggcgggggagcggcactgccgccgcgaatgaaaaaaggtcgtctgaaactgctttttcagacgaccttttttaatggttgtttcaaatcaaaatatctatgccgccggccccatcagcacttcttcacatccgaaggcaaaaatccgtaatgccgtctgaacgcttcgttgaaccgtcccgcgtggcggtagccgcaaaagtgcatggcggcttggacggtgctgccggattcgatgagggcgagcgcgtgttccagccgcaggcggcgcaggcatccggcgacggtttcgccggtttgcgctttgaaatagcgtttcaggtagcattcgttcagtccgacgcggcgggcgatttcggcgatggtcagcggacgggcgaattcgtgttgcaggatgtcggcggcttcgtctatgcgccgacggcggtaaccgttgtcgtggcggcggaaggtgaagcgcaataatcgggcggagagttccagcgcggcggcttcgtcggcaagcaggccgaagccgtccgattcgaacgggcgttgcagcagtgggcaggccgccgccgtcagtgccgctgcgttttgcgccagccgttgcagggcgaatcggcctattgtttgcggcgaaaacaggcgttcgtccagcaagccttcgtcgtgccagcggcgcagtttttccagcgaaaaatccaaatgcagcgcgcacatgccgctgttgtcgggcagcagggtttcggatacgtccgccaaatcgccgcgtaccagtcagatttcgccggcagatgggcggtattccctgccgcccatttgtaaccggttctgccccgacaccatgacgaacaaggcgcagttgtggctgaaattgtggatttcggtgggaaacgcgcccgttccgccgccgcgcatccgcgacaaggtgatgcccgaatcgaagcggttgatgcacatttccagatgcaaaccgggctgttttgcctgcgcaatgagcgcgctgtcggaacagccgtccaacgcccagccggatttatcggagcggacataggtttggtactggcggtagatggcggcggtgttcatgattggataggaacgagttgtctaacaaatgaattaaataggaattattaccaataatcaagcgcagggattggttgaaacggaaaaggtcgtctgaaagggtgtttcagacgaccttttccgtatcgggaatttgttttgccgtatcgggaattttgcgttttgcggcgtggtttctgcaggttgtttgcttaataataaacattcttattcgtatgcaaaggaaccgcacaccgtgaaaccgcgtttttattgggcagcctgcgccgtcctgctgaccgcctgttcgcccgaacctgccgccgaaaaaactgtatccgccgcatccgcatctgccgccacgctgaccgtgccgaccgcgcggggcgatgccgttgtgccgaagaatcccgaacgcgtcgccgtgtacgactgggcggcgttggatacgctgaccgaattgggcgtgaatgtgggcgcaaccaccgcgccggtgcgcgtggattatttgcagcctgcatttgacaaggcggcaacggtggggacgctgttcgagcccgattacgaagccctgcaccgctacaatcctcagcttgtcattaccggcgggccgggcgcggaagcgtatgaacagttagcgaaaaacgcgaccaccatagatctgacggtggacaacggcaatatccgcaccagcggcgaaaagcagatggagaccttggcgcggattttcggcaaggaagcgcgcgcggcggaattgaaggcgcagattgacgcgctgttcgcccaaacgcgcgaagccgccaaaggcaaaggacgcgggctggtgctgtcggttacgggcaacaaggtgtccgccttcggcacgcagtcgcggttggcaagttggatacacggcgacatcggcctaccgcctgtagacgaatctttacgcaacgaggggcacgggcagcctgtttccttcgaatacatcaaagagaaaaaccccgattggattttcatcatcgaccgtaccgccgccatcgggcaggaagggccggcggctgtcgaagtattggataacgcgctggtacgcggcacgaacgcttggaagcgcaagcaaatcatcgtcatgcctgccgcgaactacattgtcgcgggcggcgcgcggcagttgattcaggcggcggagcagttgaaggcggcgtttaaaaaggcagaacccgttgcggcggggaaaaagtagggagtcgtctgaaaacggagcttccgaaggaagcggggggtttctgcgaagctaaagtgcggtttcaacgaattgaaaagcagcctgtatgttgaaaataccgctcaagcaaacctacggtttgccgccctctccctagccctctcccacagggagaggggattgggttgcaggctgcctttaaggtttaggcaaatttttaacttcgttgaagctgcgatttcagaagctccgttttagcttcgcagaaactccgcttccttcgaaagctccgttttcagacgaccttttggagtaccgcaggcacacgcatcgaacggctgaatcaaagattcagaccgatggcagtccgcacccgagtttatgcggcaaacagcgaggctacggcaacccgccccctctccctgtgggagagggttagggagagggcggtaagccgcaggcttacatcaaagccgataacgcttccgttacaactccgcccactgaaagcagcctgcaacgaagccaaaacgacaaaccgcatcgtaaaccacccaacccataggagaaccccatgcaaaacgaaaccatcaacctgaaacagcaccttgccgccatcaaagaatactggcagcccgaaatcatcaaccgccacgggttccaattccacttggtcaaacttttgggcgattacggctggcatacgcacggatacagcgacaaagtgctgtttgccgtggagggcgacatggcggtggacttcgccgacggcggcagcatgacgatacgcgagggcgagatggcggtcgtgccgaagtcggtgtcgcaccgcccgcgttcggaaaacggctgctcgttggtgctgattgagttgtccgacccgtccgaggccgtctgaaaacgaagtttccgaaggaagctgagtttctgcgaagctaaaagcagcctgcaccttcaatcaatatgccgaaaatacaaccccaccgcacaccaacacacaaaggaaatcccatgacacgcttcaaatattccctgctgtttgccgccctgttgcccgtgtacgcgcaggccgatgtttctgtttcagacgaccccaaaccgcaggaaagcactgaattgccgaccatcaccgttaccgccgaccgcaccgcgagttccaacgacggctacactgtttccggcacgcacaccccgctcgggctgcccatgaccctgcgcgaaatcccgcagagcgtcagcgtcatcacatcgcaacaaatgcgcgaccaaaacatcaaaacgctcgaccgcgccctgttgcaggcgaccggcaccagccgccagatttacggctccgaccgcgcgggctacaactacctgttcgcgcgcggcagccgcatcgccaactaccaaatcaacggcatccccgttgccgacgcgctggccgatacgggcaatgccaacaccgccgcctatgagcgcgtagaagtcgtgcgcggcgtggcggggctgctggacggcacgggcgagccttccgccaccgtcaatctggtgcgcaaacgcctgacccgcaagccattgtttgaagtccgcgccgaagcgggcaaccgcaaacatttcgggctggacgcggacgtatcgggcagcctgaacaccgaaggcacgctgcgcggccgcctggtttccaccttcggacgcggcgactcgtggcggcggcgcgaacgcagccgcgatgccgaactctacggcattttggaatacgacatcgcaccgcaaacccgcgtccacgcaggcatggactaccagcaggcgaaagaaaccgccgacgcgccgctcagctacgccgtgtacgacagccaaggttatgccaccgccttcggcccgaaagacaaccccgccacaaattgggcgaacagccgccaccgtgcgctcaacctgttcgccggcatcgaacaccgcttcaaccaagactggaaactcaaagccgaatacgactacacccgcagccgcttccgccagccctacggcgtagcaggcgtgctttccatcgaccacaacaccgccgccaccgacctgattcccggttattggcacgccgacccgcgcacccacagcgccagcgtgtcattgatcggcaaataccgcctgttcggccgcgaacacgatttaatcgcgggtatcaacggttacaaatacgccagcaacaaatacggcgaacgcagcatcatccccaacgccattcccaacgcctacgaattttcccgcacgggtgcctacccgcagcctgcatcgtttgcccaaaccatcccgcaatacggcaccaggcggcaaatcggcggctatctcgccacccgtttccgcgccgccgacaacctttcgctgattttgggcggacgatacacccgttaccgcaccggcagctacgacagccgcacacaaggcatgacctatgtgtccgccaaccgtttcaccccctacacaggcatcgtgttcgacctgaccggcaacctgtctctttacggctcgtacagcagcctgttcgtcccgcaatcgcaaaaagacgaacacggcagctacctgaaacccgtaaccggcaacaatctggaagccggcatcaaaggcgaatggcttgaaggccgtctgaacgcatccgccgccgtgtaccgcgcccgtaaaaacaacctcgccaccgcagcaggacgcgacccgagcggcaacacctactaccgcgccgccaaccaagccaaaacccacggctgggaaatcgaagtcggcggccgcatcacgcccgaatggcagatacaggcaggttacagccaaagcaaaacccgcgaccaagacggcagccgcctgaaccccgacagcgtacccgaacgcagcttcaaactcttcactgcctaccactttgcccccgaagcccccagcggctggaccatcggcgcaggcgtgcgctggcagagcgaaacccacaccgaccctgccacgctccgcatccccaaccccgccgccaaagcccgcgccgccgacaacagccgccaaaaagcctacgccgtcgccgacatcatggcgcgttaccgcttcaatccgcgcgccgaactgtcgctgaacgtggacaatctgttcaacaaacactaccgcacccagcccgaccgccacagctacggcgcactgcggacagtgaacgcggcgtttacctatcggtttaaataaggtcgtctgaaaacggagtttctgcgaagctatagtggattaacaaaaaccagtacggtgttgcctcgccttagctcaaagagaacgattctctaaggtgctcaagcaccaagtgaatcggttccgtactatttgtactgtctgcggcttcgtcgccttgtcctgatttttgttaatccactataaaagcagcctgcacattgaaaatgccgcccaagcaaactttcagtttgcccgcctcgtcctagccctctcccacgggagaggggattggggtgcaggctgcctttaaggttcaggcaaattttaacttcgttgataccgcgctttagcttcgcagaagctgcactttcagacgaccttttggaacaccacaggtacacgcatttaaggaatgccgtctgaaatgcctgcctcaataacgcatcatgttgccgtcaatctcggccgcccatgcatcgatgccgccctgaaggttgtacaggttttcaaaacccgcgtccgccaaatacatcgccgtatgcaggctgcggataccgtggtggcaatacaccacaagcggcacatcatccggcagctcgttctgccgcagcggaatcagattcatcgggatatgcagcgcatttggcagcgaacaaaccgccgtttcttcatccgtacgcacgtccaacaaacaaaacatccgcccttcgtccatccacgctttcaattccgcgggcccaagttgcacaatatccatcgcaccccccaaaaaaaaccaagcaaaatgccgtctgaagccccaaacccgctttcagacggcatgacctgtcaacatcttaaaaatcgaaaccgccaaacggatcggcatccttatcatccaaatgcgccaccaaggtatcgaacagcaccttctcttcaaacacatcgcccctgcgcgtaatcaaaagcgcgcgttgaacaggcttgcgacctacgataaccaccatgcgtccgccatctttcaactgttctttcaacacttcaggcacaaggtttaccgcaccgccgacataaaccgcatcaaacggcgcacctgcggaaagttcggtcaacccgttgttttgcacataatcgatattgtccaaacccaagccgtccaacaccgctttggcgcggttttgctgttcgacatcgatgtcgtccgacaccacacgaccagccaattttgccaacagcgcggtcgcatagcccgaacccgtgccgatttccaaaaccgtatcgtttttcgtcagcttcaagccctgcgccagccgcgccacgactttcggctcgagcatcttatgaccgttggcaagcggcagcgccatatccgcatacgccaaaccctgcaagtcctcatcgacaaaaagctcgcgcggaatctccgccaaagcgtccaacacatcaaaatccaatacatcccacggacggatttgctgttcgaccatattgaaccgcgctttttcaaaatccatttagtgctccgtcaaataattgttccaacaatggcaggcattataaaaccacactcccgccgcgccaacttcggcacgcgccgacagcccgttttgtcagtctcaaaccgcctgacgcgaagcctcaaaccgcttctccaaaatcttcgccagttcgcccaaatacaaagcatccgtctcatcaaactgcgccaaatgttcgctgtccgcgtccaacacgccgatacagcggccgtctgaaaacagcggcacgacaatctccgaacgtgacaaagacgaacaggcaatatggtcgggatgcgcgttgacatccttaacaaccaccgtttcacccttcgcccaagcctgaccgcacaccccgcgaccgaacggaatccgcgtacacgccaaaggcccctgaaacggtgccaaaaccaattcgtccgaacgcgtatcgaccaaataaaaacccacccaaaaccaaccgaacgcctccttcaaaaccgccgccgtgttcgccaaattcgccacccaatccgcctcgtcagccaccacagactcaatctgcggcaacacctcccgataaagcgcggccttgtccgaagccgaaaaatgaagcgcgtgcatcacatctcctatagttgcatacatatcaggcggccattataaaacagcctgcccgaaacaacattccaaaccgcccggccggccgcttcaagttgcgaacccgccgcatatccactaaacttcacgttgcaccgcgccacacgcggcagacaaaaaaacacgacacggagcaaaaaagatgtatcgccaaatcggaatgtgggatcaaaaatgggtcatcggcaactggaaaatgaacggccggctccaaaacaacaacgcactgatgcaccgcttccgcatccaccccaccgccgaacgcgtcctcatcggactcgccgccccgaccgtttacctgctgcaactgcacaacgccatgcaaatcgttttaaacaaccgcatcctcacctgcgcccaagacgtgagccgcttccccaataacggcgcgtacaccggcgaagtgtccgccgaaatgctcgccgacaccggcacagacatcgtcctcatcggacactccgaacgcagcctttatttcggcgaaaaaaacgaaatccaacgccgcaaaatggaaaacgtcctcaacgtcggactcatcccgttattgtgcgtcggcgaaagcctcgaagagcgcgaagccggcaaagaacacgaagtcatcgcccatcagctttccatcctgcaagggctggataccaaaaacatcgccgtcgcctacgaacccgtctgggcgatcggcaccggcaaagtcgccaccgtcgaacagattgccgatatgcacgcattcatctacaaagaaatcttgtctttgtgcggaagcgatgttaaaatccgcgtcctttacggcggaagtgtgaaagcggacaacgcggccgacatcttcgcagtaccttatgtggacggcgcactcgtcggcggcgcgtcattgtcgtacgactcctttaccgccatcatcagtgccgcacaaaatgcgtagaaaaatatggaagccttcaaaaccctaatttggattgttaatataatttccgctttggccgtcatcgtgttagtattgctccaacacggcaaaggcgcggatgccggcgcgactttcggatcgggaagcggcagcgcgcaaggcgtattcggctctgccggcaacgctaacttcctcagccgctcgaccgccgttgcagcaacatttttctttgcaacctgcatggctatggtgtatattcacacccacacgacaaaacacggtttggacttcagcaacgtacaacaaactcagcaagcacccaaacccgtaagcaataccgaaccttctgcccctgttcctcagcagcagaaataacagtttttcaaatgccgacatggtgaaattggtagacacgctatcttgagggggtagtggccgtaggctgtgcgagttcaaatctcgctgtcggcaccaacacacaaaaacgcctgaaaatttcaggcgttttttgttcaatcccatccaacgctgtcaaccaattccaatcaatacaaggatttcaggctgattgttatcctgccgtcccccttcctgacagtgcaatcccgtccaatccgccctaattgaagtaacctaaaatttacggtatcttttgcggtatctgaaaaatacctcgaaaaaataccgcaaaaataaagctgaacgaccgccaaatcaggaatgccaagcggaaaagagcttgcggggaatactgccaagacgtagggaacaagggggaaaccgtccaagatgcagggcggttttttttgggtttttggaaaaaacctatactaggaagcgatacccttagttgttaccttgttaccggggaaaagttagataaataagcatatgaaatatagtgaattaaatttaaatcaggacaaggcggcgagccgcagacagtacaaatagtacggcaaggcgagccaacgctgtaccggtttaaatttaattcactataaaataagaaaaagataaaaaattggtaacaaatgcggtaacaaatggtaacgaatcggtaacaacttttggggttttccggtttttcaccgtcttggcagtgggagcgtagcggaatgaaaagccaaaacgcacggaaccgcgcctattttgagcaggaatggcggttaaaccgcttggttatatacggggaataggaagacagcgaaacgcgctaaaaacgcaatttgagccattaaaagcgattgattaaaaaaataatcaggttagccgccagtgtttcaggcggcataaacggagaaattgcggggcataaaaaaggcagcttgccgtgttgtctgtctctggtataattccaagtatcactaatcaacggctacacaatgcggatattcaaaaaccaatggatagtgaaatttgccaagaagcacaaaatcaacgattccgagctgctggaagcggtagagcgggcggataacgggctgatagacgcagatttaggcggcggtgtgattaagcagcgcatagcaaggcaaggacaaggcagaagcggcggttatcgcagtctgatactgttcaaacaggcagacaaggcattttttgtttacgcctttgccaagaacgacagggaaaacatttcggataaagaacttgacgtttaccgaaaagccgccgcatattatctgaaatacacgcgggcagagctggcggctttgaaagaagacggcattatcacggagatagaatcatgaaatacaaaaacgaggcattagccgccattcatgaaatgatggaaggggcttacaacatcggcgcaatcgacaaaaagaccatgcgcgactttgacaagtcctgcctgaccgaaatcaaaccgttgagcggcggagacatcaaggcaatcagggagaaggaggcactatcgcaagccgctttcgccatctatctcaacgtgggaaaaaatcacgtttcggcttgggagcggggcgttaaaaagccgagcggcgcggcgttgaagctgctgaccatcgtcaaaaacaagggcatcgaagccattgcgtagccgacttggcaaacggcaaaatcagcaagttcacaatagacgcgctgctgaatatgcctgccaagacaggcaagaccgccgaactgaatatcagggcgtagccgcataaatgcccgaccgcatcaaaccaagccgaaacggcggcggtgcagacgacatagcccgacagcaaggcacggcgcagacgggcgcgaaacccgaaacatcaccgaccgcgaggtacggggattttttgcgcccgttgcagggggggattggatttaagcggcgcgggcttgaaggcaaaacgggtggggcacagaactgtttaaatgcagtctgaatctcaaacgatttcagacggcattttgaaacaatggctcaaattctcgatccccttcccttaacgccgacgttttttattaacgcgccccttatttctgacactttgctcataaaccggcataacggtcggcaacaaccgttttagattttctatacgggcattgtttgtcggatgagtagaggtaatagcataaataaagccgttttggtcgttttcctgattcattttttcccaaaccctgacagcggccgccggatgatagcctgcctgcgccatcaacatcattcccccctcatcggcttcttcttccaagctgcggctataaggcaaggtaagaccgtacgtccccaaaatatccatacccaatccgaccaattccggattagtatccggttttttgtctaatataatctgcgtgcctatctgcgccgccgtattggtcaagatttgctgcccgaccttatttttaccgtgttcatgcagggcgtgcgtcatttcatgccccataatggcggcaatttcgtcatcggtcagcttgagtttgtcgactatccccgtataaaacgccatttttccaccgggcattgcccacgcgttcagctcatcgtttttgaaaaccgtcattttccagtcaaacttatggctggtattatttgccgcatcggcataaggcagcatacgtcgaaatactgcctgcaccctgcgggctgttctggatgtggtatcgacattgccggcagacttgtttaactcaaccgttttcatataatctttggcagccgcagcgttcattgtggcggaatcatgaccgtaaacatcagcaacgaccgcacaagcccccaataccgagattactgccgacaggcagagtatccgtttaaaggaaggaaggaaggaaatttcatatttaggtttactccttaaaaaattaaatttcaaaaaaatgccgtctgaatccaaaacggatttcggacggcatcttaacattgtttaatgtttttaaaaagatttacaccacgatgttctccagtctgcccggtacggcgatgattttcttggcaggcttgccttctatgaatttcaccgcgccttcagcggcgtattcggcagcttcttcagccggtttgtcgaaatcacgcataaattgccaataattctccaacttttttacggctgctgctgccttttgcggcaatattgcgctgaacttcaactgttttcaaaatggcagaagaataaatatcccttgtgaattcagtatcatgatttgaaatcaaaataccttgggagttgggcgcaatttattgattttttgtaaagtccgcgaccaatgaattcgatcgtattttggtcgcgcagaatttgcaactgttggcggattttgtctctgatatggttgttttggggaaattggatggatagtttgttttcaaattcatacatttgcgacaatgtgaattcttcggggagttggtcgatacatttcataacagccagaagccagcctttgcgctccgcattttggttgcgtaaaaacaaattggattgccattttttcagaacggtttcgggttcgataatgcgggaattgtctattaagaatattttgccgctttcaggcaaaggggcgagattgatagaacacataatgtggttcggccggtttttaatgcctttatttctgggaataatcatatccggcgtgatgaaatgtttgggtacaagcaccaattgccgtatggagtaatccgcttttttatatgcaagaaagaaaaagttggggttggtatctgaccggatgcgctccaacatggtgtgatatgcaccgtcaggcacgctgttgcctatggttttttgatttttactctttaattcatattgctcgtggcaatttgggcaaaagaggtctgcaacaggtttgttattggcaaatctctgcatcggcttgcttccgcaacaggggcagtagccgtttttttccaaccaagcctcgctcattacacggattttatgggttgctttattttgttgctttcccaattcggtatcgaaaaataaattcatgttttggattttgagatttcagttattcggggttcgtcatgcagacaacacaatccaccttaaaaaggccgtctgaaaccctgtttccaagtttcagacggcctttatccgtgtggctaaaccttaaaagcggttagacgacgatgttcaccagtctgcccggtacgacgatgattttcttcgccggtttgccttccatgaatttcaccgcgccttcggtggcgagtgcggcggcttcgaggtcggctttggatgcgtcggcggcaacagtgattttgccgcgcagtttgccgttgacttgaaccatcacttcgatttcggatttgaccaaggcggcttcgtcgactgtcggccagcctgcttcccacagtttcgcgccgttcaattcgctccacagggtttcgcagatgtgcggcacgatgggccacaacaggcgtacggcggtttccaatacttcttgggcgacggcgcgtccttgttcgccgccggtgtcggttttgtcgtattggttgagcaattccatcacggcggcgatggcggtgttgaactgctggcggcggccgtagtcgtcgctgactttggcagtggtcgcgtgcagtttgtggcgcaggtctttgagttctttagacaaaccgtcttggctgcctgcgaacgctttgaccgcttcgccttgcttcaagtattcgtaaacggtacgccacaggcggcgcaggaagcggtgtgcgccttcgacgccgctgtcgctccattcgagggactgttcgggcggtgcggcgaacatcataaacaggcgggcggtgtccgcgccgtaggcgttaatcagttcttgcggatcgacgccgttgtttttggacttggacattttttccgtgccgctgatgacgacgggcagcccgtcggctttgaggacggcggaaatggggcggcctttgtcgtcgaacgtcagctcgacatcggcggggttgatccaatctttgccgcctttgtcgttttcgcggtagtaggtttcgcaaacgaccatgccttgcgtcagcaggcgttcaaacggttcgtcaacattgactagaccttcgtcgcgcatcagtttggtgaagaaacgcgcgtacaagaggtgcaaaatcgcgtgttcgatgccgccgatgtattggtcgaccgcgccccagtatttcgcggcggcaggatcgaccatgccgtctgaaaattttggcgacatgtagcggaagaaataccagctcgattccatgaaggtgtccatggtgtcggtttcgcgtttcgccgcgccgccgcagcatgggcaggcagtttcgtaaaactcgggcatttttgccagcggcgaacccatgccgtcgggtacgacgttttcaggcaaaacgaccggcaattggtcggcagggacgggtacgtcgccgcattgttcgcaatggacgatgggaatcgggcagccccagtagcgttggcgcgaaatgccccagtcgcgcaggcggtattgggttttcggttcgcccgcgccttggctttgcagcttggcggcgacggcgtcgaatgccgtctgaaaatccaagccgtccaagtcgccgctgttgaccaatacgccgttttctttgtcgccgtaccattcttgccattggttttcgtcaaatgcgttgtcgccgacggcaatgacttgttttttcggcagattgtatttggtggcgaactcaaaatcgcgttcgtcgtgcgccggaaccgccatcaccgcgccgtcgccgtagccccacaatacatagttggcaatccacacttccagcttgtcgccgttgagcgggttgacgacgtagcggccggtcggcacgccttttttctccatcgtcgccatatcggcttcggcaaccgaaccggctttgcattcggcaataaatgcctgcaattcgggtttgtcggcggctgcggcggctgccagcggatgctcggcggcaacggcaacataagtcgcacccatcagcgtgtcggggcgggtggtataaacttgcaggaatttcgcgtaatcgccttccaagccttgtttgctgtcgtctgaaacggcgaagcgcacggtcataccgcgcgatttgccgatccagttgcgctgcatggttttgacttgttccggccagtgttccagcttgtccaagtcgttgagcagctcttcggcgtaatccgtgattttgaagtaatacatcgggatttcgcgtttttcgatcaatgcgccggaacgccagccgcgtccgtcgatgacttgctcgttggcaaggacggtttggtcgacagggtcccagtttaccgtgccgtttttgcgataaacgatgcctttttcaaacagcttggtaaacagccattgttcccagcggtagtattcgggtttgcaggttgcggtttcgcgcgcccagtcaatcgcaaaacctaggcttttgagctgggttttcatgtattcgatgttatcgtacgtccaagcggcaggggcgacgttgtttttcatcgccgcgttttccgccggcatgccgaacgcgtcccaacccataggctgcatgacgttgaagccgtttaaaagtttgaagcggctcaatacatcgccgatggtgtagttgcgcacatgccccatgtgcagcttgccgctgggataggggaacatggagaggcaataatatttgggtttggaagcgtcttcggagacgttgaaaatacgggcgtcgtcccattttttctgcgccgcaggctcaatggcggcgggccggtattgttcttgcatagtcattctgttttcgcttaaaaacgttggaaaaataaagtcggcatcaattataacaggttgccggaagcggcgaatcggcagattgccggcaggatgcgtaaattcgcacgcgcattattccgtatgccgtacaaatacaccgcgtttattgatacgcacgttttttatgctaatattacaaaccaaaatcaaatgtttaaaactctcctgatgcggctcttccgaacaaaaggcagacgggcatcgggtaaaagaggattctgcatatgaaaatcaaacaaatcgtcaaaccgggcttggcagtattggcggcgggcgttctgtctgcctgcgcaaccaaaagcaacgtcaaagccgacggcacgaccgacaatccggttttcccgaaaccctattccgtaacgctcgacaacaagcgcggcacattcccgacttatgacgaactggatcagatgcgccccggcctgaccaaagacgacatctacaaaatcctgggccgcccgcattacgacgaaagtatgtacggcgtgcgcgaatgggattacctgttccacttccataccccgggcgtaggtatcgaccctgaaaacacttccggcgtagaagatgttactacctgccaatacaaagtgattttcgataaagacaaatttgcccgcagcttctactggaaccccgtcttcccgaaagatgccgcctgtccgccgcccgcacccaaagccgagccgcaagtcatcatccgcgaaatcgtgccggcaaaaccgaaacgtatccgccaataatccgacatgccgttccgcctgtttttagggatattatgcggcctgtcaatggttgcccccgtatatgcacaggggcagccggatacggtcggcgactttatccaaaagaaaaaagtcatcgtcgatacatccaaagcggaactctgtttcgctgacgaccgtcagtgccaccccgtcctcatcggtgttgccacgcccaaggggacgttcgggctgacgctgaacagtaccgacaagcccggatacggcggcgaagtcatcggtttcaagcaggagggtgattttcttttcgccctgcaccgcgtttggaatcagataccgtcggaaaggcggaacgaacgcatcgcctccccgtccgtgtccgacaggattatgaccaacggctgcatcaacgtcagcgatgcggtgtacgaaaaactgcgtcattattttgtgttggaagtgatttgaaacagacggataccgcacgcgccggtatctgttttcacattgccccgatgcctgaaacagactgtccgccacgtcatgccgtctgaaaccggcgcagatgccgccaagccttcagacggcattgcctgcccgctccgaccgaacaacaaccatctttgggagaaccttatgcccgaacaaaaccgcatcctctgccgcgaactgagcttgctggcattcaaccgccgcgtgttggcgcaggcggaagaccaaaacgtcccccttttggaacgcctgcgcttcctgtgcatcgtttcatccaacctcgacgagtttttcgaagtccgtatggcgtggctgaagcgcgaacacaaacgctgcccgcagcgcaggctggacaacggcaaaatgccgtctgaaaccatcgccgacgttaccgaagcggcgcgctccctgatacggcaccagtacgacctgttcaacaacgtccttcagcccgagctggcacaagaaggcatccatttttaccgccgccgaaattggacagacacacagaaaaaatggattgaagactatttcgaccgcgaattgctgccgatcctgacccccatcggactcgacccttcccaccccttcccgcgcccgctgaacaaatcgctcaacttcgccgtcgaactcgacggcacagacgcgttcggcaggccttcggggatggcgattgtgcaggcaccacgcatcctgccgcgcgttgttcccctgccgtccgaactgtgtggcggcggacacggcttcgtcttcctctcctccatcctgcacgcccacgtcggaaaactcttcccgggcatgaacgtcaaaggctgccaccagttccgcctgacgcgcgacagcgacttgaccgttgacgaagaagacctgcaaaacctccgcgccgccattcaaaacgagttgcacgaccgcgaatacggcgacggcgtgcggctcgaagtcgccgacacctgtcccgcctacatccgcgactttctgctcgcgcaattcaaactgaccgccgccgaactctatcaggtcaaaggcccggtcaacctcgtgcgcctcaacgccgtccccgacctagtcaaccgccccgatttgaaatttcccacacacacgccgggcagactgaaagccttgggcaaaaccgcgtccatattcgatttggtgcgccaatcgcccatcctgctgcaccacccctaccaatcgttcgaccccgttgtcgaaatgatgcgcgaagccgccgccgaccccgccgtgcttgccgtcaaaatgacgatttaccgcaccggcacgcgttccgaactcgtccgcgccctgatgaaggcggcactcgccggcaaacaagtaaccgtcgtcgtcgaactgatggcgcgttttgacgaagccaacaacgtcaactgggcgaagcagctcgaagaggcgggcgcgcacgtcgtgtacggcgtgttcggctacaaagtccacgccaaaatggcactggtcatccgccgcgaagacggcgtgctcaaacgttacgcccatctcggcacgggcaactaccaccaaggcacatcgcgcatctacaccgacttcggcctcattaccgccgacgaacaaatcaccgccgatgtgaacatattgtttatggaaatcacaggtttgggcaaacccgggcggctgaacaaactctaccaaagtccgtttaccctgcacaaaatggttatcgaccgcatcgcacgcgaaaccgaacacgcaaaagccggcaaaccggcgcggattaccgccaagatgaattcgctcatcgaaccgaccgtcatcgaagccctgtatcgggcaagcgcggcaggcgtacaaatcgatttgattgtgcgcggtatgtgcaccttgcgcccgggtgtaaaaggcttgtccgaaaacatccgcgtccgctccatcgtcggcaggcagctcgaacacgcgcgcgtgtattacttccataacaacggcacggacgatacctttatctccagcgcggattggatggggcgcaacttcttccgccgcatcgaaaccgccacgccgattaccgcgcccgaactcaaaaagcgcgttatacatgaaggactgaccatggcactggacgacaacacccacgcgtggctgatgcagcccgacggcggctatatccgcgccgcacctgccgagggcgaatccgaagccgacctgcaaaacgatttgtggacactgctcggaggctgacccgcaccgccccaatcaaaaaccatgccgtctgaaacctttccgtttcagacggcatggttttacagcaatctaaacagggcggaccggagtcaaaaacacaccttcgccattcctgcacaagcacttcccctatacgctcccaaccccaagccgccgcattccagacggcattatagtggattaaattttaggggctgtactagattagcagatatgttaccctcgaaatatgaagataacgcactgcaaattaaagaaaaaagtacagaaagaactgctccgttttttgtgctggaagttaccgcccgttctgccgccgatattttgggtatccatcccaattcggcagcactgttctaccgtaaaatccgcacggttatcaaccatcatttagccttggctgccgatgaggtttttgagggccctgtcgagccggacgaaagcgatttcggcggacggcgtaaaggcagacgtggtcgcggtgcggcaggaaaagtggttgtcttcggcattctgaaacgcaacggacggggctataccgttgtcgtagataatgccaagtctgaaacgttactccctgtcatcaagaagaaaatcatgccggacagcattgtttataccgatagtctgagcagctgcgacaagttggacgtgagcggttttatccattaccgcatcaaccattccaaggagtttgcagaccgtcagaaccacattaacggcattgagaatttttggaatcaggcaaaacgcgtcttgcgaaaattatagtggattaacaaaaatcaggacaaggcgacgaagccgcagacagtacaaatagtacgaaaccgattcacttggtgcttcagcaccttagagaatcgttctctttgagctaaggcgaggcaacgccgtactggtttttgttcatccactatacctttccgacagccgaacaaaaccccgaatccgtctgcacggttcggggtatatctccaatacgggcatcgtgttccggaaaaccgtcaaatccgcatcggcatcacaatatatttgaaattcggattgttcggcacggtaaacagcgtcgagcggttggcatcgccgaaggcaagctgcatatcgtcggaatggatgttgcgcaacacgtccatcagatagccgatattgaaaccgacttcgagttcgccgccctgataggcgatttcgatttcttcgcgcgcttcttcctgctcgttgttgctgcacacaacgctcaacaggccgggttgcaaaaacaatcgcgcaccgcggaatttttcattggcaagaatcgatgcacgttccaacgcgcccaacaattctgccctcgacaacacgaaaatcttgtcgttgtccaaaggaatcacgcggttgaaatcggggaatttgccgtcgatgaccttgctgacgatggtcgtgccgttgcattggaaacgcacctgtttgtccagcagctcgatttgaatcggatcgtcggggttgttcaacagtttgaacagttccagcaccgttttgcgcggcaaaatcacttcggcgcgcggcaaatccgcatcaatcgcgcaggctgcataggcaaggcggtgtccgtcggtcgccacaaggcgcaactggctgccctcaacctgcatcagcagaccgttgagataatagcggatgtcctgcaccgccatgctgtactgcacttgcgacagcatggttttgaaacgctcctgctccagcgagaaagtcgcgctgatgtcctcgccgacattcatcatcggaaaatcggcggcaggcagggtctgcagggcaaaacgcgatttgcccgccttcagcgtcagacggctgtcgtcccaatccagcgacaccagcgcaccggcaggcagcgcgcgcaaaatatcctgaaatttcttggcattggtggtgatgcggaagtcgcccgcgccgccctcgggacccgcagtgtcgatttggatttccaaatcggttgccaagagtttggtctgaccgccttttccctcaatcaggacgttggacaggatgggcagggtgtggcggcgttcgacgatgccggtaacggcttgcaacggcttgagcaggctgtcgcgctcggcttgtaaaatcaacatgttcgctcctttaaatcggtttgtatagtggattaaatttaaatcaggacaaggcgacgaagccgcagacggtacaaatagtacggaaccgattcacttggtgcttcagcaccttagagaatcgttctctttgagctaaggcgaggcaacgccgtactggtttaaagttaatccgctatatctttacccttcggacggcatgggcaatatcatgtcgtctgaaaacgttttccatcagttttgaatcagaatcagcagcttttcataatcctgagccaattccggatcttcttcgcgcagtttcgccactgccctgatgccgtgcataacggtcgtatggtcgcgcccaccaaacgaatcgccgatagacggcaggctcaaagtagtcagttctttggtcaggctcatcgccacctggcgcggacgggcaatgtttcgtgtccgtttcttaccgagcacatcgctgattttgatgcggtaatatttcgccaccgcatcgatgatgatgtcggcggtgatgactttgtgcttctcggcaataatgtcctgcaaagcggtacgcgccaaatcgatgtcgatgacgggacggttcataaagcggctgctcgctccgacacgattaaacgcgccttcaagctcgcgcacgttggaacggatcagattggcaatgaacagcgcggcttcgtcttcgatactgatgcccgccgcttccgcctttttctgcaaaatggcgatgcgcatttccaattcgggcggctcgagttccaaagtcagtccccatgaaaaacgggatttgaggcggtcgtccatgccttcgattttcgcaggcaacacatcgcaagtgaggatgagctgttttttctcgttgtggaaatggttgtacagatagaaaaactcttccatcgtacggtctttgcctttgatgaactggatgtcgtcgataatcagcaggtcgtattgcttgtattgctgcttgaacacgtcgtaagtgttgttgcgaaccgccttcataaagctgcggatatagtcatccgaatgcatatagcgcactttggcatcgggacggtttttcagcagctcgttgccgaccgcctgcacaaggtgggttttgcccaaacccgtgctgccatagaggaagaacgggttgtaactctgccccgggctttccgcaatcgcctgcgccgcagccgccgcaaggcggttgcccttaccttctaccaacgtatcaaacgtgtaatccggagacaggttggtctgctcgtaacgcgcctcttccgcatcgcgctgcacgtccgtccgtgctttggcaactgccaccgattccggccgggaagcagacccggcagcctgacgcggctcgtgcggcaggtttttcatacgttccgccaaaatatccgccgccgttttcgacgcagcgggtttgacaggctcttcagacggcagctcgtccaacagaacctcctgcacgggcattccctccgacaccgcatgcaaggacggctcggcaggttcgacagcaccttcaaccgccgccatctcataacgcacgccttctcccggtttgaatacgaaggcggaacggccggcagccaactcttccctcaccgcttctatttttccggcaaactggctcttgagcatattgcaggcaaactggttcttgccgtacaccacccatacgccaccctcctcaccaacggtaaggggcgcaatccattgcgcaaactgcccttgaggcaacatatcgtgaagacggcggaggcacagcggccaaaactctgctaatgtcatggataggctcgaatcggtaaaaatgaaatcgaaaacaaagaaaatataatattttcaaaaagaaaacaaatctgttgaacgcacatcggttcaaaacgcgactgcccgattataccgactcacgaatattttatccacaacccgtgcaaaaatttatccacagaaaggcggcggaaatccgcaggcaatcgggcaatcttcctgcaaagtttctatattgattgacaaaagcggcaaattggagtgtaattcacggtttaattatctacccattctattttaggaaacatcatgaaacgcacttatcaaccttccgttaccaaacgcaaacgcacccacggcttcctggtgcgctccaaaacgcgcggcggccgcgcagtattggccgcacgccgtgccaaaggccgcaaacgcctggcggtataattttggactaccgcttcggaaggcagtaccgcttgttgaaaacggatgatttttcatccgtttttgcattcagaaaccgccgcagccgcgacctgctgcaagtttcgcgctcaaacggcaacgggctgggccatccccgcatcggtctggtggtcggcaaaaaaaccgccaaacgcgccaacgaacgaaattatatgaagcgcgttatccgcgactggtttagattgaacaaaaaccggctgccgccgcaggatttcgtcgtgcgcgtccaccgtaaattcgacagggctaccgcaaaacaggcaagggcggaactggcacaactcatgttcggcaaccccgcaaccggatgcaggaaacaggcatgatcagaacggtactctgcaggcaaggttcagacggcaacgggtttcccatacaaggaacatcccgatgaacttcctattgtccaaactcctgctgggactgatacggttctaccaatattgcatcagcccgctgattccgccgcgctgccgttatacgccgacctgttcgcaatacgcggtcgaagcggtcaaaaaatacggcgcattcaaaggcggccggctcgccatcaagcgcattgcacgctgccaccctttcggcggacacggacacgaccccgttccctgacccgacgcaatattcaaattgcacgctttccttttatttcccatcggtttctatataatgccgtctgaagcttcgggcaggcggcacgaccgccgggtatgaagcccgcccttattccccgtctatcggaacacgcaacctgcggcatttccgaccattcaggaaactcttatggattttaaaagactcacggcgtttttcgccatcgcgctggtgattatgatcggctgggaaaagatgttccccactccgaagcccgtccccgcgccccaacaggcagcacaacaacaggccgtaaccgcttccgccgaagccgcgctcgcgcccgcaacgccgattaccgtaacgaccgacacggttcaagccgtcattgatgaaaaaagcggcgacctgcgccggctgaccctgctcaaatacaaagcaaccggcgacgaaaataaaccgttcatcctgtttggcgacggcaaagaatacacctacgtcgcccaatccgaacttttggacgcgcagggcaacaacattctaaaaggcatcggctttagcgcaccgaaaaaacagtacagcttggaaggcgacaaagttgaagtccgcctgagcgcgcctgaaacacgcggtctgaaaatcgacaaagtttatactttcaccaaaggcagctatctggtcaacgtccgcttcgacatcgccaacggcagcggtcaaaccgccaacctgagcgcggactaccgcatcgtccgcgaccacagcgaacccgagggtcaaggttactttacccactcttacgtcggccctgttgtttatacccctgaaggcaacttccaaaaagtcagcttttccgacttggacgacgatgccaaatccggcaaatccgaggccgaatacatccgcaaaaccccgaccggctggctcggcatgattgaacaccacttcatgtccacctggattctccaacctaaaggcagacaaagcgtttgcgccgcaggcgagtgcaacatcgacatcaaacgccgcaacgacaagctgtacagcaccagcgtcagcgtgcctttagccgccatccaaaacggcgcgaaagccgaagcctccatcaacctctacgccggcccgcagaccacatccgtcatcgcaaacatcgccgacaacctgcaactggccaaagactacggcaaagtacactggttcgcctccccgctcttctggctcctgaaccaactgcacaacatcatcggcaactggggctgggcgattatcgttttaaccatcatcgtcaaagccgtactgtatccattgaccaacgcctcttaccgctctatggcgaaaatgcgtgccgccgcacccaaactgcaagccatcaaagagaaatacggcgacgaccgtatggcgcaacaacaggcgatgatgcagctttacacagacgagaaaatcaacccgctgggcggctgcctgcctatgctgttgcaaatccccgtcttcatcggattgtattgggcattgttcgcctccgtagaattgcgccaggcaccttggctgggttggattaccgacctcagccgcgccgacccctactacatcctgcccatcattatggcggcaacgatgttcgcccaaacttatctgaacccgccgccgaccgacccgatgcaggcgaaaatgatgaaaatcatgccgttggttttctccgtcatgttcttcttcttccctgccggtctggtattgtactgggtagtcaacaacctcctgaccatcgcccagcaatggcacatcaaccgcagcatcgaaaaacaacgcgcccaaggcgaagtcgtttcctaaatgccgcagcatgaaaaatgccgtctgaaacctgttcagacggcatttttattgcccaccccctatcggggcggaaatcttcaacccgcatacatcacaaaaatcgtcgggcgttttttcagattgggcatttcttttctttttcgccactgcacgattgtttgactgatgatttcctgtgtcggcaaggtcaaatccgtagccgtgcataaacgcgtttcaggatgcaggttttccaccgcatcggcaagcagcgcatcattgcggtaaggcgtttcaataaaaatctgcgtctcgccgcactggcgcgaacgctgttccaaagcccgaaaagcctgaatccgctcgtttttttcagacggcagatagcctttaaacgcaaaactctgcccgttcgcacccgaagccatcaaagccagcagcaggctggaaggcccgaccagcggacgcacttcaaaaccgtgtttatgcgccaatgccaccaaattcgcacccggatcggccacagccgggcaacccgcctcactgacaatgcccatactgcgcccttcttgcaaaggtttcagcaattccggcaaagtcttcaaatccgtatgttcattcaacgtttgcagattcagctcgcggataggcgtagtcacgcccaaatgtttcaaatgcgcacgcgccgttttttccgcctccacgacaaaatccgtcagcccgacaatcgcctgttgttcatgcggcaacaggcacggcgtgtcaggcgtacccaaaggcgtaggaatcaaatacaaaacaggagacatcattccctcactcatcggttaaaaatgccgtctgagcctttcagacggcataaacgggcagttacagaacctccacgccctcatttttcaagaaatcgaccagacggaaaaccggcaaaccgattaaagcattcggatcggtactctcaatcctttcaatcagcaatgcacccaaatcctcactcttcagcgcacacgaacaataaaccgcatcaggctcgcgctccaaatagcggaggatatgcaactcgtccaactgcctcatcacgaccaccgtcttatcgatatgccgccgcatcctgcccgtaaccgtattcaacagcacgatcgcgctgtaaaactcaatctccctgccgctcaagtgcatcagcatcttttgcgcattggcaaggttcatcggcttgccccactgcctgccgtcgcaccacgccacctggtccgcaccgacaatcaacgcctctgggaaacgcccggtcaacgaccgcgccttaccctcggcaaggcgcaatgccgtctgaggggcggattcccccaacatcggcgtttcgtcaaaatcgggggacgccgcctgaaaggcaatgccgagcctttccatctgttcgcggcggaaaaccgaactcgtacccaaaatcaaaggcagttccaaacccatcccatcctccttaccgttgaaaacacgcccgaaggggcagtaaaatccagccatgcgccgaaacacggatacccgccttcggcgtaccgcaacatttttcttaaaaatattgacgttagaacatctaaattatatcatatcccgtttatgtcagaccctaatttgattgacttggaaatttttgccgccgaagggcagaacctgcaaggcagttttctgctggaagaattggatgaacgcgtcagttcgcacgattatcccgccgacaggcagaccaaaatatcgtttacactgaccggcggtcgcgaccggctgcaacgcctgttcctcgacctgaacgtcaaagccgatatgcccctgatttgccagagatgtatcaaacccatgccgttcatgcttgatgaaagcagccgtatcgtcctgttttccaacgaagagtccttggacgaatccatgcttgccgacgaagaactcgaaggcatactgattgaaaaagaactcgacgtgcgcacattggtagaagaccaaatcctgatgtccctgcccttttcgccgcgacacgaagactgcggcgacaatgggacactggaagaagtcaatcgggacaaacccaacccctttgctgttttggcaggtttgaaaagcaattgattaggacacagtttatttatctaggagcttgaaatggccgttcaacaaaacaaaaaatccccttccaaacgcggtatgcaccgttcgcacgacgcgctgaccgcgcctgcactgtctgtcgacagcacaaccggcgaagtacaccgcccgcaccacatctcccccaacggtatgtaccgcggccgcaaagtggtcaaagccaaaggcgaataatccctattcgactgactgaaaaagccagaacattgccatgcaattactggctttttttgcattggacgcaccatccgtccaaactttcgccatacgtcaacacacaggggcaaagcgttccgtataataccccgtgaaaatattccaaaagccccaaccaccaaggaaattccgatgaaacagaaaatctggtacacctacgatgacatccaccgcgtcatcaaagcattggcagaaaaaatccggaacgccgacatcaaatacgatgccatgattgccatcggcggcggcggctttattccggcacgtatgctgcgctgttttctggaaattccgatttatgccgtaaccaccgcctattacgacagcgacaacgaaggacaggttaccgaagaagtcaaaaaagtccaatggctcgaccccgttcccgaagccctgcggggcaaaaacgtactcgtcgtcgatgaagtggacgacagccgcgtaaccatggagttctgcctgaaagaactgctcaaggaagacttcggtacgatcggagtcgccgtactgcacgaaaaaatcaaagccaaagcaggcaaaatccccgaaggcattccctatttcagcggcatcaccgtagaagactggtggatcaactatccgtgggacgcactcgacatcgacgaacacaaccgccttgccgaggccggccgaggctgaccctttcagacggcatattttccgaaccgatgccgtctgaagcccgcacgacccctgccgcagaccgaaaacctaccggagaaaccctatgattacattggccgtagatgccatgggcggcgaccaaggacttgccgttaccgtacccggcgcaaccgcattcctccaagcacaccccgatgtccgcctgattatgaccggcgacgaaacgcaactgcgccaagccctgaccgcggcaggcgcaccgatggaacgcatcgacatctgccataccacccaagtcgtcggcatggacgaagccccgcaatccgccctgaaaaacaaaaaagactcctccatgcgcgtcgccatcaaccaggttaaagaaggcaaagcccaagccgccgtatccgcaggcaacacgggtgcgctcatggcaaccgcacgtttcgtcctcaaaaccattcccggcatcgaacgccccgccatcgccaaattccttccttccgacaccgaccacgttacccttgcactcgaccttggcgcgaacgtcgactgcacgtccgaacagctcgcccaatttgccgttatcggcagcgaactcgtccacgcactccatcctcaaaaaggacagccgcgcgtcgggctggtcaacgtcggcacggaagacatcaaaggtacggacaccgtcaaacaaacctacaaactgctgcaaaacagcaaactcaactttatcggcaacatcgaaagcaacggcatcctctacggcgaagcagatgtcgtcgtcgccgacggctttgtcggcaacgtcatgctcaaaaccatcgaaggcgcggtcaaattcatgagcggagccatccgccgcgaattccaaagcaacctgttcaacaaacttgccgccgttgccgccctacccgccctcaaagggctgaaaaacaaactcgacccgcgcaaattcaacggggccatcctgctcgggctgcgcggcatcgtgattaaaagccacggcggcacagacgaaaccggtttccgctatgccctcgaagaagcctaccacgaagccaagtccgccggcctttccaaaatcgaacagggcgtagccgaacaactcgccgcactcgaaactgccaaagccgtccaaaacgaaaatgtcggcggtctgtaacacacacgatgccgtctgaacgcccccgcccctttcagacggcatccgcccgcaccaaacctgcgggcgcggacggcgatgcgcctgtccggcacttcccaaatatcgccttgtaaaataaggagtatttgaaaaatgaagacattagaaaaacggatgaaagctctagacaaacggattatgaagttcggaaaatcccttgaaggcaggcttgatgcccgtctgattgaatccgcattggattatattcattattcggaacgttttttggcttttgaaatcctgtgtacttatatcgaagatttcgatgtccggctgacggaacaagaatcccgggaaatttcttttatcaacaaggaatttgagatagaaagcacgtccgattaaccaataaagccaatgggttgataaacatgaaaacatcgacggtcgtttttggcggattttttatggcagacaacggagagcgaatccaaatccccgttttggaaaatcctgacattagggaaatcaatcactttttttccgtatcaaattttgagaaaaaaaccggcgtccttgttttcagaatcatccccgagccggaatttggcaataccgaattaactgtctattttaaaaaaggatattatagtggattaacaaaaaccagtacggcgttgcctcgccttgccgtactggtttttgttaatccactatatcagacgaaaacaaacacccgcgccaatagcctgacggcaacccggcaatcaaaatgccgtctgaagcagcttgggctttcagacggcatttccttcgcttaaaacagcgtatcggcaaccccgccctgcctgtccacggcaatctgcatctgaaaaccatctgtatcccaaaccacacccccatccctgtttccatcatgtgcaccctgtccgtattgggcaatcatctgtttttcgcttacaatagccgaatctgaaccaactctctaaaaaggccgttcccatgcagtatgcaaaaatttccggcacaggcagctatcttcccgccaaccgcgtcagcaatgacgaccttgcccaaaaggtagatacctctgacgagtggattaccgcgcgcacgggcatcaaattccgccatattgcagccgaaaacgaaaaaaccagcgatcttgccgccgaagcggcgcaccgcgcgctggatgcagccggattagacagcggcgaaatcgatttgattatcgtggcaacggcaacgccggatatgcagtttccgtctactgcgaccatcgtgcaacaaaaattgggcatcaccaacggctgccccgcgtttgacgtacaggcggtgtgcgccggctttatgtacgcgctgaccacggcaaacgcctacattaaaagcggtatggcgaaaaacgcgctggtcatcggcgcggaaaccttcagccgcattgtagactggaacgaccgcacaacctgcgtattgttcggcgacggcgcgggcgcggtggttttaagcgcgtcggacacgccgggcatcatccacagcaaactcaaggccgacggcaattatctgaaactcttaaacgtccccgggcaaatcgcctgcggcaaagtttccggttcgccgtacatttcgatggacggtcccggcgtgttcaagtttgccgtcaaaatgctgtccaaaatcgccgatgacgttatcgaagaagcaggttacaccgccgctcaaatcgactggattgttccccatcaggcaaaccgccgcattatcgaatcgaccgcgaaacatttaggtttgagtatggacaaagtcgtcctgaccgtccaagaccacggcaacacatccgccgcatcgattccgctggctttggatacgggcatccgcagcggacaaatcaaacgcggtcaaaacctgctgctcgaaggcatcggcggcggtttcgcgtggggcgcggtgctgttgcaatattgaacccgatgccgtctgaaacaggctttcagacggcatttcccatatcatgaagcggcaggctttcttcaaactgatggcgtgtgcggcatttctgtctgccgtttcgctgcgcctccccgtattgggcgcgtgttacgcaatattgtccctctatgcgtttgcactttacggcatcgacaaacggtgcgccatacgggggcaacgccgcattcccgaacaccgcctgctgctgcctgcattgctcggcggctgggtgggcgcgtatttcggcagcatgacattcaaacataagacagcgaaaaagcgttttgttgtgctgttccgtctgactgtttcaggtaatgtcttggcgaccctcatcctgatttatagtggattaaatttaaaccagtacggcgttgcctcgccttgccgtactatttgtactgtctgcggcttcgtcgccttgtcctgatttttgttaatccactatattattttgtcccgcctgaatttttcgtaaaactcgggcagaatacctgattatccaaccaaacaaaggaatactatgtcttttgccttcttttttcccggacaaggttcccaaagcctcggtatgatgaacggctttgccgaacacgccatcgtcaaaaacacctttgccgaagcctccgccatattggggcaggacttgtgggcgatgataaacggcagcgatgccgaaatcatcggtcaaaccgtcaacacccagcccattatgctcgccgccggcgttgccgtttaccgcgcctatttagaagcgggcggcaaaacgcctgccgccgttgccggacacagcctcggcgaatacaccgcactcgttgccgccggcgcattgaattttgccgacgcggtcaaactcgtgcgcctgcgcgccgaactgatgcagtccgccgtaccgcaaggcgtgggcgcaatggcggcgattctcggcttggaagatgagcaggttaaagccatttgtgccgaagccgcccaaagcgaagtggtcgaagccgtcaacttcaactcacccggacaaatcgtgattgcaggcaacgccgccgccgtcggacgcgccatggctgccgccaaagaagccggtgccaaacgcgccctgccgctgcccgtgtccgtaccttcccattgcagcctgatgaaacccgccgccgacaaacttgccgaagccctgaaaaccgttgaaatcaagcagccgcaaatccgcgttatccacaacgccgacgttgccgcctacgatgatgccgacaaaatcaaagacgcgctcgtccgccagctttacagccccgtacgctggacggaaaccgtcaacgccctcgtttcagacggcattgccgaatccgccgaatgcggcccgggcaaagtgttggcgggcttggcaaaacgcatcaacaaagccgccgcgtgcagcgcactgaccgatgccggacaggttgccgcctttatcgaagcgcactgacttcgttctgcaaaaagcagcctgccctcttcaggctgcttttcatgtccgaacgacggcagccccatatttacgctataatccatcccgaccaaaccaccgacagcggctgccgttgcagttcccgccctaccgatatgatagaaaaactgactttcggactgtttaaaaaagaagacgcgcgcagctttatgcgcctgatggcgtacgtccgcccctacaaaatccgcatcgttgccgccctgattgccattttcggcgttgccgccaccgaaagctaccttgccgccttcatcgcccccctgattaaccacggcttttccgcacctgccgcgccgcccgagctgtctgccgccgccggcatcatttccaccctgcaaaactggcgcgaacagtttacctatatggtttgggggacggaaaacaaaatctggaccgtcccgctcttcctcatcatcctcgtcgtcatccgtggcatctgccgctttaccagcacctatctgatgacttgggtctccgtgatgaccatcagcaaaatccgcaaagatatgtttgccaaaatgctgaccctttcctcccgctaccatcaggaaacgccgtccggcaccgtactgatgaatatgctcaacctgaccgaacagtcggtcagcaacgccagcgacatcttcaccgtcctcacgcgcgacacgatgatcgttaccggcctgaccatcgtcctgctttacctcaactggcagctcagcctcatcgtcgtcctgatgttccccctgctctccctgctctcgcgctactaccgcgaccgtctgaaacacgtcatttccgactcgcaaaaaagcataggcacgatgaacaacgtgattgccgaaacccatcagggacaccgcgtcgtcaagctgttcaacgggcaggcgcaggcggcaaaccggttcgacgcggtcaaccgcaccatcgtccgcctcagcaaaaaaatcacgcaggcaacggcggcacattccccgttcagcgaactgatcgcctcgatcgccctcgccgtcgtcatcttcatcgccctgtggcaaagccaaaacggctacaccaccatcggcgaatttatggcattcatcgtcgcgatgctgcaaatgtacgcccccatcaaaagccttgccaacatcagcatccctatgcagacgatgttcctcgccgccgacggtgtatgtgcatttctcgacaccccgcccgaacaggacaagggcacgctcgcaccgcagcgtgtcgaagggcgcatcagcttccgcaacgtcgatgtcgaataccgttcagacggcatcaaagccctcgacaacttcaacctcgacatcagacaaggcgaacgcgtcgccctggtcggacgttccggcagcggcaaatccaccgtcgtcaacctgctgccccgctttgtcgaaccgtctgccggcaacatctgcatagacggtatcgacatcgccgacatcaaactcgactgcctgcgcgcccaattcgccctcgtctcccaagacgtattcctgtttgacgacaccctgtttgaaaacgtccgatacagccgtcccgacgcgggcgaagccgaagtcctgttcgccctccaaaccgccaacctgcaaagcctgattgacagctccccgctcggactgcaccagcccatcggatcgaacggcagcaacttatccggcggacagcggcaacgcgtcgccattgcccgcgccattttgaaagacgcgccgatattattattggacgaagccaccagcgcattagacaacgaatccgaacgcctcgtccaacaggcgctcgaacgcctgatggaaaaccgcaccggcatcatcgtcgcccaccgcctgaccaccatcgaaggggccgaccgcatcatcgtgatggacgacggcaaaatcatcgaacaaggcacacacgaacaactgatgtcccaaaacggttactacacgatgttacgcaatatctcaaacaaagatgccgccgtccggacggcataaacaaaatgccgtccgaaatggtacaatcgccccgaccctttcagacggcatcatatccgccgacccatccgattatcttcaatcactgtaaaacccattatgacccaagacaaaatcctcatccttgacttcggttcgcaagttacccagctcatcgcccgccgcgtgcgcgaagcccacgtttactgcgagctgcattctttcgatatgcctttggacgaaatcaaagccttcaaccccaaaggcatcatcctctccggcggccccaattccgtttacgaatccgactatcaagccgataccggtatttttgatttgggcattccggttttgggcatctgttacggcatgcagtttatggcgcaccacttgggcggcgaagtgcagcccggcaaccagcgcgaattcggttatgcgcaagttaaaaccatagacagcgagctgacacgcggcattcaagatggtgagccaaacacactcgacgtatggatgagccacggcgacaaagtgtccaaactgcccgacggtttcgccgtcatcggcaacaccccgtcctgcccgattgccatgatggaaaacgccgaaaaacaattctacggcatccagttccaccccgaagttacccacaccaaacaaggccgcgccctgttgaaccgctttgtcttggatatttgcggcgcacaaccgggctggacgatgccgaactacatcgaagaagccgttgccaaaatccgcgaacaggtcggcagcgacgaagtgattttaggtctgtccggcggcgtggactcttccgtagccgccgcgctgattcaccgcgccatcggcgaccaactgacctgcgtgttcgtcgatcacggtttgttgcgcctgaacgaaagcaaaatggtgatggatatgttcgcccgcaacttgggtgtgaaagtgatacacgtcgatgccgaagggcagtttatggcgaaactcgccggcgtaaccgaccccgagaaaaaacgcaaaatcatcggtgcggaatttatcgaagtatttgatgccgaagaaaaaaaacttaccaacgccaaatggttggcacaaggcacgatttaccctgacgtaatcgaatccgcaggtgcaaaaaccaaaaaagcccacgccatcaaatcgcaccacaacgtcggcggcctgcctgaaaacatgaagctcaaattgcttgagcctttgcgcgatttgttcaaagacgaagtacgcgaattgggtgtggctttgggcctgccgcgcgaaatggtgtaccgtcatccgttcccgggtccgggtttgggcgtgcgtattttgggcgaagtgaaaaaagaatatgccgacctgcttcgtcaggcagacgatattttcattcaagaattgcgcaatactaccgatgaaaacggtacatcttggtacgacctgaccagccaggcattcgccgtgttcctgcccgtcaaatctgtcggcgtaatgggcgacggccgcacatacgattacgtcattgccttgcgtgccgtgattaccagcgactttatgaccgcgcattgggcggaactgccgtattccttgttgggcaaagtgtccaaccgcatcatcaacgaagtcaaaggcatcaaccgcgtggtttatgatgtgagcggcaaaccgcctgccaccatcgagtgggaataaacagcaaacatggctgccccgtccggcgcagtccttcgattatcggaaaaaaggaaaaaatatgagcacacaagatttaaacggcaaaatcgctttggtaacaggcgcatcgcgcggtatcggtgcagcaattgccgacacgctggcggcagccggtgccaaagtcatcggtacggcgaccagtgagagcggtgcggcggcgattagcgagcggttggcgcaatggggcggcgaaggccgcgtattaaattccgccgaacctgaaaccatcgaaagcctgattgccgacatcgaaaaagcgttcggcaaactcgatattctggtcaacaacgccggcatcacccgcgacaacctcctgatgcgcatgaaagaagaagagtgggacgacatcatgcaggtcaacctcaaatccgtgttccgcgcttctaaagccgttttgcgcggtatgatgaaacaacgttccggccgcatcatcaacatcacatccgtcgtcggcgtgatgggcaatgccggtcaaaccaactatgccgcggcaaaagcaggcttaatcggtttctccaaatccatggcgcgcgaagtcggcagccggggcattaccgtcaactgcgtcgcccctggctttatcgataccgacatgacacgcgccctgccggaagaaacccgccaaacctttaccgcccaaaccgccttgggcagattcggcgacgcgcaagacatcgccgatgcggttctgttcctcgcttccgaccaagcaaaatacatcaccggccaaacgctgcacgtcaacggcggtatgctgatgccttaacagacaactttttcaaccatgccgtctgaagccctttcagacggcatttgcattctcaggcaaaatgaacacacaccacaccccgccctgcccatgcggctcaggcacaagctgagacctttgcaaaattcctttccctcccgacagccgaaaccccaacacaggttttcagctgttttcagctgttttcgccccaaataccgcctaattctacccaaatacccccttaatcctccccggacacctgataatcaggcatccgggtcaccttttaggcggcagcgggcgcacttagcctgttggcggctttcaaaaggttcaaacacatcgccttcagatggctttgcgcactcactttaatcagtccgaaataggctgcccgggcgtagcggaatttatggtgcagcgtaccgaagctctgttcgaccacatatagtggattaacaaaaaccagtacggcgttgcctcgccttagctcaaagagaacgattctctaaggtgctgaagcaccgagtgaatcggttccgtactatttgtactgtcttcggcttcgtcgccttgtcctgatttttgttaatccactatacatcatcgctactaccgttccggcgcaacaggcattcctcgatgccgccgaactgatgcaatggagtatagaaaccgaagggctgggcttgaacgtcatctcgcacaagatactcggcaaagaccacgcccaagtcgaatttgaagcctacttccgagacggacaacaccgatccgcgcatcacgaactgtccggcttcgtcaacatcggcggacaatggtattttatcgatcccaccgttccgcatcctgcgatgaaacaaccctgcatttgcggatcaggcaaaaaattcaaagcctgctgcggcaaatatctgaaacctgtcgcataaaaatgccgtctgaacgttcagacggcattttcaacgtgcaaaaaaaaccattcataccaagggtaagtatgaatggtcaatacattgcgggaaaacgtcttacttgctgcactgccgaaaagggagaaacggcagcggtaatcagcggaaaggattgtacccgaattaatattaagaaacgttaatcgcgaaaatatattaacaaacctgttgaaacctattggttttcccgtatccacccgacccagcgttcaaacagcttcggttcgagcgcggcaacgaccgagcgtttgaacacgtgttcaccactccaaaacccgtcgccttccaaagtcgtcagcctgccgcccgcctcctcgaaaatcaacgcgccggcggcataatcccacagcttctgcccgccgtgaacataaacatcataacgcccgcacgccagataacaccaatccaacgtactgctgcccatactccgtatcgttccaaaaggcgcgagcgtactcatacggctggaaagtttgcccgaacgcagatatttgatttccacgcccgcaatcgcctcattgagttttttatccacgaggcgcaggggcagacgcgtcccgtttaaaaacgccccctgcccgcgttcggcataaaaacattcgccgctgactgggttgtagattacgcccaactcggcgcgcccgttgcggacaaacgccaccgataccgcaaaatgcggcagcccgttgacaaaattgttcgtcccgtctatcggatcgacaatccacagccccttttcccccgaatattgttcccacaaagccgactgttcctgccgcgacatttcctcacccaacatcggactgtcgattaaaagcggcaacgcggcggcaaaagccgtctgcgcggcaatgtccgcctcgctcaacatcgaaccgtcttccttgcggtgagacggcgtattcaaaaaacgcggcataatttcggtttgcgcgatatggcgcacgactttctgcaaacggtgtaacacttcctactgtcctcatattttgaacttgcggcgcgcgaacgtataatgtccgcttccatcacgccgctgcgacggattataaccgtccgaaccgccaaaaactatgccccgattccacctgcccgaaaacctttccgtcggacaaaccgtcgccctgcccgacaacatcgtccgccacctcaacgtcctgcgcgtccgccccaacgaaaacatcaccctcttcgacggcaaaggcaaggcacacgccgcacggctgaccgttttggaaaaacgccgcgccgaagccgaaatcctgcacgaagacacaaccgacaacgagtccccgctcaacatcacactgatacaatccatctcctccggcgatcgcatggatttcaccctgcaaaaaagcgtcgaactcggcgtaaccgccatacagcccgtcatcagcgaacgctgcatcgtccgcctcgatggggaacgcgccgccaaacgcctcgcacgctggcaggaaatcgtcatctccgcgtgcgaacaaagcggcaggaacaccgttccccccgtactgcccatcatcggctaccgtgaagcactcgacaaaatgccgtctgaaagcaccaagctgattatgagcatcaaccgcgcccgcaaactcggcgacatacgccaaccgtccggcgcaatcgtctttatggtcgggcccgaaggcggctggacagaacaggaagaacaacaggcatttgaagctggctttcaggcggttacactcggcaaacggattttacgcacagaaaccgccccactcgccgccctcgccgccatgcagacgctttggggcgatttcgcataaacagaaatgccgtctgaaacccgttcagacggcattttgcagccgattaagatagtaggttcaaataagatttcccgtgtcgtcattcccgcgaaagcgggaatctagaaacgaaaaactacagagatttatccgaaacaacaaccctctccgccgtcattcccgcaaaagcgggaatctagaaacgaaaaactacagggatttatccgaaacaacaaaccctctccgccgtcattcccgcgcaggcgggaatctagaaacgaaaaactacagggatttatccgaaacaacaaaccctctccgccgtcattcccgcgcaggcgggaatctagaaatttaacgttgcggtgatttatcggaaatgactgaaactcaacggactggattcccgcctgcgcgggaatgacgagattttaggtttctgtttttggttttctgttctcgcgggaataacggaattttaagttttaggaatttgtcggaaaaacagaaatccccccgccgtcattcccgcaaaagcgggaatctagaaacgaaaaactacagggatttatccgaaacaacaaaccctctccgccgtcattcccgcgaaagcgggaatctagaaatttaacgttgcggtgatttatcggaaatgactgaaactcaacggactggattcccgcctgcgcgggaatgacgaattttaggtttctgtttttggttttctgttctcgcgggaataacggaattttaagttttaggaatttatcggaaaaacagaaatccccccgccgtcattcccgcgaaagcgggaatctagaaatttaacgttgcggtgatttatcggaaatgactgaaactcaacggactggattcccgcctgcgcgggaatgacgaattttaggttgctgttttttggttttctgtttttgcgggaatgacgaattttaggtttctgtttttggttttctgttctcgcgggaataacggaattttaagttttaggaatttgtcggaaaaacagaaatccccccaccgtcattcccgcaaaagcgggaatctagaaatttaacgttgcggtgatttatcggaaatgactgaaactcaacggactggattcccgcctgcgcgggaatgacgaagtggaagttacccgaaacttaaaacaagcgaaaccgaacggactagattcccgcctgcgcgggaatgacagtgtatccatttctaattttaatccgctatattttacacaaactatttgaacgatatgacccgcctgccgtaagctttctcaagctccgcctgcctttgacgctccattcttttcttcttttccctaccgaatttacccaaagcacgcttcaagtcaaacatcaccttcaacgaacggcggtgtcttctttcttgttccctatctttttccaaatcgctacccaacatactgtttttactgaggaacttggcataatgcaattcttgggtacataaggcgggattaacctgataaacaggcatcccctccttatcaaagaaataagtaaacatcatccaatctaccgctttaatccactctgccggcaaaacggcaaacctttccaagaaaaaccgcatcgcctcacgcgaaatgatatagccagccgtcccccaatgttcgctctccagcaaaggaaatgaccgattctcataattcaggactttatccggtctgacaataactttcgcaaacatcgtttccaaacgaacgataaaggcagaatccttatcaaaacgctcttccaaccaagtatcttcggcaaggaacttttctgcgtctttgccaagcaggacatcatcctcaaatacggcaacatagggcagaccttcatccaatgcctgtttccacaatacggcgtggctcataaagcaggctttttccacttcgctcaacaggtgctgttttgccaatcccggcaccaattccgccatcatccgattcagttcttcagacggcatcagtgcgtcgaaaaactgaaacgggatgccgcgcacgccgaaggttgcggcaatgtgcgccctgcgttctgcggcggaagctaagctgataacatggttttgcataatttatcctgttttttgtctgttggataaagcggcgtttttcaacggtttttcagcaatcggcgcaaaatgccgaagtattgcctcaaggtaaacagccgccgcatcctgccgtctgctgcaaatacgatgtccatctctcctccttttattggaaaggcacaatgaactgttcgcgcctttgccggcgtttttccctttccctgctgattttggtcaaggcgcggatcaggcggtgtttgaatgtgttggcgggggaatcgcgcctttgctgtttgcggttcaggaggcggtcgtgttcgatcaggctgcccaatgcgctgttttggtcgtgaaacttggcataatgcagctcttgggcgcacaaggcgggattgagctggcaaaccggcattccttccctgtcgaaaaaatcgctgaacatcatcagatcgacggggtgcagcccttcgggcggcagggcggcaaacctgtccaggaaaaaccgcatcgcttttcgggaaatgatatagcccgccgtcccccagtgttcgctttccaacagcggaaaggcgcgcccgcagtaatccgccacgccggagggcgaggtcaggacgtgcataaacatcgtttccaagcggacgataaaggcggtatccgggtcaaagcgttcttgcagccaagcgtcttcggcaaggaatttttccgcaccttcgccgagtaaaacgtcgtcctcaaatacggtgatatacggcagaccttcgtccaatgcctgcttccacaatacggcgtggctcataaagcaggctttttccactccgctcaaataggggtgcgccgacaagccggggacgagttccgccattgcctgttccagcctttcagacggcatcagtgcgtcgaaaaactgaaacgggatgccgtgcctgccgaaggtatcggcaatgtgcgccctgcgttctgcggcggaagctaagctgataacgtggttttgcataatttatcctgttttttgtctgttggataaagcggcgtttttcaacggtttttcagcaatcggtgcaaaatgccgaagtattgcctcaaggtaaacagccgccgcatcctgccgtctgccgcaaaatccagccacgcgccggcgggcagcgtgtccgtccgtttgaagcattggtacaaaaaccggcgggcgcgttcaaaatcttcttccggcaaatgtttctccagcaattcatacgctactgcttttatttggcggtattcaaggctgtcgaaccgggttttaaaacccatagactgcaaaaaatcgtttctggcggttttttggatgccttgcgcgatttcgtgttggcggatgctgtatttggatgaaacctgattggcgtgaaggcggtatttgaccaaggcttcgggataataagccagcctgcccaatttgctgacatcgtaccaaaattggtaatcttccgcccaatcccgctcggtgttgtaacgcaaaccgccgtcaatgacgctgcgcctcataatcatcgtgttgttgtgtatggggttgccgaaagggaaaaagtcggcaatgtcttcgtgtcgggtcggttttttccaaattttgccgtgttcgtggtgccgcgccagccggttgccgtccttttcttccgacaaaacttccagccacgcacccatcgcgatgatgctgcggtctttttccatctcacccacgattttctcaatccagtcgggggcggcaatatcgtctgcatcggtgcgcgcaatatattccccccccccccccgactttgccaattcatccagcccgatgtttaaagagggaatcagaccggaattgcgcggctgcgcgaggatgcggatgcggccgtcctgttcttggaaacgctgggcaatggcaagcgtaccgtccgtcgagccgtcatcgacaatcaaaatatccaagttgcgccaagtttgattcacgacggcggctaatgattgggcgaaatatttttctacgttgtaggcgcaaatcaatacgctgactaaaggctgcaatttattctcccgataggcacgatgccgtctgaaggcttcagacggcatttggactgtacaacggttactcgcccaaaagcgcgatatccgctaccgcgttcatttgttctgccaagcggttcagcaggttcaggcggttttgtttcacggcggcatcttccgccatcaccatcacgccgtcgaagaaggcatcgacttgcggtttgacggaagccagttcggacaaggcggtctggaaattgccttcggcaacggcggcggcaattttcggctgcaagccttgtgcggcggcaaagagggctttttcttcgtcctgttgcagcaagctttcgttaaccgcgcccaactcggcatcggcttttttcagcaggttttgcacgcgtttgttggcagcggcgagcgcggcggcttcgggcagttgtttgaacgcggcgacagcctgcagtttggcggtcaaatcgtccaaacggcgcggctgcttggcaagtacggcggcaacgatgtcttgcggataatcgttttgcagcaatacggcaaggcgcgcctgcatgaagtcggcggtttcagacggcgttttttcgttgagcaaaccttgcgggaagctgttgaaggccgtctgaatcagttcgtttacgtccaaaccgtactgcatcagcatacgcaaaatacccaatgcggcgcggcgcagggcgtatgggtctttgtcgccggtcggaatcaggccgataccccaaatgccgaccaaggtttccagtttgtcggcaagcgcaacggcggcggcaattttgccctcaggcaggttgtcgccggcaaaacgcggttggtagtgttgctcgacggcttcggtaatttcttcggtttcgccgtccaagcgggcgtagtatttgcccatcgtgccttgcagttcggggaactcgccgaccatttcggttactaagtcggcttttgccaaacgcgcggcgcgttcggctgcggcggcatccgcgcccaaagccttggcgatatgggcggcgatgctttgcaggcgttcgatgcgttcggcttgcgaaccgattttgttgtgataaaccacgttcgtcagtttgggcaggcggctttccaaagtcgctttttggtcttgtttgtagaagaactcggcatcagacaggcgcgcgcgcaagacacgttcattgccttggatgatgtgtgacggatcttcggtttgcagattggacaccagcaggaagcggttcatcagcttgccgttttggtcgagcagcgggaagtatttttggttttgctgcatcgtcagaatcaggcattcttgcggtacggcgaggaagtgttcttcaaaaccggcttccaataccacaggccattcgaccagcgcggttacttcgtccaacaaggcttcatcggcggcggcggtcgcgttcagacggcgtgcctgcccttccaataccgtctgaatcgcggctttgcgctcggcaaacgaagcgacgactttgccttgctcgcgcatttgtgcggcgtagctgtcggcgttttcaatggtaatttcgccgtcggagaggaagcggtgtcccaaggttttgttgccgctttgcagacccaaaacgctgacgttcacaatgtcgccgccgtgcagtacaactagcccgtgaacggggcgcacaaaggtaaacgtgctgctgccccaacgcattactttgggaatcggcagcttcttaaccgcttgattgataatgtcttccaaaagtccgcccaacggtttgccgatttggacgtattcgtaggcgtacacgtcctgcttgccgtcgtggacgatggtcaagtcttcgattttcgcgcccgcaccgcgtgcgaaaccttccaaagccttggttggcgcaccgtctttcatggcattcgctacggcagggccttttttcacaattttttgatcagcctgaacggctttgacgtttttgacttgaaccgccaaacggcgcggcgaggcataagccgtaaattcggctgcgccgtcaaccagttgcgctttttccaagccttcggcaacggaagcggcgaaatggttgcccagattattcagggctttgggcgggagttcttcggtaaggagttcgattaaaagggtttgggtcatcattcggctttctttgaatttggttaatctgcctgtttataggtttcgctgtaattttcccagccgtcatccccataaaaaccgtcaaccagcggggtggcgtacaaagtggcaacatcttcgcggtctgccagccaagagataatggcttttttctcggtttctcccaagcttcgggcaccggatttttgaaacaggcacgaaaaatcgccgcaatcgcccccccgccatttcaaagccgtttgccgcaagatacgcaatcagctcgtccataaagcggtcgaacgcttcggcatcgtcctcagcttggtgcaaactgccttgaacgccgaaaatcaatgtttgaaactcgcccaaatgcagctttttatgctggcggcggttcattttgtgcaggcgtttcctgcttggggtgcggaaatagacaggcatgattttcctaaaaaatataatggcttccggacggctgccttatcgtgccgcccgaacgtaaaaaatcgtcgcccccttaggcggcgtttgccttcattaaagggaagcccagtttttcgcggctttcaacatatttttgcgccacggcgcggctcaatgcacgaatacgtccaatataagttgcccgctcagttacggaaatcgcgccgcgtgcgtctaaaaggttgaacgtatgccccgctttgaggacaagctcgtaggcaggcagggcgagggcggcgttttcttcggcaagcaggcgtttggcttgcgcttcgtagtcgttgaactggcgcagcagccagtcggcatcgctgtattcgaagttgtaggtggattgctcgacttcgttttggtggtacacgtcgccgtaggtgacggtgttgccgtcgagcgtttttgcccaaacgaggtcgtagacgttttctacaccttgcaagtacatcgccaagcgttcgatgccgtaggtgatttcgccgagtacgggcgtgcagtcgatgccgccgacttgttggaaataggtaaactgggttacttccatgccgttgagccagacttcccagcccaaaccccacgcgccgagggtggggttttcccagtcgtcttcgacaaagcggatgtcgtggactttgggatcgatgcccaattcgcgcagagagtcgagatagaggtcttggatattggcgggagcgggcttgagggcgacttggaattggtaatagtgttgcaggcggttggggttgtcgccgtagcggccgtctttggggcggcggctgggttggacgtaggcggcaaaccaaggctcggggccgagtgcgcgcaggcaggtggcgggatgggatgtgccggcaccgacttccatgtcgaagggttggatgacggtgcagcctttgtctgcccagaatgtttgcagtttgaagatgatttgttggaaggtaagcatggcttatgattcgataaaataaagggtttattttactgtttccattgctgtttggataggtttatctcaaagacagactgatttgaaaacacggcatacatgatatagtggattaaatttaaaccagtacagcgttgcctcgccttagctcaaagagaacgattctctaaggtgctcaagcaccaagtgaatcggttccgtactatttgtactgtctgcggcttcgtcgccttgtcctgatttttgttaatccgctatatgtttcggttaggcggcaggctgccctattgaataccttaaagcaggctatgcctgccaacgccatatccaaacacagtctttaatttaaatccggaaaataaaaagcacgaccaaacggtcgtgcttttccaaaccaaacaagtttatttcttgtgcgaacggatatagtccaaagttttgagctgtgcaatcgcagcagccaatactttatgcgcttccgccaaagccttatcgtctttagcttgggaaatgcccgcttctgcggcttttttcgcctcttccgcacgtgcccgatccatctccgcactgcggacggcaacatccgccaagacagttactttatcaggctgtacttccaaaacaccgccggaaacagcaaccaaaacctctttatcctcgcccggaacggtcaaacgcaaagcccccggccgcaccaaactcataatcggctcgtgtcgcggataaataccgagttcgccctgtacagtcggaacaacgataaatgttgcctcgcctgaatagattttctgctcgctacttaccacctcaacttgcatgatgctcatgccgacctccttagtttaaggttttcgctttctctactgcttcttcaatgctgccgaccatatagaatgcctgctcgggcagatgatcgtattcgccgttcaagatggctttgaagccggcaatggtatcgcgcagggcgacatatttacccggagaacctgtaaacacttcggcaacgtggaacggttgggacaggaagcgttggattttacgcgcacgcattacggtcagtttgtcttcatcagacaattcgtccatacccaagatggcgatgatgtcgcgcaattctttgtatttttgcagggtggactgcacaccgcgcgccacgtcgtagtgctcttgacccaataccatcggatccagttggcgcgaagtagaatcaagcggatcgactgccgggtaaatacccaaagaggcaatatcgcggctcaatacgacggttgcgtccaagtgggcgaacgttgttgccggagacgggtcggtcaagtcgtccgcaggtacatatacggcttggatggaagtaatagaaccggtttgggtagaggtaatacgctcctgcaaacgacccatttcttctgccaatgtcggttggtagcccactgcagacggcatacgacccaacaatgcggatacttcggtaccagccagggtgtaacggtagatgttgtccacgaagaacaatacgtcgcggcctttgccgttttcgtctttttcgtcacggaagtattccgccatggtcaaaccggtcaatgcgacgcgcaaacggttgcccggaggttcgttcatctgaccgtaaaccattgccactttatccaatacgttggaatctttcatctcgtggtagaagtcgttaccttcgcgggtacgctcacccacgcctgcgaacacggacaagccgctgtgcgctttggcgatgttgttgatcaattccatcatgttcacggttttacccacaccggcaccgccgaacagacctactttaccgcctttggcaaacggacacagcaagtcaatcactttaatgcccgtttcgagcaattcggttgtggaagacagttcgtcaaacttaggggcagcttggtggatggcacggctcttgtcggtatcgatcggacctgcttcgtcaacaggcgttcccaatacatcgacaatgcgtcccaacgtacctttacctaccggcacagtaatgggcgcaccggtattgctcacagtcatgccgcgtttcaaaccgtccgagctgcccatcgcaatggcacggactacgccgtcgcccaaaagctgttggacttccaaagtcagaccgttttcgtctaatttcaaagcgtcgtaaacgcgcggaatcatgtcgcgtggaaattccacgtcaacaaccgcaccgataatttgtacgattttgccttggctcattatcgtatcctaatttccgtacaggattcagacggcatcagacagccgccgcacctgctacaatttctgacaattccgtggtaatcgcagcttgacgcgatttgttatataccaaacgcaactctttgatggcattgcctgcattgtctgttgcagctttcatggcaaccatgcgggctgcctgttcggatgccatattgtcgctcaacgcctgataaaccacagactctaaatagcggcgaaccagatattccaacactgcaagtgcagtcggttcgtagcggtattcccagctgaacggtgatttgggagctgaatcgccaatcacgttctcaccgataggcagcaatacttccattctcggttcttgacgcatggtattgacaaaacccgaatacaccagatggattctgtcaatttcatgtttctcataccgttggaagagttctgtcaaaggtccgagcagcatttccatttttggggtatcgcccaaatttacggcactggcaaccacattcagaccaatgctctgacacgccatcagacctttactgccaaagcatacgatttcctcttcaataccttgattccgatactcttgaacttgtgccaaaaactttttcagcacgttggcgttcaaaccgccacacaaacccttatcagacgtaatcaaaataaaaccgacacgtctgatttcccgatgagattccagtaacggaataccatgatcggtattggtttgcgcaagatggctcatcaccatacgcactttttcggcatacggacgcgccaaacgcatccgttcctgagtcttccgcattttagaggttgacaccatctgcatcgctttagtgatcttttgggtattctgaacactgcggattttggtgagaatctcttttcctactgccatttcagactcctttcacttcaagccttatgcctgataggcgtaagaagatttgaaggatttcatggctgcttcaagcgttttctcgctctcgtcggacattgcacctgaagcattgacggcttccaaaacttccggatgttgggtacggacaaagctcaaaaattcagattcaaaagccagagctttggcaaccggaacatcagaatacgaaccgttgttgattgcccaaagggtcaaagccatttcagccgtattcaacgtactgaactgtttctgtttcatcagttcggttacgacttcgccatgctccaattgtttgcgcgtagcttcatccaaatcggatgcaaattgcgagaacgccgccaattcacgatattgtgccaacgccaaacggataccgccacccagctttttaatcactttggtttgtgcagcaccgcctacgcgggatacggaaataccggcattgattgcaggacggataccggcgttgaagaggtcggtttccaagaaaatctgaccgtcggtaatcgaaatgacgttagtcggaacgaaagcagatacgtcgcccgcttgggtttcgataatcggcaacgcggtcagagaaccggttttgccttttacttcgccgttggtcaatttctccacttcgtgttcattgacacgtgccgcacgttccaacagacgggagtgcaggtagaacacatcgccgggataggcttcgcggccgggcggacggcgcaaaagcagggaaatttgacggtaagccacagcctgtttggacaaatcgtcataaacaatcaaggcatcttcgccacgatcgcggaagaattcacccatcgtacaaccggagtaaggtgcgatatattgcaatgccgccgcttcagatgcagttgcagcaaccacgatggtatgctccatcgcgccatgctcttccaatttgcggaccacgttggcaatagaagatgctttttgaccgatagcgacatagatacagataacacccgtacctttttggttgacgatggcatccaatgctacggccgttttacctgtctgacggtcgccaataatcaactcacgctgaccgcgaccgacaggaaccatagagtcaatcgccttcagaccggtttgcatcggctggtcaaccgatttgcgcgcaatcacgcccggtgcgattttttcgataggggcggtcaaagttgtattaatcgggcctttgccgtcgataggccgacccaatgcatcaacgacgcgtccgaccagttcgcgtccgaccggcacttccaagatacgaccggtacaggtaaccgtgtcgccttctttaatgtgttcgtactcgcccaacactacggcgccgacggagtcgcgctccaggttcatcgccaagccgaaagtgttacccgggaattcgagcatctcaccttgcattgcatctgacaaaccatggatgcgaacgataccgtcagttaccgaaattaccgtaccacaggtacgcacttcggcatttacagacagattttcgatcttggctttaatcaaatcgctaatttcagcaggattaagctgcatgaaaactctcctaattcgtcatagtcgtgtacaaggcactcaatttgccttgtacagacaaatccaaaacctgatcacccacttcaacttttatgccgccaatcagctccggttcgatttcgacagagattttcagctcgctgtcgaaacgcttattcagcatttgcaccaactcgccgacctgtttgtcggtcaacggataggcactgtaaatgacggcagatttgatatggttgaatgataaggtcaagtcttgatattgagcatatacttccggcaatatcgacaaacgtttctgcccggccaagacgataacaaagtttttcaactccttgtctttcaaaccgaccaaatcgatgaggatatctgctttttctgaagcattcgtttcaggacggtcaatcaatgaagccaccttcccttcctgaacaaccgccgcaagtttttccagtccgcccaaccaagactcaatttggtttttttcctgagccagaccgaacaatgcctttgcataaggtctggcaatcgttgcgaactctgccataagattacagctcctgtttcagggtatcgagcagttttgcgtgtttggaagcatcgacttcgctgcgcaaaatagattcggcacctttgacagccaacacggcaacctgctcgcgcagggattcgcgtgcgcggaacaattcctgctccacatcggcctttgcctgagctgcaatgcgcgccgcctcggaagaagcctgttctttggcttcttcgacaattttggcggcacgtttttcggcgttggcaaccatttcggaaacctgattacgcccttctgccaagagttctgcaacctttttttcagcctgctcaaaatcgcttttaccacgctcggcggcagccaagccttcggcgacttttgcggcacgctcatccaaagcttttgcaatcggcggccacacgaatttcatggtaaaccataccaaaccgaaaaagacgatgatttgagcgaataatgttgcattgatattcacgttacttaaccttcgtactggggttaatcaaacaggctgcgcctgtacggaacggacgaatccgtcctgattatgcacctgcaaacgggttaacgaaggcgaacagcagtgcaatggcgacaccaatcaagaatgcggcatcaatcaaaccggcaatcaggaacagtttggtttgcagcggaccgatcagttcgggctgacgggcagaagactccaaatatttagaaccgaccattgcgataccgatagaggcacccaatgcacccaatgcaacgatcaaaccacatgcgatagcaatcaaacccattttaaactccttaaagaaacaaaggttaaactacaaaaacaaactacttaggaaaatcagtgcgcatcatgtgcctgtccgatatagacgaacgccaacgccatgaaaataaacgcctgcagggtaatcaccaaaatatggaaaatcgcccatgccaaaccggcaataatgtggaatacaaacagaatcggatccatgacttcgacgctgccggaagccgcccaagcaccgccaagcaaggctatcaacaagaataccaattcgcccgcatacatattgccgaacaaccgcataccgtgggatacggttttagaaagaaactcgaccaaattcaacagaaagttcgcaggtgcgagttttgcaccgaacggcgcgctgaacaactcgtgaaaccagccacccaatcctttgattttgatgttgtaatagatacaaatcagcaacacgccgacagcgagtgccaaagtggtgttcaaatcggcagtcggtacgacgcgcagcagggcgtgatggttgccggtaatgccctgccataccatcggcagcaaatcgaccggcagcatatccatcgcgttcatcagaaaaatccagacaaacagcgtcagacccaacggcgcgacggcttttctagacttttcgttgtgaatgatgctcttacacatatcgtccacaaactcaaacaagatttccactgcggcctggaaacgtccgggaacgcctgccgtcgctttttttgcaccgcgccacaacagaaagctgccgattacgcccaacaggacggcaaaaaagacggcatcaaggttaataaacgaaaaatcagcaatgtttttcagtccctgaccctgagtaacatccgacaaactggtcaagctctgcaagtggtgcttgatgtagtcggcagcggtaatggtttcacctgccataatctttcactctcaacaatactaaaaaaaccaaatggctgacaccgagcagccccatcagaaacggggcgaacaccagcgattgatgccatattgcaaatacggcaagcatggacaacagcgacagcactacttttaaaatctctccgaagacgaacatcctgctttgcaggaaggggtttcccctgaaaagttttaaaagtaaaactgcaacaaacgtgggaagcaggtaggacaaaccgccaccgaccgccgaaaggaatccggcaaaaccccatacagcaaaggcaactgcggcgcatatggacaatacggcggattgtaggatgataatctgcttcataaagggaatgtttccgcctcggatttggggcgcggctaatataatttagaagccttattacgtcaagcgacagttaatctttgtgaaacaacgtatcccaatccgccgcgctcgccgcctgaataacggcgacaggtgtcattctaacacacattacatataattacaggatattaaggagtttgtccgcaatttctttacatttttaatgttcttacgtgatttgtttgctttacgtggaaataataaaaaatcaacgcgaaattgtagcagtttatcggtcggattgtcggcagtttggggaatttgctcaataaataaaaggtcgtctgaaaatattttcagacgaccttttccgaataaaggattagcaactgcctgccgctttaagcaaagcattgcattgacttttgcctttgtgcgttccgcctcccaaacaaattgcatcggaagtggtaacgccgattgtgctgattacactggtaacatagcattggctcacgcgcttacccacagttgcggtaaagttgatgcgtatgccttcattgttgcggttgctgatttttacggcatttgggctgacgcccaaggcaaacgcggcacgttcctgaagtttctagtcggaaacggttacattattgattgagccgcaacctgctaatgccaacgcaacgaacgcagccgaaacgatgatgcgtgtgttcataatttcctcgaaaattaaaaatgaaaacaggaaaacgattcttacgtgaagcagaaaaaatgtcaatagaattatatttcccacttaaaatctggaaagctattctctatatttcagacggtatatcccgcaaaattaaggccggtaatctatgcccaactgctccagcaggtggccgaacgtttcaggcgtatcgaaatacaggacaatcctgccttttttgtggttggcggttttgacttcagcgttgacacccagtttttcagtcagcaaatcattcaggcggccgatgtcggcggcggcagtctttttgggctcgggacgtttgttttgaagggcggcctggctgcggcgttcgacttcgcgcaccgaccagccgtttttgacggccttttgcgccaattcgagctgttcgacgacgggcagggtcagcaatgcgcgggcgtgccccatttcgaggcggcgttggtaaagcatttcctgcacgggttcgggcaggcttaaaaggcgcaggctgttggaaatcgcgcttcggcttttaccgacggcttgggcgatggtttcgtgggtcagcccgaactcgtcggcaaggcgtttcaagccttgtgcttcttcgatggggttgaggttttcgcgctggaggttttcgatcaaacccattgccaatgcggtttcgtcgctgatggttttgataacggcggggatttcggtcaggccggcaatctgtgcggcgcgccaacggcgttcgcctgcaatcagttcgtatcgggacagtccgtgttcgcgcacgatgacgggctgtatcacgccttgcgccttaatcgaatctgccagttcctgcaaggcttcgtcatcgatttgaacacgcgcctgatagcggccgggccggatatctttaaccgcaaccgtggtcaatcggtcgccgctgctgttgtccgcgccgttggcgagcagcgaatccaagccgcgccccaatccgccttttacttttgccataccgccctcccgtgcctattcagataggatgttaaatcgggtattttatcggatattgggtgttgccgacaatttgtatccgcgtttatcggatttctgttttttcactataatagccggtttgccgttgcaggcggttttatgggaaaggcggatgatggtacggcgtttgataatcggcatcagcggggcgagcggtttccaatacggcgtgaaggctttggaacttttgcgcgcgcaagatgtcgaaacgcaccttgtggtatcgaaaggtgcggagatggcgcgcgcttcggaaacggcttatgcgagagacgaggtatatgccttggcggacttcgtgcatccgatcggcaatatcggggcgtgcattgccagcggtacgtttaaaacggatgggatgctggtcgccccctgttcgatgcggacgcttgcctctgtcgcgcacggcttcggcgacaatctgctgacgcgtgcggcggatgtggttttgaaggaaaggcggcggctggtgctgatggtgcgcgaaacgccgctgaaccttgcccatttggacaatatgaagcgggtaacggaaatgggcggcgtggtgtttccccctgttcctgcgatgtaccgcaaaccgcagacggcggacgacatagtggcgcacagtgttgcacacgctttgtcgctgttcggaatcgatacgccggattcggcggaatggcagggaatggcggattaaaggacaaaaatgccgtctgaacacggatacagttcagacggcatcattttatacgactgccttatttggctgcgccttcattccatgcggcaggggatttgtagccctcgaagcgtttgtgcgcgtaggctttgaacgcgtcggagttataggcctcggttacgtctttaagccattggctgtctttgtcggcggttttgacggcagaccagttgacataggcaaagctcggttcttggaacagggcttcggtcagcttcatgccgctgcttatggcgtagttgccgttgacgacggcaaaatccacgtcggcgcggctacgcggcagttgcgcggcttcaagctcgacgattttgatgtttttcaggttctcggcgatgtccgctttggatgcggtcaacggattgatgccgtctttgagtttgatccaacccagttcgtcgagcatcaccaagacgcgggcgaagttggacgggtcgttgggcgcggatacggtgctgccgtctttgacttcttccagcgatttcagcttgcccgggtacagtcccaaaggcgcggtcggcacttggaagacttcggtgatgtccagattgtgttcttttttgaagtcgtcaagatagggtttgtgttggaagacgttgatgtccaactcgccctcagccaatgccagattcgggcgtacatagtcggtaaactcgaccagtttgacggtgtagccttttttctccagctcggcttggatttgttctttgaccatatcgccgaagtcgccgacggtcgtgccgaagacgatttcttttttcgccgcgccgttgtcggcggcggcagaagcggatgcggcgggcgcgctgtctttttgaccgccgcaggcggcgaggatgagcgcgagtgcggcggcggaaagggttttgaagaaggttttcatattttctcctgatgttgtggcagtttcaaacaaaaatgacgggcagggagtcctgccgtccggattcggcgttcagacggcatttgccgcgaacagggggattttatagcatttttcggatagcggtgggggttttggcgttcagacggcattcgggttcaacgtttgtcgagtttccgcgccaacgcgttgccggtgctttgaatcaggatgaccagcagcacgaggagggcgacgatgaagatgatgacttcggtttggtagcggtagtagccgtagcggatggcgaggtcgcccaagccgccgccgcctatcatccctgccgccgcgctgtatgacaaaagcccgatggcaagcacggtaatgctggaaaccatgcccgcgcgcgcttcgttcaagaggactttgcagacgatggcaatcggcggcgcacccatcgcggcggcggcttcaattacgcctttggggacttcgcgcaggttttgttccaccagtcgggcaaaataaaacaatcccgacacgctcaacaccagcgaggcggcaaccggaccgatggtgctgccgacgatggcgcgtgtggcgggtatcatcgcaatcatcaggatgacgaaggggaaggcgcgcatgaggttgacgaggttgtcgagcaggaagttcaccagcttgttgtaatgcagttggcggctggaggttacgaagagcagcacgcccagcagcgtgccgaagatgacggcgaatgtggtggacaagccgaccatcacgaaggtttcgcccaaggcgcggaagatttcgtctttcatgccgacgatggtggaaacggcttgttggaatgttaagtctgccatatcagtcctcccgaatcagttcgcgcccgatgtcggattgggcgtggatttggttgccgcgtacttcgacgatttcgacgactttgcctttatccaagagggcggcgcggtcgcacaggcggcggatgacgctcatttcgtgggttacgatgacgatggttacgttgaagcgtttgttgatgtcttccaaacattccaagacgctgcgcgtggtggcggggtcgagggcggaagtgggttcgtctgcgaggatgacttggggtttgggcgcgagtgcgcgggcgatgccgacacgttgtttctgcccgccggaaagctgggcgggatagtggccggcgcgttcggtcaagccgacgatttcaaggcattctttaacgcgcgctttgattttttcagacggccatccggcgatttccaaaggaaaggcaacattgtcggcaacggtgcggttgctcaaaagattaaactgctgaaacaccatgccgatattctgccgagcctgacgcaatgcggcggcatcgagcgcggtcagctcttgtccgcagacgttgaccttgccgctgtcggggcgttccaacaggttaatcaggcgcaacagggtggatttgcctgcacccgaataacccatcagcccgaagatttcgccgtcgcggatttcgaggctggtcggctcgacggcggcaaaacgggtcttgtcgcgcgtttggtaatgcttggaaaccttgtccaaaataatcattgtctttcccatacaacaaagcccgatgtcggacacaacgggcgcggaagataaagctgaaattgtcggaacgctttagctgttatgcccgcaagctgtgtcaaatcggcaggttaattttcgtaggatattatcgggaaagcatttttttgtcaataaagcaggaagcgggcaaccatttcggacaatgccgtctgaaacgggcaaaggcagcggttcgcaccaaaacggcaaataattgaaaaacatatagtggattaacaaaaatcaggacaaggcgacgaagccgcagacagtacaaatagtacggaaccgattcacttggtgcttcagcaccttagagaatcgttctctttgagctaaggcgaggcaacgccgtactggtttttgttaatccactataaattatgtcggaaacattccaaaggcggtgcagtttcggcatataattcgggcaaacgcctgttcagacggcattttgtcttttccaaccctgaccgttcagggttccgattcttaaggaaatccgatgtacctaccctctatgaagcattccctgccgctgctggcggccctggtgcttgccgcgtgttcttcgacaaacacactgccagccggcaagaccccggcagacaatatagaaactgccgacctttcggcaagcgttcccacccgccctgccgaacccgaaagaaaaacgctggcagattacggcggctacccgtccgcactggatgcagtgaaacagaaaaacgatgccgccgtcgccgcctatttggaaaacgccggcgacagcgcgatggcggaaaatgtccgcaacgagtggctgaagtctttgggcgcacgcagacagtggacgctgtttgcacaggaatacgccaaactcgaaccggcagggcgcgcccaagaagtcgaatgctacgccgattcgagccgcaacgactatacgcgtgccgctgaactggtcaaaaatacgggcaaactgccttcgggctgcaccaaactgttggaacaggcagccgcatccggcttgttggacggcaacgacgcctggaggcgcgtgcgcggactgctggccggccgccaaaccacagacgcacgcaaccttgccgccgcattgggcagcccgtttgacggcggtacacaaggttcgcgcgaatatgccctgttgaacgtcatcggcaaagaagcacgcaaatcgccgaatgccgccgccctgctgtccgaaatggaaagcggtttaagcctcgaacaacgcagtttcgcgtggggcgtattggggcattatcagtcgcaaaacctcaatgtgcctgccgccttggactattacggcaaggttgccgaccgccgccaactgaccgacgaccaaatcgagtggtacgcccgcgccgccttgcgcgcccgacgttgggacgagctggcctccgttatctcgcatatgcccgaaaaactgcaaaaaagcccgacctggctctactggctggcacgcagccgcgccgcaacgggcaacacgcaagaggcggaaaaactttacaaacaggcggcagcgacgggcaggaatttttatgcggtgctggcaggggaagaattgggtcggaaaatcgatacgcgcaacaatgtgcccgatgccggcaaaaacagcgtccgccgcatggcggaagacggtgcagtcaaacgcgcactggtactgttccaaaacagccaatctgccggtgatgcaaaaatgcgccgtcaggctcaggcggaatggcgttttgccacacgcggctttgacgaagacaagctgctgaccgccgcgcaaaccgcgttcgaccacggtttttacgatatggcggtcaacagcgcggaacgcaccgaccgcaaactcaactacaccttgcgctatatttcgccgtttaaagacacggtaatccgccacgcgcaaaatgttaatgtcgatccggcttgggtttatgggctgattcgtcaggaaagccgcttcgttataggcgcgcaatcccgcgtaggcgcgcaggggctgatgcaggttatgcctgccaccgcgcgcgaaatcgccggcaaaatcggtatggatgccgcacaactttacaccgccgacggcaatatccgtatggggacgtggtatatggcggacaccaaacgccgcctgcaaaacaacgaagtcctcgccaccgcaggctataacgccggtcccggcagggcgcgccgatggcaggcggacacgcccctcgaaggcgcggtatatgccgaaaccatcccgttttccgaaacgcgcgactatgtcaaaaaagtgatggccaatgccgcctactacgccgccctcttcggcgcgccgcacatcccgctcaaacagcgtatgggcattgttcctgcacgctgacgtaccgatgccgtctgaaacccgcccggtctttcagacggcatttttatcccgaacggcattgacggcgaaccataaatataagacaatccgaaaattgtttttcctgctttttcaagcagcttgacacggcacaagccgacccgttaggaggtgatgtttccgtcacggcgcgtatcccgccgccgcaaggcacagcgatacggtaaactttcaacaccgtctgccctaccctttccaccgatatgatgggcagatgaaacaaccgaatttattaaaggaaataaaatgcctgcaatccgcgtaaaagagaatgaaccatttgaagtcgctatgcgccgtttcaaacgcgccgtagaaaaaaccggcctgctgaccgagctgcgcgcccgcgaagcctacgaaaaaccgactaccgaacgcaaacgcaaaaaagcggcagccgtaaaacgcctgcaaaaacgcctgcgcagccaacaactgccgcccaaaatgtactaaacgttcaagtacagattacaggtcagccctgtgatatgaggacacaccgcaagacctgctctgcggtgtgttttgcttttcagacggcatcgaaacccgccgtttccatccgacatcccagcgaggacatcatgagcctgaaaatccgccttaccgaagacatgaaaaccgcgatgcgcgccaaagaccaagtttccctcggcaccatccgcctcatcaacgccgccgtcaaacagtttgaagtggacgaacgcaccgaagccgacgatgccaaaatcaccgccatcctgaccaaaatggtcaaacagcgaaaagacagcgcgaaaatctacactgaagccggccgtcaggatttggcagacaaagaaaacgccgaaatcgaggtactgcaccgctaccttccccaaatgctttccgccggcgaaatccgtaccgaggtcgaagctgccgttgccgaaaccggcgcggcaggtatggcggatatgggtaaagtcatggggctgctgaaaacccgcctcgcaggtaaagccgacatgggcgaagtcaacaaaatcctgaaagccgtgctgaccgcctgattgcccgaatatcggacaaaatgccgtctgaagcccgtatcgcaggttcagacggcattttcaatatcccaatatcgaatcggcaggggcaacacggttttgatacgccgaaacgggttttgccgataaacagattccgtttgcgccccatcggacaaaatgccgtctgaaacacgattccgttcagacggcatagatttatttgaccaatttcaagccttttttggcgggtcggggcgcggtttcggcagaggtgttttcaggcggcgtatcggggcggtacgcttccaactcaaaccccataccttctccggtctcccgtgcgaaaaggctgaggacgtgtccgacaggtatccatatatcgtgcgcctgtccgccgaagcgggcggaaaagctgatccaatcgttgtcgatttgaaggttttgcgtggcggtcgcgccgatgttgagcataatttcgttgtcgcggacgtactgcatggggacgcgcgtgtgttcgttgacccagacaaggatgtgcggtgtgaggctgttgtcgctgcaccattcgcagagggcgcggaggatgtagggtttggtggaagtgggcataatgggttccgtgttgtacgccaaaataggaaaatgcctgcaaaacggtgggttttgcaagcatttcggacttatttgcgcatggctttttcggcgggtgtcagtgcttcgataaaggcttcgcgctggaagatgcgctcggcgtatttgagcagcggcgcggcacttttgcccagtttgacatcgtagtggtcgagccgccacagcagcggagcaagggcgacatcaatcatagaaaaatcttcgccgaggatgtatttgcttttgctgaacgaaggggcaagcatggtcagaccgttgccgatggcttcgcgcgcttttgcctgttccttgttggtggcggcggggttttctaacacttggacgtggttgaacaattctttttccatacggtacagcaccagccggccccgaccgcgcataacgggatcgccgggcatcagctgcggatgggggaagcgttcgtcaatgtattcgttgatgatattggactcgtgcagcaccaaatcgcgctcgaccagcacgggaacttggttatacggattcatgacggcgaggtcttcgggtttgttgtaaatatcgacgtctttgatttcaaaatccatacctttttcgtacaaaacgaagcggcagcggtggctgaaggggcaggtaatgccggaatagagggtcatcataataattgtcgctcctgtgtgatgcctgcaaaacggctgatttatagtggattaacaaaaaccagtacggcgttgcctcgccttagctcaaagagaacgattctctaaggtgctgaagcaccgagtgaatcggttccgtactatttgtactgtctgcggcttcgtcgccttgtcctgatttttgttaatccactatataaaggtttaatcgcgcaattatacgcgatttccggcacttaatccagaaattcggctcaatctgttgttttttatatattttccccgattttccgtatcagtgcgaacttactgtctttgttgcgcggacgcgcaccctgccaaaccgtctgccagccttgcggcgcatccgcattttggggcaggaggacgatgcggtagcggcattgtacatcgccgacgcggtgcggcaatgtgccgtactgcgtccaaacaatccgcgtgtgcaggtcgccgccgcctatgccgatacactcgatgccgtctgaaagctcccgtttcaattccggggaaagcgatgcctccatactccggacgaccggcgcgtggcttttcgccgcgtccagccacggcaggaacagcgtcatcagcaaagcccaggtcagggtaacgcctgccgcccagttggtaaccgcctgcctgccgcgtatgtttttccgggtaatcgcccacagccacaagggtgtgaacagtacggcaaccgccatcggaatgggatcgatatcaggaacataatacgggctgaaataggcggcgcgttcggcaagcttggcgggccagccgtaattcatggcgaaaaagcccgtccacaggaacacggcaaacagtccgaacgccataatgccgaaccagttgacaaacgccgccgcgccgcgcctcaggctgtccagttgcgccgcgccgaacagggcaagcggcggaagcagccagacgaggttatcctgaaaacgctgcggattgacggcaagcagcaccaaaacggcaagcatccagacgacgcccaaaatcccccagtcggtcgaaaacaggcgcgtgcggcaaaccgtccaaaccgccagcggcagcgcgggcaatgcaaaccaaagcaggtttttcagatagtaaaacaaactgaatgccgtctgaacgtgccgcacgccgccgaacgtaccgaaaacgtgatagtcgagccattgcgcgaacagcgcgggctgcgtttttgccaagagcagcgggtaaacggtcataagcggcagggcaaaggcaagtgaggcgactgccgtcaacatcaaacgcctgctttgccacggacggaaaaacatcagtacgggcaagggcagcatcagggcaaatgctgccggataagctgctgccaacgacatcagcgtccagcccgtaccgagcagaaaagaggcggcaatcacgcgccggcgagccaaagaataaccgtgcagcaccagtccggcggcggcaaaggcggcggcagcggggttgaggaaatgggcaactggaatcagcccgatacagccgatgagaatcaggacgacgctgcgcccgtggtgtctgcccaaaaagttgaaaccggcaaagccgcaggaagtcagtccgataacggcaaaaaatacgcctgcaaagcgtgcggcatcgtatgagtcggcagcccacggcgacagcaaatgtttgaacgcggcggcaacccaaagatacacgggcggtatgccgaaatcggtttgaccgaacagatgggcaaccaagggggtggggctgcctgccagtgcttcgacggcggtatagacggcaggttcgtcaggattccacaaatcgtgggaaaacacgccgggccacaaccaggcaaacgccatcaacagcagcagccacggcttttcgtgggttttggcgggcgggcgggcatcgggcggggtataggtcagcataagcgtgagaaaaaatggacggattgccaagtgtagcaaatattcgcacaaaggtcgtgcagagactgcttcagacggcatcagacacaaaaagaccggcaacaaaaaagactgcacatggcagtctttgcagatactatctttttcataatattttttcctagcccaacacagtccatagcatatcaaaactgttgttttcaaccaggatatatatccccaatcctaaataaacaacagcaacaaaccatctgctatatttttccaaagtttctccaacagaagggacttgtgctaatttttgggcagaaaaaaccaagagataaatcatgactagaaaggtaagtaaagccactatcaaattcgctaaatttaaggtagtaaaatatgggacaaagacaccaatattgtcagcaccacaacttgcaaaagtaatcatagcgactagaaaaatcaggtttttattatctttgcgcaaaccctctttggcaatagcctctccatcagaatctcctaaaagcaaaactttgatgcctaggagaattggaatcaagccgagcaaacctaaaatctctttactaggaatataatctaagacaaatgcaaaaagtaaacttagcaatatcagactaacagagcctagaaattgtcctaaatagatgttaatgatgtcttttctactttttcttttggcaaaaaataacattaggataataagtaagtctacggctgtcccagaatacaggattattgaagtaacgacattttgaatcataaaacatctcattcaaatatatttttaaatgtattcaaacattaaaccttgtagatgtcaacttcaaccccgtcaaaatatagtggattaacaaaaaccagtacggcgttgcctcgccttagctcaaagagaacgattctctaaggtgctgaagcaccaagtgaatcggttccgtactatttgtactgtctgcggcttcgtcgccttgtcctgatttttgttaatccactatatagataagaagtcagtgtgccaaatattaaaaagccctgccatcgaaatgatggcagggcttaattcttgcaaagcggcaatcagcgtttgaacaggttgccgaatttgttgttgaatttgtccacgcggccggtggtatcaacgattttttgggtgccggtatagaacgggtggcacagggagcaaacctcgatattgaagttttctttttccatcgcggatttggttgcgaatttgttgccgcaagagcaggtaacgttgacttcgtggtagttcgggtgaataccttgtttcatttgatttcctttcaaaaaagcgggcataggggatgtacctatgctacagacaagtccgacattctcgctattttctgttgttacgtcaagagtatattcgataaaatgtatagtggattaacaaaaaccagtacagcgttgcctcgccttgccgtactatctgtactgtctgcggcttcgttgccttgtcctaatttttgttaatccactataaaaagttcttttgagggaggtttgatgggatcaaaattctttttcctgctgctgcgttttgccggttcggggttgccgccgtcacatatgcgcggcatcggcatcgtcggcagacgggtgcgcggttttttggcgcggcgggtttctccgcatatcggacgcggggtcaatatcgaacgcggggcgtatgtgtttccggatacggttttgggcgacggctcgggcatcggggcaaactgtgaaatctgccgtgggctggtggtcggcaaaaatgtgatgatggagccggaatgtctgttttattcaaataaccacaagtttgaccgttcaaaaaacgctttgagggctacacggaaatccgtccgattacgttggaggacgatgtctggccggggcacagggtgattgtaatggcgggcgtaaccgtcggacgcggttcggtcgtgggcgcagcgcggtggttacaaaagacattccgccctactctttggcggcaggcaatccggcagtggtgaaaaagaatctgccggaaggttgaatgccgtctgaacgtgtcggggcggatgatctgaaaaaacaggaacatcgtttctgttttttgcgcttcagacggcatcgctattgcgccacgcggtatcgatttcttggtagagtttgccgaaatcgggttcgccgacgtaggttttgaggatttcgccttttttgccgataaggacggaagtcggataaacctgtgtgccgaacgcctgtccgacagctttgtccgcatcatacatgacggtaaacggcaaaccgtagtctttgacatattggcggacgctttctatcggatcgatgggctgggcgacggcaagtacttggaagtttttgtttttatagtcatttgccgttttaatgattttgggcatttcgctcacacaacccggacaggagggaaaccaaaaattaatcagggttactttgccttgcaggtcggcgttggaaacggtttttccgtgcaggtcgggcagggagaaggcgggcgcggttttgctgtcggggatgaggacgatggcaaggaggatgccgatcagtgcgacgacggcggcggtgagtatttttttcattcggacaaggcttccaatgcgcgggcaagggtggcgggcaggctgacggtgcgttgtgtggcggcgtggacgggcatcagggtgatgtcggcttctgcggcggttttgccgtttggcagtgtaatcgtctgggtcagcacaatacggcgcgtgccgggggttttcaggcggcatgaaaactgcaatacgtcgccttcgacggcggggcggctgtatcggatgtcgatgcgggcgacaatcagtatgaggcctgccaactcgtgcagcagtccgcgttcttcaaaaaacgcccagcgcgcttcttcgaaaaattcgaggtagcgcgcattgttgacatggccgtagccgtcgagatggtagttgcggacggtcagcttcatcagttcaggttgatgggttggaaggcttcgcgggcaagcggttcgtgttcgaggtcggtgatgacggtagaaagctggatgtcgaaccattcgttgaaaatgtcggcatcgagcgcaggccactcgcgttcgtcttcgcaccagtcggcaagttcggcggcgaaaatgtcttcaaaacgggcttcgatttcgtcccatacttcgtcggcggtttcgcacgggcggacaaggtaggaattggcgtcggcttggatgtcttcaagagtcagtccgtcgaggtggttgcccggcagggtttgcagccagttccaaaaaggttctaaagggatgaggacgaatacgctgcggttgacttcgtacatggtttttcctttgctgtcgcgcggtatgcgcaaaaaagagattatagcccaatctgtggtttcggactgtccgttccgacagaagggaatgccgtccgaacacggattttcagacggcatggctttaaggttgtgttccaggttgcgtttcggcttcccctgctgcttctgcctgtgtttcggatacggaatcttcttgaacggcagtttccgccgcgccggtttcggcactttcgaccaattcgtcgatgtcgatgttatcttccgtaccttcggcaggtgttgcaccggtctgccgcgcacggactttcatatagaggtcgcgcgtgtagctgtatttgtcgatggcggcttcgtccagactgtcggtcaaatcgagcaggccttcgcgcgtactgacggcggatacggcagtcgtgccccagcgtccgacaggggtgcggaagacgatattcttgggcgaataaacggaggtaatacccgtgccgagcgcgtcgcggacggtggacggccctaagacgggcaacacgaaataattgctgtttttccatccccacgaggcaaacgtgtcgcccaaggtgtttttattgtcgggaatgccgcccgcgccggcgatgtcgataagcccgcccaaaccgaaagtggtgttgatgccgacgcggacaaggtcttcgcttgcgcgtttgatgtccaagcgcaagatattgctgccgaagctgaccacgtcgcacaggttgttaaaaaaattggacacgccggcgcggacgggtttcggcgcaactttgcggtagccgcgcgcggcaggggcgaaaatgtagcggtcggcttggtcgttgaatttgaaaacggcgcggttgtagccttcataagggtcggcggggcgggtttcggcaaatgcaggggcggaagcgaacccgatcagcaggaggaaggcataggcggtttttttcatgatttcagccagtctttgatttcgtacagttcggacagcgcgcgcacggattcgggaatgccggtcagcctgacgctgcctttgcaaccgcgcagcacttcgagcagcagcgacacgcaggcggaatcggcgcgtccgacgccgctcaaatcaaccgcgcaggtgtctttcagacgacattgctgtctgaagcgggtaaaagcggcggcggtcagggttttgacggtgatgtcgccgccgatgtgcaatattccgtttttgagttctgtatgcatagcgtttgctcggaaaacccataccgccctcggacggtatggtttgtcggttatttgccgccgtttttggctttcaactcggcaatcagtccgtccacgcctttcgctttgataatttcgccgaattggttgcggtacacggtaaccaggctcgcgccttcgatggcgacgttgtaggtacggtatttaccgccgctttggtaggtggtgaagtccatgttgacgggtttttgcccgggtacgccgacttcggcgcggacgatgatttctttgccgcctttattgacgatgggattgtctttgacgttgacgttggcgttttttaatttcagcatcgtgccggaataggtgcggatcagcagggtttgaaattctttggccaacgcttgtttttgcgcgtcggacgcggtgcgccaagggttgccgaccgccaatgcggtcatacgttggaaatcgaaatagggaatcgcataggcttcggctttttggcgagcggtgttggcatcgccgttttttaagatgctcaatacttgagtggcgttttgacggatttggcttaccgcgtcggcaggggcggcaaatgccatgccgatgctcaaaataccgatgcccaatgcgctgatgagggaggattttttcatgattaagtgtcctagtttgaatatgatggcatacgtttattcggcggctttttccgcattgccgccgtcggcatttttctcggcaaaactcgtcatgaatttgccgataaggttttccagaaccattgcagaactggttacggagatggtgtcgccggcagcaaggttttccgtgtcgccgccctgctgcagcccgatgtactgctcgcccaaaagtcccgaagtcaggatttgcgcggaaacgtcgctgctgaactgatacttgccgtccaaatcgaggcgcaccctcgcctgataggatttcgggtcaagtccgatagcgccgacgcgcccgaccaatacgcctgcggatttgacgggggcattgaccttcaaaccgccgatgtcgccgaaatcggcataaacggcgtaagttttgtccgaaccgccgaacgccgcaccgccggccacgcggaaagcgagaaaggcaaccgccgccgcgccaatcaggacgaacagtccgacccaaaattccaatatgttctttttcattaaagttccttgaatatccgatgttccgcgtttcgtcttcagacggcctgtcaatctgtaaacatccacgcggtcaatataaaatcgaccgccaaaatcgtcagggcggacgaaaccaccgtgcgcgtgctggcgcgcaaaatgccttccgaagtcgggacgcaatggaagccctgatgcacggcaatcagcgttaccgccacgccgaacgcggcggatttgatcagaccgttgattacatcgtaatgtatcgtgatgttgttctgcatttgcgaccagaaaataccgctgtccaagcccagccaggttacaccaaccaaatacgcaccgaaaatgcccgccacgttgaaaatcgaagccaaaagcggcatggaaaacacgcccgcccaaaagcgcggcgcaaccacgcgggcgacagggtttaccgccatcacattcatcgcttcgagctgttcggtcgttttcatcagaccgatttcgctggtcatcgcaccgcccgcgctgctggcaaacaaaatcgctgccaataccggacccagctcgcgcaatagcgaagccgcgaccatatagcccaaaatatcggcggatttgaatttcgacaactgcgtatagccctgtaaacccaagaccatgccgacaaacagccccgaaacggcaacaatcaacaccgacagcacaccggcgaaatacacttggcgcacgctcaggcgcggacggacgaaagccgtaccggacttcgccagaatgttcagcagaaacagcgtgatactgccgagggattgaataaggccgagggttttcgccccgacggaacggataaagttcataaatttctatgtgtaaagttcaacggtttcagacggcatcaactcatttatcccaacaggtcctgctgcaacgacgtttgcgccggataacggtatgctacggggccgtctgccagcccgccgacaaactggcgcacccaaggcgaatccagttcgcgcatttcctgcggcgagccggagaacataatttcgccgtgcgccaagaaaatcacctgatcgacgatttccaaagatttttcaatgtcgtgcgttaccataatactggtcgaacgcaaagccttgttgacgcggctgatcaagtgggcaatcacgcccaaggaaatcggatcgaggccggtaaacggctcgtcgtacaacataatttcagggtcgagcgcaatcgtgcgggcaagcgcgacgcggcgcgacatcccgccggacaactcggacggcatcaggttttccacaccgcgcagaccgaccgcgttcaatttcaacaaaaccaaatcccgaatcaccgcttccggcaggcgcgtcagttcgcgcatcggaaaagcgatattgtcgaataccgacaaatcagtaaacagcgcgccgtgttggaacaatacgcccatacggcggcggtgttcatacaactcgtcagccgaaaagcccgccaaatcccgtccttcaatcaaaacctgcccggactgcggacgaatctgtcctgtaatcagtcgcatcagcgtggttttgccgctgcccgaaccgcccattacggcagcaaaattgccttgcggaatgctgaaattgatgttcttcagaatcgggcggtcgccatacgcgaaggcgacgtctttcatttcgataaagggggatgggctcatgtacggacggacggtaggtttgacggcgtgtattttaaggcttatcgggaagacgggcaattttcagacggcatacggacggtaaatgttgtgaaaatgccgttgtcggcggcggattgtttgctgtggcgaaaaatgttatctttcaaatgataacctttatcagaaaactatggaaaaagcagaacatttgaacagcagccggttcgtcaatctagtcaaaagcggcggcggcagctatgtggagggcagctaccgtttcgatactttgtccaacggcatttccatccacggcggcacagtaacggcacggtgtgatttttgcagcagccgcctcgccgaaccttatgtgtcgttcgtgctcttgctggaaggcagtttggacttcggcatcaaccgctgccgcttccaaatcgatgcggacggcggcaagattgtcctaattgctgtcggggaagaagtcctgttcagccgctatctttaccgaggcggcaaaacggtcaaaatgaccattaaaggtatggaacaatggctgctgcgtccggaatacgcgcgtttcgcacccctgctttaccgcgaaccggtcaggatatgggatttgcccccgaacctgcgcggcttggcggcatcctgcctgaaagccgtcccaaaggggcatttgggcgaaacattgcgccgcgaggcggacgtgttgcggctgctgtcggacttgtgggacacggtttcagacggcatcgggccggcggcggggcaaacggcggaagcagacgctatgccgtctgaagacttcagccgcaccctaaatgccgcgtttgccgacggcgcacaccaagtcaaccggctgacagacgcgctgaacatcagtgaaaggacgctgcaacgccgtatgcgcgaccatttcggcattacggcaagcgaatggctgcaccacaaacaaatgcagcacgcgctctatctgttgcaaaacgggggaaaaagcataggcgaaaccgcatatttatgcggctaccgccacgtttccagctttactcaggcattcaggcaatatttcggcagcacgcctgcggaaaccaaaaaagaaaaccggtaagccgcatttgatttcaaacccgaaatccgcgtgtatagtggattaacaaaaaccagtacggcgttgcctcgccttagctcaaagagaacgattctctaaagtgctcaagcaccaagtgaatcggttccgtactatttgtactgtctgcggcttcgtcgccttgtcctgatttttgttaatccactataaaaaacttgtacggcaatttatttgggaataaactaaaactacatctaactacaaaactggagaacccgaaatgaaacaattggccatgtacatcaacggacgctttgaaaacgatttcaacggcgaatggcgcgacgtattgaacccgtccaccgaagaggccatcgcccgcgaacccaaaggcggcaaggcggacgttgaccgcgccgtcgcggcggcgcgtgcggcgcaaccggcttgggagcgtctgcctgcggtcgaacgcggcgcgtatttgcgtaaaatcgcccaaggcatacgcgaacgtgccgacgagctgaccgacaccatcgttgccgaaggcggcaaaaccaaagacttggcacgcgtggaagtcatgttcaccgccgactatctcgattatcaggccgaatgggcgcgccgctacgaaggcgaaatcatccaaagcgaccgcccgcgcgaaaatattttattgttcaaacgtccgctgggcgtaattgccggcattttgccgtggaacttccccttcttcctgattgcccgcaaaatgggccccgctttggtaacgggcaacaccatcgtcgtcaaacccagcagcgtaaccccgatcaactgccacatcttcgccgaaatcgtcgatgcggtcggactgcccgcaggcgtgttcaacgtggtgaacggtcccggcgcggaaatcggcaatgccttgtccgcccatccgcaagtcgatatggtcagcctgaccggctccgtcgaagcaggccgccaagtgatggaagccgcctccgccaacatcaccaaagtttcgctggaactcggcggcaaagcgcctgccatcgttttgaaagatgcggatttggacttggcggtgaaatccatcttggcttcgcgcgtcggcaacaccggtcaaatctgcaactgcgccgagcgcgtctatgtccacagcagtctgaaagacgcattcattgaaaaaatgaccgccgcgatgaaaggcgtgcgctacggcaaccctgccgaagccgaagcaggcgcgctggaaatgggcccgctgattgaagaacgcgccgtcaaagccgttgccgaaaaagtggaacgggcagtcaaacaaggtgcgaaattggtttgcggcggcaaacgcgccgaaggacgcggttatttcttcgagccgaccctgctgaccgacaccgacaacagtatggacattatgaaagaagaaaccttcggccccgtgctgcccgtttccgctttcgacacgctcgaccaagtcatcgccttggcaaacgattgcgagtttggtctgaccagttctgtttatacgactaatttaaacgaagccttctacgttacccgccgcctgcaattcggcgaaacctacatcaaccgcgaaaactttgaagcgatgcagggtttccacgccggttggaaaaaatccggtatcggcggcgcggacggcaaacacggtttggaagaatatctgcaaacccaagtcgtttatttggaaaccgacatttaatgccgctttaaaaccccgatagaaaatgccgtctgaacccgttttcaggttcagacggcatttttattgcttcaccggcaatcagtcatgaccgaggtcgatgtttttgtctttgtatagtggattaacaaaaatcaggacaaggcggcgaagccgcagacagtacaaatagtacggaaccgattcactcggtgcttcagcaccttagagaatcgttctcttcgagctaaggcgaggcaacgctgtactggtttttgttaatccgctatattccgccatctctaagatttacagcgatacacgggtaatttaaggaatgcccaaaccgtcattcccgccacttttcgtcattcccgcgaaagcgggaatctagaatctcggactttcagataatctttgaatattgctgttgttctaaggtctagattcccgcctgcgcgggaatgacaaatccatccgcacggaaacctgcaccacgtcattcccacgaacccacatcccgtcattcccacggaagtgggaatctagaaataaaaagcaacaggcatttatcggaaataactgaaaccgaacagacctagattcccgcctgcgcgggaatgacggctgcagatgcccgacggtctttatagcggattaacaaaaatcaggacaaggcgacgaagccgcagacagtacagatagtacggaaccgattcacttgttaaagaatcgttctctttgagctaaggcgaggcaacgccgtactggtttttgttcatccactataactagggaaattcaaattaagttagaattatccctatgagaaaaagccgtctaagccggtataaacaaaataaactcattgagctatttgtcgaaagttcaaatttccattttaaaacaattagtaaaatcgagtttatcctagttgtccaagacaacccctataataatataattcaaaatataaaaatgggttacatctaaacattacggaatttttattccctcgcctgaattctattgtcagattcaaggagacctcatcatgcgaacgaccccaaccttccctacaaaaactttcaaaccgactgccatggcgttagctgttgcaacaacactttctgcctgcttaggcggcggcggaggcggcacttctgcgcccgacttcaatgcaggcggtaccggtatcggcagcaacagcagagcaacaacagcgaaatcagcagcagtatcttacgccggtatcaagaacgaaatgtgcaaagacagaagcatgctctgtgccggtcgggatgacgttgcggttacagacagggatgccaaaatcaatgccccccccccgaatctgcataccggagactttccaaacccaaatgacgcatacaagaatttgatcaacctcaaacctgcaattgaagcaggctatacaggacgcggggtagaggtaggtatcgtcgacacaggcgaatccgtcggcagcatatcctttcccgaactgtatggcagaaaagaacacggctataacgaaaattacaaaaactatacggcgtatatgcggaaggaagcgcctgaagacggaggcggtaaagacattgaagcttctttcgacgatgaggccgttatagagactgaagcaaagccgacggatatccgccacgtaaaagaaatcggacacatcgatttggtctcccatattattggcgggcgttccgtggacggcagacctgcaggcggtattgcgcccgatgcgacgctacacataatgaatacgaatgatgaaaccaagaacgaaatgatggttgcagccatccgcaatgcatgggtcaagctgggcgaacgtggcgtgcgcatcgtcaataacagttttggaacaacatcgagggcaggcactgccgaccttttccaaatagccaattcggaggagcagtaccgccaagcgttgctcgactattccggcggtgataaaacagacgagggtatccgcctgatgcaacagagcgattacggcaacctgtcctaccacatccgtaataaaaacatgcttttcatcttttcgacaggcaatgacgcacaagctcagcccaacacatatgccctattgccattttatgaaaaagacgctcaaaaaggcattatcacagtcgcaggcgtagaccgcagtggagaaaagttcaaacgggaaatgtatggagaaccgggtacagaaccgcttgagtatggctccaaccattgcggaattactgccatgtggtgcctgtcggcaccctatgaagcaagcgtccgtttcacccgtacaaacccgattcaaattgccggaacatccttttccgcacccatcgtaaccggcacggcggctctgctgctgcagaaatacccgtggatgagcaacgacaacctgcgtaccacgttgctgacgacggctcaggacatcggtgcagtcggcgtggacagcaagttcggctggggactgctggatgcgggtaaggccatgaacggacccgcgtcctttccgttcggcgactttaccgccgatacgaaaggtacatccgatattgcctactccttccgtaacgacatttcaggcacgggcggcctgatcaaaaaaggcggcagccaactgcaactgcacggcaacaacacctatacgggcaaaaccattatcgaaggcggttcgctggtgttgtacggcaacaacaaatcggatatgcgcgtcgaaaccaaaggtgcgctgatttataacggggcggcatccggcggcagcctgaacagcgacggcattgtctatctggcagataccgaccaatccggcgcaaacgaaaccgtacacatcaaaggcagtctgcagctggacggcaaaggtacgctgtacacacgtttgggcaaactgctgaaagtggacggtacggcgattatcggcggcaagctgtacatgtcggcacgcggcaagggggcaggctatctcaacagtaccggacgacgtgttcccttcctgagtgccgccaaaatcgggcaggattattctttcttcacaaacatcgaaaccgacggcggcctgctggcttccctcgacagcgtcgaaaaaacagcgggcagtgaaggcgacacgctgtcctattatgtccgtcgcggcaatgcggcacggactgcttcggcagcggcacattccgcgcccgccggtctgaaacacgccgtagaacagggcggcagcaatctggaaaacctgatggtcgaactggatgcctccgaatcatccgcaacacccgagacggttgaaactgcggcagccgaccgcacagatatgccgggcatccgcccctacggcgcaactttccgcgcagcggcagccgtacagcatgcgaatgccgccgacggtgtacgcatcttcaacagtctcgccgctaccgtctatgccgacagtaccgccgcccatgccgatatgcagggacgccgcctgaaagccgtatcggacgggttggaccacaacggcacgggtctgcgcgtcatcgcgcaaacccaacaggacggtggaacgtgggaacagggcggtgttgaaggcaaaatgcgcggcagtacccaaaccgtcggcattgccgcgaaaaccggcgaaaatacgacagcagccgccacactgggcatgggacgcagcacatggagcgaaaacagtgcaaatgcaaaaaccgacagcattagtctgtttgcaggcatacggcacgatgcgggcgatatcggctatctcaaaggcctgttctcctacggacgctacaaaaacagcatcagccgcagcaccggtgcggacgaacatgcggaaggcagcgtcaacggcacgctgatgcagctgggcgcactgggcggtgtcaacgttccgtttgccgcaacgggagatttgacggtcgaaggcggtctgcgctacgacctgctcaaacaggatgcattcgccgaaaaaggcagtgctttgggctggagcggcaacagcctcactgaaggcacgctggtcggactcgcgggtctgaagctgtcgcaacccttgagcgataaagccgtcctgtttgcaacggcgggcgtggaacgcgacctgaacggacgcgactacacggtaacgggcggctttaccggcgcgactgcagcaaccggcaagacgggggcacgcaatatgccgcacacccgtctggttgccggcctgggcgcggatgtcgaattcggcaacggctggaacggcttggcacgttacagctacgccggttccaaacagtacggcaaccacagcggacgagtcggcgtaggctaccggttctgacggacaggaagcagacagccgcaaagatcacggtctttgcggctgtttcttatgaaaagaaaaccctattccaattgcctgcttctattgtttcaagacttcttccaaagattcggcattaatcagatgtatagcggattaacaaaaatcaggacaaggcggcgaagccgcggacagtacaaatagtacggaaccgattcactcggtgcttcagcaccttagagaatcgttctctttgagctaaggcgaggcaacgccgtactggtttttgttaatccgctatattccaccatctctaagatttacagcgatacacgggtgatttaaggaatgcccgaaccgtcattcccgccactttccgtcattcccgcgaaagcgggaatctagaatctcggactttcagataatctttgaatattgctgttgttctaaggtctagattcccgcctgcgcgggaatgacgaatccatccgcacggaaacctgcaccacgtcattcccacgaacccacatcccgtcattcccacgaaagtgggaatctagaaatgaaaagcaacaggcatttatcggaaataactgaaaccgaacagactagattcccgcctgcgcgggaatgacggctgcagatgcccgacggtctttatagcggattaacaaaaatcaggacaaggcggcgaagacgcagacagtacagatagtacgaaaccgattcactcggtgcttcagcaccttagagaatcgttctcttcgagctaaggcgaggcaccgctgtactggtttttgttaatccactatacttggagctggtcttgcttttcgcctaattctacgttttcaaacggttgcagctggtggtctgccataaaggtctccttattgtatttcaggttggaaatcggaatttgttttcacaattttacaccttcgcccccgctttctctacataaaattacattttgccgatatttgccgaattgtctgaaaatatgtgtaataaggggcgtataatcaaaacatttgccccggattgccatgccttatttcgccctgtttgacgatgccgtaagcggccgcgcaaaacgctatcaaaatcatgtggaaagccgttttttccgtcccgaagaactcgatgctttggacggcgcgctgcaatcgggctggcaaaaagggctgcattcggtgttgtttgcagactacggattcggtttgccgctgacgggggttgagtccgaacgcggcggcaatcttgccctgcactggtttgccaactgcgccgacatcgatgccgaaagctggcttgcccgacactcagacggcctccccgccggcatttccacgccgcaaccctccgtatccgaaaccgattacctcgaccgcatccgccaaatccacgaagccatccggcgcggcgacacctatcaaatcaactacaccacccgcctgcacctgcaagcctacggcaatcccgtcagcctctaccgccgcctgcgccagcccgtcccctatgccgtcttgtcccacctgcccgatgcggaggggcaatccgcgtggacgctgtgtttctcgcccgaactcttcctcaaaatcggttcggacggcaccatcagcaccgaaccgatgaaaggcaccgcgccgattttgggcgacggacaagacgaacgccgcgccgccgagttgcaagcagacccgaaaaaccgcgccgaaaacgtgatgattgtcgatttgctgcgtaacgatctcggcaaaatcgcccaaaccggcacagtatgcgtacccgaaccgtttaaagtatcgcgtttcggcagcgtttggcagatgaccagcaccatccaagcccaagccttgccgcacacctcgttcgccgacatcctccgcgccgccttcccctgcggcagcatcaccggcgcgcccaaaaaaatgagtatgcagattatcgaatcgctcgaagccgaagcgcgcggactttatacgggcagcatcggctatttgaacccgtgttccggcggcttggggtttgaaggcacgttcaacgtcgttatccgcaccttgtcgctcacgccgctttcagacggcatttatcaaggcgtgtacggtgtcggttccggcatcgtcatcgacagcgaccccgccgccgaatatcgcgaatgcggctggaaagcccgtttcctcaacgaattgcgccccgacttcggcatttttgaaaccctgcgcgcggaaaacggacgctgcaccctgctcgaccgccacctatgccgtctgaaaacctccgcccaagccctcaacctgcccctgcccgacggctgcgaaaatcaaatcaaacaatacattgccgacttgcccgatggcgcgttccgcgtcaaagccctgctcgcttcagacggcatcagcctgtcccgcgccgttttaaaccgtctgaccgacaaacaacgcgtcatcatttcgcccgccgtcctgcccgcacaaaactacctgcgccgcttcaaaaccacctgccgcgccctcttcgaccaagcgtggcaaaccgccgaaacacaaggcgcgttcgacagcctgtttttcaattcagacggcatcctgctcgaaggcggcagaagcaacgtcttcatcaaacatcgcggacaatggctcacaccctctttagatttagacattttaaacggcataatgcgccaagccgtattggacgaaccgcaaaaatatttgcaaacaaatcaagtaatcgaaacacacatcacacaaaaaacactgcaagaagccgaagaaatccgcctctccaacgccttgcgcggcgtatttgccgccgcccttgcctgaacgcgcaaaaatgccgtccgaacctgtttccaaagttcggacggcattatcccaccattcaaaaccgccaatccgccgacacaaacacctcgctgttgcggcgtttcgcatacggcacattactttccgtcctgccgaaacgataattcaacgccggcacgatacctttgtacgacaacttgtcgtggctcaaagccagcgagacattccattcgcggttgcgttgcgcctctgtcgagaaagccgcaatgcccttatagttgcggcgggcataagacgcggaaacccgactgttcaaaccgcccaactgccgccactcctgcgcccaaccggcataaacaccgttgcgccggtaggcggcattattgaccgcgccgcccaccgtttcgcgtttcggcacaaaccgcacaaactgccagccgccgaacacagttgccgattcgcccaaacgttttgccgacgaaacataaaacccgtcctgcctgccgttattgtattccgccctatcctgttcgcggtagcgttggcggtaatgttccagcgcgaccgaaaattgccatcccgggtttgggcggtaagtatgggacagctgcacgccgactccgtgcgccagcatatacggcggcaggcggcggttgtttacccgttttgttttcgcatcaaagccgtcgctgcccgacaactgcacctgataaaacggcaaaatccccgccgtctgccgtgcatttttatactgccaacccaaatacgccctgccgaacccgtcatcataagctgattttttactgaaataatagctcgtgccgccgatattggaacggaacaacaaataatgattatctgccaacggcgtcagcttttccgcctcgatttcataattcaaccctgccgcccgctccgcccggctgacactgcatatctgccggcctccgttttgccggcaatattgcggcgcggcattattggcatttctattgaccgccggactgatgccgcccgaaaaacgccagcccgtcagcccctccgtttttttccgaaaacgccccacattttccaaaaccggtgccggcaaatccaattttgccgcctccgcaaaatgcctttctgccgacttcagccggaaatcgtcaaactccgccgccgccaaatccagcaaaatccgctcgtctgccgcattttccccgtgcagttcccgataccgcgccaccgcctccgccggccttcccgccaatttcgccagcaaagcccgcgccctgccgtacaaaaccgcgtcataatccggcagcttggcatacaaatccgccaacgaagcgattaaatccgcctgattgccgttgagcgcgtcgcgcaaactatgttccaacattttcggatgcgccaacaaaaaatccccgtcaaccacgcgcggggcatcattttcaactttccaatctgattccgcccacttatccgacaccgaccgctgcacctgcaacaatgccttgtcatccaaaatcgcgggcgcatccgccccataggcggcagaaacacctgccgcacaccaaacaaccaaaaagccgtatctgaaatacaacataccctgtcatttacctttctggcaaacacgccgccgaagcacgtcaaaccatccgaaaaacaggcagaaacccgtgaaaaccggctttgccgcctgaaagcaggcaaacaaaaaccgccgcccgattttcaaagggcggatttcacatttatagtggattaacaaaaatcaggacaaggcgacgaagccgcagacagtacaaatagtacggaaccgattcactcgtgcttaagcaccttagagaatcgttctctttgagctgaggcgaggcaacgccgtactggtttttgttaatccactataacagcaaccctgtcgccgtcattcccgcaaaagcgggaatgacgaagctatccgcacagaaacctgcaccacgtcattcccacgaaagtgggaatccagaacgtaaaatctgaagaaaccgttttatccgatacgtttccgcaccgacagacctagattcccgctttcgcgggaatgacggcggaaaggttgctgtttttccgataaattcctgccgctcttcgtttttgggatggcgggaaataaaacaaaagcgcgcgtatcaaaaaacaaaaatgcaaagaacggcgttggcaattttaaggtttgcgccttagccgcacttattcgcaaaaaaaaccgcacggcgttgaccgtgcggttttttatctgaaagcttcagacggcattgcttacatcatgccgcccataccacccatgccgcccatatcaggcacagccggtttgtcttcggggatttcagcgatcatgcaatcagtggtcagcatcaagccggcgatagatgcggcgtgttgcagcgcagaacgggttactttggcggggtcgagtacgcccatttcgatcatatcgccgtattcgccgctgccagcgttgtaaccgtagttgcctttgccttccaatactttgttcacaaccacgctgggttcgccgcctgcgttggcaacgatttggcgcagcggagactcaacggcgcgcaagacgatttgtacgcctgcgtcttggtcggcattgccggtgtgcaggttttccaaagcagcacgggcacgcaacagggctacgccgccgcctgcaaccacgccttcttcaacggctgcgcgggtagcgtgcagcgcgtcttccacgcggtcttttttctctttcatttcgacttcggtcgcggcaccgactttgatgactgccacgccgcctgccaatttagccacgcgctcttgcagtttttctttgtcgtaatcgctggttgcggtttcgatttgttggcggatttcggcaacacgcgcttcgatttgggctgcgtcgccaaagccgtcgatgatggtggtgttttctttaccgatttcgatgcgtttggcttgacccaagtcgtccaaagtcgctttttccaaagacagaccgacttcttcggaaatcaccacgccgccggtcaggatggcgatgtcttgcaacatcgctttgcggcggtcgccgaagccaggggctttgacggcaacggttttcaggatgcctcggatgttgttcacgaccaaagtcgccaaggcttcgccttctacgtcttcagcgataatcaacagcggacggctggcttttgccacttgttccaaaacaggcagcaggtcgcggatgttgctgatttttttgtcgaacaacaatacaaacggattgtccaaagcagcgatttgtttttccgcatcgttgatgaagtaaggagacaggtagccgcggtcgaactgcataccttcaactacgtccagctcgttttccaaagacttgccgtcttcaacggtaatcacgccttctttgccgactttttccatcgcttcggcgataatcgcgccgacttgttcgtcggagttggcggaaatagagccgacttgggcgatttctttagaagtgtcgcaaggtttggcgatgtttttcagttcgtcaaccaaagcggcgacggctttatcgataccgcgtttcaggtcggtcggattcatacctgcggtaacatatttcataccttcggcaacgatggattgcgccagtacggtggcggtagtcgtaccgtcgcctgccacgtcgttggttttggacgcaacttctttcaccatttgcgcgcccatattttcaaacttgtctttcagttcgatttctttggcgacggttacgccgtctttggtgatgtgcgggccgccgaatgcgcggtcaacgactacgttgcgacctttggggcccaaggttacgcggacggcgtttgccagaatgttcacgccgtttaccattttttgacggacttcattgccgaactgtacgtcttttgctgccatttcaattctccaaaaatcattaaaactgtctgataaaaccgtttatgccgtctgaaggcggtttgccgtttcagacggcatcgtgtccgtatttatttttcaacgatgccgaaaatatcttcttcgcgcattaccaacagctcttcgccgtcggcttttacggtttggccgctgtatttgccgaagatgattttgtcgccgactttgacatccagcggacggcggctgccgtctttaccgattttgcccgcgcccacggcgatgacttcgcccatatcgggtttttcggcggccgcacccggcaaaacgatgcccgatgcggttttttcttcagcttccaagcgtttgacgacaacgcggtcgtgtaaaggacggatggtcatatttatgctccgataaaatagtttgaaaacaatcatctgcccgaacggttcaggcagattgaagtggaaaccggacagccgtcaagcagctgcccgtataagtcggcaaaattagggtgtgtgcgggtaaattcaagtgaggcggaaaaaatttatttccgccgttttttatagtggactaaatttaaggggctgtactagattagcagatatgttaccctcgaaatatgaagataacgcactgcaaattaaagaaaaaagtacagaaagaactgctccgttttttgtactggaagttaccgcccgttctgccgccgatattttgggtatccatcccaattcggcagcactgttctaccgtaaaatccgcacggttatcaaccatcatttagccttggctgccgatgaggtttttgagggccctgtcgagccggacgaaagcgatttcggcggacggcgtaaaggtagacgtggtcgcggtgcagcaggaaaagtggttgtcttcggcattctgaaacgcaacggacgggtctataccgttgtggtggataatgccaagtctgaaacgttactccctgtcatcaagaagaaaatcatgccggacagtattgtttataccgatagtctgagcagctgcgacaagttggacgtgagcggtttcatttattaccgcatcaaccattccaaggaatttgcagaccgtcagaaccacattaacggcattgagaatttttggaatcaggcaaaacgtgtcttgcgaaaatacaatggaatcgatcgtaaatctttcccgctgttcttgaaagaatgcgaatttcgatttaacttcggcacaccgtctcaacagcttaaaatcctgcgggattggtgtgggatttagggctaatctagtacagcccctaaaatttttcgttttcaagccttcaccgcttgccatcagcgttaaatttttttacgataagcacatagattgtaaacaatcggccacaagccggtttgttttttcagaagacattatccctgtcagacgctatttctatatatttcgcctataatggcttgtttttaataaataattcaagaggtatcaacgtgtctgattccaagacgaaagaacgcgccacattcggcacgcgccgcgcgtttatgattgccgccatcgggtccgccgtcggcttgggcaatatttggcgtttcccctatattgcttttgaaaacggcggcggcgcgttcatcctgccctatctggtcgcgcttctgacggcgggcatcccgctgctgctgctcgattatgccatcggccaccgttaccgtggttctgcgcccttggctttccgccgcctcggacgatggtttgagccggtcggctggtggaacgtgatgaccaatatcgtcatctgcatctattacgcggtaattatcggttgggcggcaagctatacctattattcggtcaacgccgcctggggtgcggatccgcagggttttttctttaaggacttcctgcaaatggcgggcccggaagccttgggtttggattttgtcggcaaagtcgccggtcctttggcgggcgtgtgggtttttaccgccgccattatggcgttgggcgtgcaaaagggcgtggcgcgcgcctcgtcgttctttatgccgctgcttttggtgatgtttttgattatggtcggcatttcactaaccctgccgggtgcggcaaagggcttggacgcattgtttacgcccgactggtcgaaactcgccgattccaaggtctgggtggcggcatacgggcagattttcttttcgctttccatctgcttcggcattatggttacctattcttcttatttgaagaaaaaaaccgacttgggcggaacggggctggtggtcggttttgccaacagcagctttgaactgctcgcgggcatcggcgtgtttgccgcattgggctttatggcgcaggcgggcggtaaggcggtcaacgaggttgcctcaggcggcatcggtttggcgtttatcgcctttccgaccattatcaaccaggcaccgatgggctggctgatcggcatattgtttttcggttcgctggtgttcgccggcgttacgtcgatgatttccatccttgaagtgattgtggcggcgattcaggacaagctgaacatcgggcgcgtcaacgccacgctgctggtctgcattccgatgggcattgtttccacgctgctgttcggtacggcgacggggctgccggttttggacgtgatggacaaattcgtcaacacctacggcattgttgccgccggctttgtttatgttgccgccatcatcatcagcggcaggctgccggaattacgcaagcacctgaacgctttgtcctccatccgcatcggcggcttgtggacggtctgcgtcgtggttaccgtcgtgatgctcggctatatgctgtttaaagataccagcggcctgatggagaaaaattacgaaggttatccggatggtttcctcagtattttcggctgggggatgtcggcggcgttggtcgtgttcgggctgctgctgtcgttgctgccttggaaacacggtcaggatttcaacgtcaaagacgaacacgaacatgaacaaggagaagaaaaatgagtacttccgccattgtgatgatgattgtctcaatcgtgataatctggggagggctgctgctttccctgttaaggctgccgaacgagtaagcctttagagcgttaaaaatgccgtctgaaccgcttcagacggcattttgatgttcggcttgcaggcaggcgagttcgtttgccatttgctgttccaaggtttcgcgccggcggatgagtcggtattcgttgccgtccaccaacacctctgccgcacggttgcgcgcgttgtaattgctcgccatactggccccgtatgcgcccgcgctgcggataagcagcaaatccccttcttcgcaggcgatggtgcggtctttgccgaggaagtcgccggtttcgcaaatcggaccgacgatgttggcggtcagcgtcgcgatgtctttggtttcgaccgcctcgatgtgatgataggcatcataaagcgccgggcgcatcaaatcgttcatcgccgcatcgaccatcacaaagtttttctcttcgccgtatttgacaaactcgacgcgtgtcagcagcgaacctgcgttgccgaccaggctgcggccgggctcaagaatgagtttcagacggcgtgtgccgatcagtttttgaacggcttgggcatacgcgcccaaatcaggcacattttcgtcttggtaaacaatgccgacgccgccgcctaagtctaaatgttccaaaacaatgccttcggcggcaagcgcgtcaaccaaaatcaaaatgcgctcgcaggcttcgaccagcgggcttaagtcggtcagttgcgaaccgatgtggcagtcgatgccgatgattttcaaattgggctgttgtgcggcatagtggtaggcttcgagcgcgtcggcgtaggcgatgccgaatttgttggctttcagacctgtggagatgtagggatgggtttttgcatcgacatcggggttgatgcgcagggagacgggcgcggttttacccaaacgtgcggcaactttctgaatacggtcgatttcggggatgctttccatattgaagcatttcacgcctgcattcagcgcgaactcgatttccgcctcgcttttgcctacgcctgaaaatatggtttttgccgcgtcgccgcctgccgccaaaacgcgtgccaattcgccgccggacacaatgtcaaaaccgctgcccagcgaggcgaagtgtttgataatgctcagattgccgtttgccttgacggcgtaacagacgagcgggttcaaagcggcaaacgcggtttggtagtgttcaaatgcttcggtcagcgcggattggctgtacacataaagcggtgtgccgaatgcttcagcaaggcgggggtaggggacttgttcgcaaaatagggtcatgttttcgttttcatttttgggtttgtggagcggattgcggtttgctttgaagttgcaaaccggtttggattacgccgaaacgcgccttgtcgccttctttgggcaggtagaggtcgcctttgtaaccgcaggccgagagcaggagggcggttgccgccgcaaaaaatacgccgtatttcatcggtaaacttccttcataagcgcgaatgtggcaagattcggcatcttaaacaaaaaacacgcaaaaagctatgatgaccgaaagcgagtttatccgcgcgagcgaagcattatttgaacacatcgaagaccaaatcgacgaaaacggctgggatttcgactgccggtttgccggaaacgtcctgaccatcgaagccggagacggcgcccaaatcatcgtcaaccgccacacgcccaatcaggaattgtggattgccgcaaaaagcggcggctaccatttcgccgagcaaaacggcaaatggctggcaacgcgcgacggacgcgatttttatgacgttttaaacgaagccctgagcgcggcttcgggcgaagcggtggaaattgcggaattgtgatttgggtgttatcacggaaagaaaaaatgaacacacgtcccttttatttcggactgatatttatcgcgattatcgctatacttgctaactatttaggaaacactgatttttcccatcattatcatatcagtgctttaattattgctatcttgctgggaatggcaatcggcaataccatttatccgcaattttcgacacaagtggaaaaaggcgttttgtttgccaaaggcgcgcttcttcgcactggcattgtgttgtatggttttcgcctcacttttggcgatattgccgatgtaggattaaatgcggttgtcactgatgcaatcatgctaatttcaaccttcttttttaccgcacttttaggcattcgttatctaaaaatggataaacaattggtttatctcactggggcaggttgcagcatttgcggtgcggcagcagtgatggcggcagagcctgttactaaagcagaatcccataaagtttcagtggcgattgccgtagtggtcattttcgggacgcttgctatttttacttaccccttgttctacacgtggtcacaacatttaattaacgcccatcaattcggtatttatgttggttctagtgtacacgaagtggctcaagtgtatgcgattggggaaaatattgatcctatcgtggcgaatactgccgtcatttccaaaatgatccgagtgatgatgctcgccccctttttattaatgctttcttggttattaacacgtagtaatggagtatcagaaaatacatcacacaaaattacaattccttggtttgctgtactttttattggtgttgccatttttaattcttttgatttattaccaaaagaactcgtgaaattattcgttgaaatcgattctttcttattaatttcatcaatggctgcgcttggcttaacgacgcaagcaagcgcaatcaaaaaggcaggattaaaaccgtttgttttaggaatactaacttatttatggctagtggttggtggatttttagtgaactatggaatatcaaaattaatataaaattcactaaagagagcgttacccaatggcacaattaccgctatatctgacttctgaaatcaaagactttactgtcggcacgcctaaagttttagaatcattttccaaacatatcccttatggtgtcgtctttgaagacgacggcgacacaggctacttctatgccgcttcgcaagacgggattttagatgccttgcacatctataatgtcgaagatgtatccgacaaacatatccccaatcatgtcttgattttatgggatgatgcctgcaccatagccgcattgtgtatcaacgactacattcatgccgtctatgattttgtcgaacaggcaggatattgccgcaacggcttccctgaagcaggcggcgaatgggtgaaagtcgaaaaccgcgtcttggatgatgaattgctggacaaaatcctatcccgaaaatctacataaccctcacaaaaggatacccaaatgcccctactagacagtttcaaagtcgatcacacccgtatgcatgcccccgccgtacgcgtggcgaaaaccatgactacgcccaaaggcgacaccattaccgtgtttgacctgcgcttttgcgttcccaacaaagaaatcctgcctggaaaaggcatacacacgctggagcatttgttcgcaggttttatgcgcgaccacttgaacggcaacggcgtggaaatcatcgacatttccccgatgggctgccgcaccggtttttatatgagtcttatcggcacgccttccgaacagcaggtcgccgatgcgtggctggcttcgatgcaggatgttttgaatgtcaaagaccaaagcaaaatccccgagttgaacgaataccaatgcggcacttatcaaatgcactcgctcgccgaagcgcagcaaatcgcgcaaaacgtgttggcgcgcaaagtggcggtgaacaaaaatgaagagctgacgctggatgaagggctgctgaacgcctaatccgccaaaaatgccgtctgaacaagggtttcagacggcatttgccttttccgttataatccggggttgtccgggggcgggttttaagccggcatcgtccttccctatttttttctgtcccttatcggttttaagcgggttttttatgtccaacagacctacactcctcctcgttgacggatcgtcctacctctaccgtgcgtatcacgcgatggggcaaaacctgaccgcccccgacggcgcgccgacgggtgcgctgtatggtgtattgaatatgttgcgccgtttgcggtcggaatatccgcacgattattgcgcggtggtttttgatgcgaaaggcaaaaatttccgccatcaaatgtttgaagaatacaaggcgacgcgcccgccgatgcccgacgatttgcgcccgcaggcggaagcactgccggatttagtgcgcctgacaggctggccggtattggtgattgggcaggtggaggcggacgatgtgatcggcacgctggcgaaacagggggcggaacatggtttgcgagtcattgtttcgaccggcgataaggacatggcgcagttggtggatgagcgcgttacgctggtgaacacgatgagcagcgaaacgctggacattgaaggcgtgaaggcaaaattcggcgtgcgccccgaccaaatccgcgattatctcgcgctgatgggcgacaaggtggacaacgtgccgggcgtggaaaaatgcggcccgaaaacggcggtgaaatggctggaagcctacggttcgctggctggtgtgatggaacacgcttcggaaatcaagggcaaagtgggcgaaaacctgcaagccgcgctgccccaactgccgctgtcgtatgatttggtcacgattaaaaccgatgtggacttgcacgccgagctttcagacggcatcgaaagcctgcgccgtactacgccgaaatgggcgcagctggttgtcgatttcaaacgctggggcttccgcacctggctgaaagaagcggaatcaaacatgaataccggctcgaccgatgatttgttcggcagcgacagcatcggcgagcaggcggctttgaatgcggaaatgccgtttgaaaaacaagccgaaaaagccaccgcccccgaaaaactggattatcaagccgttaccaccgaagcgcagtttgccgctttgttggacaaactgtcgcgggcggacacaatcggcatcgatacggaaaccacgtcattagacgcgatgaacgcctcgctggtcggcatcagcatcgctttccaagcaggcgaagcggtttacatccccgtaggacacagcctgaccgccgcgcctgaacagcttgatttacaagacgtattaggccgtctgaaaccgcatttgggaaaccccgccctaaaaaaaatcgggcaaaacctcaaatacgaccaacacgttttcgccaactacggcatcgccctgaacggcattgccggcgacgccatgctcgcttcctacatcatcgagagccatctcggacacggcttggacgaattgtccgaacgctggctcggcttggaaaccattacctacgaatcgctgtgcggcaaaggcgcgaagcaaatcggttttgccgatgtcgccatcgggcaggcgaccgaatacgccgcccaagacgccgatttcgccctgcgcctcgaagcgcacctgcgcgcgcaaatggacgaaaaacagcttgaaatgtatgaaaaaatggagctgcccgtcgcgcaggtattgtttgaaatggaacgcaacggcgtgcaaatcgaccgcgccgaactcgcccgccaaagcgcggaactcggcgccgagctgatgaagctcgaacaggaagcctatgccgccgcaggccagccgttcaacctcaattcgcccaaacagctgcaagaaatcctgttcgacaaaatgggcatccccaccaaaggcctgaaaaaaaccgccaaaggcggcatttccaccaacgaagccgtgctcgaacagctcgcgcccgactaccccctgcctaaaatcatcctgcaaaaccgcagcctggcgaagctcaaatccacctacaccgacaaactacccgaaatgatttcccccaaggacggccgcgtgcataccacctacgcccaagccgtcgccattaccggccgcctcgccagcaacaaccccaacctgcaaaatatccccatccgtaccgaagaagggcgtaaagtccgccgcgcctttaccgcaccgcaaggcagcgtcatcgtttccgccgactattcccaaatcgagctgcgcattatggcgcacctctccggcgacaaaaccctgattgccgcgttccaaaacggcgaagacgtacaccgccgcaccgccgccgaagtgttcggcactgcgcccgaaaacgtctcgtccgagcaacgccgctatgccaaaagcatcaacttcggcttaatttacggtatggggcaatacggtttggcaaaatcattgggcatcgacaacctttccgccaaaaactttatcgaccgctacttcgcccgctaccccggcgtcgccgaatacatgcagcgcaccaaagaacaagccgccgcccaaggctacgtcgaaaccctgttcggcagaaggctctacctgcccgacatccgcaacaaaaacgccaacgcccgcgccggagccgaacgcgctgccatcaacgcccccatgcagggcaccgcctccgacctcatcaaacgcgccatgatagacgtgtcccgctggctttcagagtgcgaagcctccccgtgggacgaactcttacaaagcaaactgattatgcaggtgcatgacgaactggtgctggaagtcgttgaaaccgaactggattttgtcaaagaaaaactgccgcagattatggcgaaagtggacggcggattattggatgtaccgctggtggctgaggttggcgtaggggagaattgggaagaggcacattgattgaaaggtgttatatgctatctttatttaaataaaatttaatttttggtatattttttctaaatgttcctatagtatagtggattaacaaaaatcaggacaaggcgacgaagccgcagacagtacaaatagtacggaaccgattcacttggtgcttcagcaccttagagaatcgttctctttgagctaaggcgagacaacgctgtactggtttttgttaatccgctatattccgccatctctaagatttacagcgatacacgggtgatttaaggaatgcccgaaccgtcattcccgcaacttttcgtcattcccacgaaagtgggaatctagaaataaaaagcagcaggaatttatcggaaataactgaaaccgaacagactagattcccacctgcgtgggaatgacaattcgagacctttgcaataacataggttactaaaattttatgctcaatctcattttcaaaatgcaaaacttttctgatttttcctactttttgctcaatattaggaaggttttaggcaattgaaaattttttggcgcatttttatgcgtcaaatttcgttaacagactatttttgcaaaggtctcaattcataagtttcccgaaattccaacataaccgaaacctgacaataaccgtagcaactgaaccgtcattcccgcgcaggcgggaatctagaccttagaacaacagcaatattcaaagattatctgaaagtccgagattctagattcccgctttcgcgggaatgacgaaaagcaagccgtaggtcggatacttgtatccgacaaaagcctgccatctcaaatagccgtcggattcgagaatccgacctgccaaaccgggcgcggacgctccggccggcagttagtacgcaaatcgaacagaacatcacaaaaaagcccgattcggattttccaatcgggcttttttgcgcccgttttgtcatcccgtgaaatatccgcatgacaaaaatatagtgaattaacaaaaatcaggacaaggcgacgaagccgcagacagtacagatagtacggtaaggcgaggcaacgctgtactggtttaaatttaattcactataatgcaaaatcatgacaaaaccggcgcgaggttacacaaacggatgaaatcaaccgatattcaaacacagtcatttttagcgcattttcagcgtatcgttaatgcggaaaatttcgtgaacaggttttttgcacaggcctccgcctcgtttcgcgggatgggaaaccgtattagaaaacggacgcacgcaacataaaccccgaaagtgatgataagatgatgatttaacgtactgctttaattatttaaggaattatcgtgtttcccgacaaatacaagttgagtttgaaagaaaatatttttttggcaaagaaagtattggttgcccaaattcacaacctcagtcgttttgagaattgtcagacgaccttgttgcagaccgaacaaattatccatggcaaaaatgtagcctccgcgtcactggaagacatccaaaccatcttgaacctgaaacgtgcctatcaatatgtgatttcgcatatttcaaacggcgaaccggtcgatatttcactccttaaaaaaatcaacaacattgttgccaaggacgattctttggcacccggtgatttccgtaccggttcggtcggcgtaacgctattggacggttcccgtcatgccccgaatccagtgaaggaaattgaagtggcccgcgtgttacaaaatatcggactgcaaagcggttcgacgacggaggcagccgtccgttttatgctttattgtatgcggcagcaggttttttgggacggcaacaaacgaacggcaaccttatttgccaacggtctgatgatggcggggggctgcggcatcttggaaatctccgaaatgcagatgccgcaattcaatgaaaaactgtccgcattctatcgctccggcgacgataccgatatttccaagtttgtgtatcaaaattgtatatcgggcatagactgagacctttgcaaaattccccaaaaccccttaaattcccaccaagacatttaggggattttccatgagcaccttcttccagcaaaccgcccaagccatgattgccagacacatcgaccgtttcccgctattgaagttggaccaggtgattgattggcagccgatcgagcagtacctgaaccgtcaaaaaacccgttaccttagagaccaccgcggccgtcccgcctatcccctgctgtccatgttcaaagccgtcctgctcggacaatggcacagcctctccgatcccgaactcgaacacagcctcattacccgcatcgatttcaacctgttttgccgttttgacgaactgagcatccccgattacagcaccttatgccgctaccgcaaccggctggcgcaagacgacaccctgtccgaactgttggaactgattaaccgccaactgaccgaaaaaggcttaaaagtagagaaagcatccgccgccgtcgttgacgccaccattattcagaccgtcggcagcaaacagcgccaggctatagaagtcgatgaggaaggacaaatcaacggccaaaccacaccgagtaaggacagcgatgcccgttggataaagaaaaacggcctctacaaactcggttacaaacaacatacccgtaccgatgcggaaggctatatcgagaaactgcacattacccccgccaatgcccatgagtgcaaacacctgccgcctttgttggaaggactgcccaaaggtcgaccgtctatgccgacaaaggctacgacagtgcggaaaaccggcaacatctggaagaacatcagttgcaggacggcattatgcgcaaagcctgccgcaaccgtccgctgacggaaacgcaaaccaaacgcaaccggtatttgtcgaagacccgttatagtggattaaatttaaatcaggacaaggcgacgaagccgcagacagtacaaatagtacggcaaggcgaggcaacgccgtactggtttaaatttaatccactatatgtggtcgaacagagcttcggtacgctgcaccgtaaattccgctacgctcgggcagcctatttcggactgattaaagtgagtgcgcaaagccatctgaaggcgatgtgtttgaaccttttgaaagcggccaacaggctaagtgcgcccgctgccgcctaaaaagcagcccggatgcctgattatcgggtgtccgtggaggattaagggggtatttgggtagaattaggaggtatttggggcgaaaatagacgaaaacctgtgtttgggtttcggctgtcgggagggaaaggaattttgcaaaggtctcagactatttcggcacggacgaagatatagatttccccgacccaccaaacatgggctaaaaatcaatttgacggttatcagacaatggagcaggcacaaggcggcggcagaaaaagggtttgacagcgcacggtggcatcgtcagacccctttcggcatatccggcggttaccagcggtagcctaatttgatgcccgcgctgtgttgcgcttccagttgcgggcctttggcggcggcagcgtggagggacagcgtgaaacctttgatttcggcgtttacgccccattccgcactgcgggttttgccgaaatcctgagccaatacggcggtattgacgcgtgttcggactttgcccgaagcggcatcggtataggacaggctcaaataaggcgtgatggaaatgtgttgcgccggtttgaatgaataatctgccttaatgcccgcgcggtagcggttgaatgcaaggccgggggtggcgatattgacgttttcgtagcggtaatccgctttttggacgaaatagcgcgttgcgccgatgtgcggttcgatgccgaatccgccgaaaccggcgcggtatcgtgcctgaatgccgtaatgcagcacgcggcggcggattttgcctccgatgccgtctgaaaggctgccgctgctaaaacccgcgcccgcgctgatgccgatgtagaacctgtcgatgccgtattgcccgaaaacggcgccgtgggcaagccgtgccgagttgccgatgccgtcgtcgaaggtgttttcggtccggttgtgcgaaaacaggatgccgacgcgcccgctgccgaggtttttctgcataccgatttggcgcaggtcggtttgttggcggtaggcgcggaaatcttgcgaacggtagtgtttggtgtcccggatgccgcttgtccaaacggcgttgcggcggtcttcggcaaatacgcggtctaattcgtcctgtacggcgaaaacgctgttgagcgtggcggaaaattcactcaaaccgctattggcataacggctgatcaggtcgcgctgcggttggggctgcggttggggttgcagttgcggcaaatcccggcgggcgcggcgggcgcgggggaaggcggtggtagccggccgggtttccgcttcgcgctgtttcgccaaggcggtgtctttatccgcctgcacccgttttttctcttcctccgcctgcataatgccgacattttccccgcctgcctgccgggccggttcggcaacgctttctgtcttttcgacggcatcgcgcccggccgcaatcagcgcgtcaaggctttgcgcgttgtctttttccgcctgttttttggcttctgccttgccgagtttgtcggaaagctcttgttctttgaccggattatgcaggcggaactcgccgtctttgcggatgagttggtaacgccacgcgccggcatcgacgtgttcgttttgcagggtgaaattaaggttttcggacagcggtttgttgtcttttccttccactaccgtcaattgttcgaggcttgcaggttcgttgccggtattgttgaccgccaaggtgtaagtgccttcggaactttccgccagcttcaatttgtcgctgcggtagccgaagagttccgacataaagcggaatgttccctgaccgttcaatttgccgtttaccgtcagcgtgttgaaacgggattctaccgaagttggcggtgtaacggataatagggaacggcgcgaacggcgcgaacggcggcgcggcgcatctgtcgcactgccggtttgcgcccctgccgcatcgtggcgataggcggaattgagtgtaatggtggcgttgtcaaggtttaaattgcctaattccgtgcctgacggcagcgtccattcgctgtcttttaagtgtaatgccgtatccttgccgccgctgatttgtccggtaaagcggctgctttcaaaatggaatactgccttatcggctagggagacattaccgttgagtgcggaatggcttacgtttgccttagcgttgccggaaagcgtcagactgccgttttgtacggcgtggtcgcttagattaaatgaagcattgcccgaagccgatgtgttgccgtttaatgtggcttgattaaatgttgcttgggcattgcccacgaggctaaggttgccgttttgggtggcgttgtggctgactgtataacgtgtatcgccatttgcactaagattgccgttgagtgtggcaagccctgtgagatttaaatgagcgtgatcggcaagatcgacattgccgctgatgtcggtcttagtcaatgaagcaatcactttatcgtcggtaatggttttttcgacacaatttgtcagacccgtccagtccgaacgtgtacagattgtgtggctttgatgcggtgcgacaccaaaaactgcttgggcgtgattgctcaaatgccaatcgcctttcactttggcaacattgcgggaaaccaccgcctgtccgcctttaatttggaagttttccgctttaaatgtgcggttgatccagtcgttgtcccacacgatttccccgcgaggaatgccctctttttgcgaccaatggtcgtttaaatgattgtaggcgtgcggtgttggtctgccgctgaaaaacagtttgccgtttgtttgcgtgatgttgccgtttaaatttgttccgccggaaagcagcagggtgcggtcttctgcggcgggctggtaaacaaggttgagccgcccgttcgttttggtcgtatctttctcgccaaaccaaccgttgtaggcaatttcttttttgctatccaagctgttgttattgccggttgtagcaatatctttattgcctgtaatggtaacggtggattctttgtcttgattgtggttgacaatcatcgccccttcatcggtattttgaatacggtggaacgaaagcgaatgcccgtttaaatccaaacgtccgccgcgaaagccgaaatagagtttgtcggggttgaactgattatcggcattcagttgcaccgtacccctgccgctgaccaagccgatttcactaaaggcttgttttttgcctttatcgtctgcctgctgatccaaaatgactgtaccgtcgcccacgctgatcgagccttggttttcccctttggcttgaacgtgcagcgtgcctttgccgattttggacaggcggtcgtttgccacgccgtttactttccaagtaacggtactgtcttcactgatatgaacgcccgcgccttgccaagtttcgttattttcaggcgagaccgtaaaatctccttggaaatataatcctccagcaccttgattgatgttgctggtaagtatcaattcgccttttccttcgtcaataaaggaaatattttctccattattcagtctgggtcgataactgttgacaccacctgcagcatgataaacaggttctcttgctgtctcggataaagaaacattaaacaattgaacggttcgtgtttttaatctattaggcagagaattgtgttcatgtttggcattgatttttcctgtgccattattatcgtcgttaaaagagtatttcccattttgacgtggttcgtagaatactgaatgggtatctccagcaaagatttcatcatagaaccaatctttacgaaccagctggaagccattgctttttcctatataggggttgcccgtttgcaataccccattaattaaccacttttgcttttgggcatcatagataaacattggtgagccactgtcgccaaatgagcctcctgttggtaaaaaaccatatgggctatgtttaattttttcactacctaagttgactgtgccaccacctgatccattttgtgcaaaggtattgccaccaacgagccaagaatacgcacttgcaatatgatatgaactttcgcggttattgggctcatcttcatcagatcgccaatattgcctgcctgccccaatacgaacacggtcagggtaattattttgatcgatatatttccgcccatccatataactggtcatttcaacaggttctgcatctgtgacaaatttatgcaaacgcggcatatgataatcgccgccataaggatggcctttagtccctgctttataattattccgtttcacaattttataagtaaaacgatgttgatcgggatttcttccttccgcaccaaaatcaacgttgttatagccgccgttatgtgccacgctcacaatatattgatcgcccaccaatgccgccacgccgttacgcgacaccacagaaaaatcaatcatcggggcttttgtcattgatttgccgaccaactccccttttttgttgtaaacctcaatatctttcgccccgactgcaaacttgcctttattttcggcaaagtcgcgatagtattggtagttgatgccgaaataagtgtgtcccgcccaggcttggggaagaatgccgaacgacaggcatatggctaagtaagcaggcgagaagcggatgcggccggttttcggggctttgcggtgtgtttcggttgtccgtttgtcggttgttttcattatttttccttatctgacgggattcgggtttgtttgggagggcgcggcttccgcttccgggcggcgcgcgggatgtgcctatatgtgcggttcggcgttcgggcggatatgaagcacgccctaggatttgtcattaatttttgccttggtctcggcttcttccaatcacgaaagcacccgccaaggcaaacactgtgccgccggcaagggaggcggcggttgcggggtagccgctccatacgaggaagacggcaaaaagcagtatcaggatggcgctgatgaagccgtacagttgcccgcgcctgttgaaggtttggtcttgccgtatggtttcgtgccggacggcttgttctttttccgccattgccataatgcggtctgccccgttgctgataatgtcgttgtattgcgccaagtcggacggcggcggcaacggtcccgaatggaaacaccgggctatcattatttgcacgtactcgtcggacaggatttgctcgacaagctccggggatttgacgacggtttcgacagcctgccgcgccttgtcctgtgcgttttcggtcattttcgcgctttctctatggcgcgttgaaaatcgccgccgatgtttttgagatcgtcggcgggattggggcggatggcggtttttgcgggatggaacagacccagcagcgagcctataccgagcaggagggcgtatgtgtttcgttttttcatatggttatatattaggtcaggcggacggatttatcaagcatttttgcggttttataccgtctgaaagccaaaccgtcggacttcagacggcatttgctataatcgcggctgttttgaattttcgggggttttatgtcggataacgttccaacgattgcggcagtcgctaccgcaccagggcgcggcggcgtgggcgtgatacgcatatcggggaaaaacctgctgccgatggcgcaggctttgtgcgggaaaacgcccaagccgcgtaccgcaacctatgctgattttacggacacggacggacaggcaatcgacagcgggcttttgctgttttttgccgcaccggcaagttttacgggtgaagatgtcatcgagcttcagggacacggcgggccggtggtgatggatatgctgctgaaccgctgtttggaattgggcgcgcgccttgccgaaccgggcgagtttacgaagcgtgcgtttttgaacgacaaactggacttggcacaggcggaaggcgtggcggatttgattgacgcatccagccgttcggcggcgcgtctggctttgcgctcgctcaagggcgatttttcgcggcggatacacggtctggtcgaagacttgattaccttgcggatgctggtcgaagcgacgttagattttcccgaggaagacattgattttctcgaagcggcagacgcacgcggcaaactggacggcttgcgccgcgccgtggatgatgtgcttgccaacgcgcagcagggcgcgattttgcgcgaaggtctgaatgtcgtattggtcggcgcgccgaatgtgggcaagtccagcctgctgaacgcgttggcgggcgacgaagtggcgattgttaccgatattgccggaacgacgcgcgacgcggtcagggaacgtatcctgattgacggcgtgccggtgcatattgtcgatacggcaggtttgcgcgagacggacgacgtggtcgagcgtatcggcatcgaacgcagccgcaaagccgtatccgaagccgatgtcgcgctggtgttggtcgatccgcgcgagggtttgaatgaaaagacacgggcgattttggacgcgttgccgccggagttgaaacgcatcgaaatccacagcaaatccgatttgcacgcacacgcggcaggcgggttcggtacgggcgcggaaaccgtcatcgcgttgtcggcgaaaaccggcgacggcttggacgcgctgaaacggacgttgttgcgcgaggccggttggcagggcgaaagcgaagggttgtttttggcgcggacgcggcacgtcaacgcactcaaagcagcgcaggaagaattgtcgctggcggcattgtgcggcaaccatcaaatcgagctgtttgccgaacacttgcgcttggcgcaggtcgcatgcggcgaaatcacgggcgagtttacggcggacgacctgctcggcgtgattttttcgaggttttgtatcggaaaataaacggatcgaaagcatcgtggtggtgtccggctgaacattccgttatcccataaaaacgggaatccgatccgtttggttttatagtggattaacaaaaatcaggacaaggcgacgaagccgcagacagtacaaatagtacggaaccgattcacttggtgcttgagcaccttagagaatcgttctctttgagctaaggcgaggcaacgccgtactggtttttgttaatccactatagtttttttgaatttcgggcaacgcttgaatcttcattccgcgcaggcggaaattatcggtgcggtacggcaacttttttcgatatgaaaagaccgtcattcctgtaaaaacaaaaaatcaaaaacagaaaattgaaattcgtcattcccgcgcaggcgggaatccaggacgtaaaatctatagtggattaacaaaaaccagtacagcgttgccttgacttagctcgaagagaacgattctctaaggtgctgaagcaccgagtgagtcggttccgtactatccgtactgtctgcggcttcgtcgccttgtcctgatttttgttaatccactataaagaaaccgtttttctcgataagtttccgtgccgacagacctggattcccactttcgtgggaatgacggtggaaaagttgccgtgatttcggataaattttcgtaacgcataatttccgttttacccgataaatgcccgcaatctcaaatcccgtcattccccaaaaacaaaaaatcaaaaacagaaatatcgtcattcccgcgcaggcgggaatctagaccttagaacaacagcaatattcaaagattatctgaaagtccgggattctagattcccactttcgtgggaatgacgaattttaggtttctgtttttggttttctgtccttgcgggaatgatgaaattttaagttttaggaatttatcggaaaaaacagaaaccgctccgccgtcattcccgcacaggcttcgtcattcccgcgcaggcttcgtcattcccgcatttgttaatccactatattcccgccgtttttttacatttccgacaaaacctgtcaacaaaaaacaacacttcgcaaataaaaacgataatcagctttgcaaaaatccccccccccctgttaatataaataaaaataattattaattatttttcttatcctgccaaatcttaacggtttggatttacttcccttcatactcaagaggacgattgaatgaataccccattgttccgtctcagcctgctctcgcttaccctggcggcaggttttgcccatgcggcagaaaataatgccaaggtcgtactggataccgttaccgtaaaaggcgaccgccaaggcagcaaaatccgtaccaacatcgttacgctgcaacaaaaagacgaaagcaccgcaaccgatatgcgcgaactcttaaaagaagagccctccatcgatttcggcggcggcaacggcacgtcccaattcctgacgctgcgcggcatgggtcaaaactctgtcgacatcaaggtggacaacgcctattccgacagccaaatcctttaccaccaaggcagatttattgtcgatcccgctttggttaaagtcgtttccgtacaaaaaggcgcgggttccgcctctgccggtatcggcgcgaccaacggcgcgatcatcaccaaaaccgtcgatgcccaagacctgctcaaaggcttggataaaaactggggcgtgcgcctcaacagcggctttgccagcaacgaaggcgtaagctacggcgcaagcgtattcgggaaagagggcaacttcgacggcttgttctcttacaaccgcaacaatgaaaaagattacgaagcaggtaaaggcttccgtaataatttcaacggcggcaaaaccgtaccgtacagcgcgctggacaaacgcagctacctcgccaaaatcggaacaagcttcggcgacggcgaccaccgcatcgtattgagccatatgaaagaccagcaccggggcatccgtaccgtccgtgaagaatttaccgtcggcggcgataaagagcgaataagtatggaacgccaagcccctgcttaccgcgaaaccacacaatccaacaccaatttggcgtacacgggtaaaaacctgggctttgtcgaaaaactggatgccaacgcctatgtgttggaaaaagaacgctattccgccgatgacagcggcaccggttacgcaggcaatgtaaaaggccccaaccatacccaaatcaccactcggggtatgaacttcaacttcgacagccgccttgccgaacaaaccctgctgaaatacggtatcaactaccgccatcaggaaatcaaaccgcaagcgtttttgaattcacaatttaaaattgaagataaagaaaaagcaactgatgaagagaaaaataagaaccgtgaaaatgaaaaaattgccaaagcctaccgtctgaccaacccgaccaaaaccgataccggcgcgtatatcgaagccattcacgagattgacggctttaccctgaccggcgggctgcgttacgaccgcttcaaggtgaaaacccacgacggcaaaaccgtttcaagcaacaaccttaacccgagtttcggcgtgatttggcagccgcacgaacactggagcttcagcgcgagccacaactacgccagccgcagcccgcgcctgtatgacgcgctgcaaacccacggcaaacgcggcatcatctcgattgccgacggcacgaaagccgaacgcgcgcgcaataccgaaatcggcttcaactacaacgacggcacgtttgccgcaaacggcagctacttctggcagaccatcaaagacgcgcttgccaatccgcaaaaccgccacgactctgtcgccgtccgtgaagccgtcaatgccggttacatcaaaaaccacggttacgaattgggcgcgtcctaccgcaccggcggcctgactgccaaagtcggcgtaagccacagcaaaccgcgcttttacgatacgcacaaagacaagctgttgagcgcgaatcctgaatttggcgcacaagtcggccgcacttggacggcttcccttgcctaccgcttccaaaacccgaatctggaaatcggctggcgcggccgttatgttcaaaaagccgtgggttcgatattggtggcaggtcaaaaagaccgcaacggcaaattggaaaacgttgtacgcaaaggtttcggtgtgaacgatgtcttcgccaactggaaaccgctgggcaaagacacgctcaatgttaatctttcggttaacaacgtgttcaacacgttctactatccgcacagccaacgatggaccaataccctgccgggcgtgggacgtgatgtacgcttgggcgtgaactacaagttctaaaacgcacatcccgaaaaaatgccgtctgaaagcctttcagacggcatctgttctgataatttgatatatagtggattaacaaaaaccagtacggcgttgcctcgccttagctcaaagagaacgattctctaaggtgctgaagcaccaagtgaatcggttccgtactatttgtactgtctgcggcttcgtcgccttgtcctgatttttgttaatccactataaagaccgtcgggcatctgcagccgtcattcccgcgcaggcgggaatctagaccttagaacaacagcaatattcaaagattatctgaaagtccgagattctagattcccgctttcgcgggaatgacgaaaggttgcgggaatgacgaaaagtggtgggaatgacgaaaagtgatgggaatgacgaaaagtgatgggaatgacggttcgggcattccttaaattacccgtgtatcgctgtaaatcttagagatggcggaatatagcggattaacaaaaaccagtacggcgttgcctcgccttagctcaaagagaacgattctctaaggtgctgaagcaccaagtgaatcagttccgtactatttgtactgtctgcggcttcgtcgccttgtcctgatttttgttaatccactatagattatcatttatcctttctaaagccgttccggtttgtccgaccggcggctttgccccaatatccccattttggagacacctatgttacgtttgactgctttagccgtatgcaccgccctcgctttgggcgcgtgttcgccgcaaaattccgactctgccccacaagccaaagaacaggcggtttccgccgcacaaaccgaaggcgcgtccgttaccgtcaaaaccgcgcgcggcgacgttcaaataccgcaaaaccccgaacgcatcgccgtttacgatttgggtatgctcgacaccttgagcaaactgggcgtgaaaaccggtttgtccgtcgataaaaaccgcctgccgtatttagaggaatatttcaaaacgacaaaacctgccggcactttgttcgagccggattacgaaacgctcaacgcttacaaaccgcagctcatcatcatcggcagccgcgccgccaaggcgtttgacaaattgaacgaaatcgcgccgaccatcgaaatgaccgccgataccgccaacctcaaagaaagtgccaaagagcgcatcgacgcgctggcgcaaatcttcggcaaacaggcggaagccgacaagctgaaggcggaaatcgacgcgtcttttgaagccgcgaaaactgccgcacaaggtaagggcaaaggtttggtgattttggtcaacggcggcaagatgtcggctttcggcccgtcttcacgcttgggcggctggctgcacaaagacatcggcgttcccgctgtcgatgaatcaattaaagaaggcagccacggtcagcctatcagctttgaatacctgaaagagaaaaatcccgactggctgtttgtccttgaccgaagcgcggccatcggcgaagagggtcaggcggcgaaagacgtgttggataatccgctggttgccgaaacaaccgcttggaaaaaaggacaggtcgtgtacctcgttcctgaaacttatttggcagccggtggcgcgcaagagctgctgaatgcaagcaaacaggttgccgacgcttttaacgcggcaaaataatgaaacggcggcattcgatgccgtctgaaacacggatgcaaaccgcctcctgtgtttcagacggcattgcccgatacggaggcttcaaacaaggctttccgctccgacggttcggactgccttgtttgaatcttctacgccttaacgcttttcccttctgtttatgactgccaaacctttttccctcaacctgaccaacctgctgctgctggcggtgttgtttgccgtcagcctgtcggtgggcgttgccgatttccgctggtctgatgtgttttcactgtccgacagccagcaggtcatgttcatcagccgcctgccgcgcacgtttgcgattgtgctgacgggcgcgtcgatggcggtggccggcatgattatgcagattttgatgcgcaaccgttttgtcgaaccgtcgatggtgggcgcaagccaaagcgcggctttaggtttgctgctgatgaccctgctgctgccggccgcgccgctgccggcgaaaatgtcggttgccgccgttgccgcgctgatcgggatgttggtctttatgctgctgatccgccgcctgccgccgaccgcgcaactgatggtgcctttggtcgggattattttcggcggtgtgattgaggcggtagccacctttatcgcgtatgaaaacgaaatgctgcaaatgctcggcgtgtggcagcagggcgatttttcgagcgtgctgctggggcggtacgagctgctttggattacgggcggtttggcggtgtttgcctatctgattgccgaccggctgacgattttggggctgggcgaaacggtaagcgtgaatttgggtttgaaccggacggcggtgttgtggtcgggtttgattattgtggctttgattacgtcgctggttatcgttacggtcggcaatattccgtttatcgggctggtcgtgccgaacatcatcagccgcctgatgggcgacaggttgcgccaaagcctgcctgcggtggccttgctgggcgcatctttggtgttgctgtgcgacattatcggacgcgtgattgtgtttccgtttgaaattccggtctctacggtttttggtgtattgggtacggctttgtttttgtggcttttgttgaggaaacccgcctatgccgtctgaaaaaaatatcggttttatggcaggaagcagccgcccgttgtgggtcgcctttgcgctgttgctggtttcctgcgtcctgtttatgacgctcaacgtcaaaggcgattgggattttgttttgcaactgcggctgaccaaacttgccgcgctgctgatggtcgcctatgcggtcggcgtgtccacgcaactcttccaaacgctgaccaataatccgattctgaccccttcaattttgggtttcgattcgctgtatgtgtttttgcagaccttgctggtgtttacgttcggcggcgtgggctatgcttccctgccgttgacgggcaaattcggctttgaactggtcgtcatgatgggcggctcgctgctgctgttctacacgctcatcaaacagggcggacgcgatttgtcgcgcatgattttaatcggcgtgattttcgggattttgttccgcagcctgtcgtcgctgctttcgcgcatgatcgatcccgaagaatttaccgccgcgcaggcgaatatgtttgccggattcaataccgtccacagcgagcttttgggcataggcgcgctgattctgctcgtcagcgcggcggtcgtttggcgcgaacgctaccgcttggacgtttaccttttggggcgtgaccaagccgtcaatttgggcatcagctacacgcgcaacaccttatggatactgctttggattgccgcattggtggcgacggcgaccgccgtggtcggccccgtaagctttttcgggcttctcgccgcctcgcttgccaaccacttttccccgtcggtcaaacattccgtccgcctgccgatgacggtttgtatcggcggcatcctcttggtcggcggacagaccgtgttcgaacacctgctcggtatgcaggcagtgttgagcgtagtagtagaatttgccggcggactcgttttcctctatctcgttttaaaacacaaaaaatgacggatgccgtctgaacggccgccgccccgaaaggacaaaccatatgacacaagaacatttcccatcattcttcaaccaagccccgaccattaccgtccaagacgcattggccgaattcctcggcgcggccgaaaacggcatcctcacttaccgctacgccgatgccgtgcgcctgtgcggacattcctgcccgaccgtcgcgggcgcgtacctgatggttatcaaaggtctgaaagcactttacggcgaagagctgcccgaacgcggcggcatcgaagcctttatgcagggcgcgcgcgacgaaggcacggtcggcgtaaccgcgtccgtcgtccaactcctcaccggcgcagcccccgaaaccggctttggcggcatcggaatgcagggacgctttgcccgccgccacctcttatcctttggtgtaggcgaaatcaacggcacactgaccctgcgccgcaaagacaacggcaaaaccgtcgccgtcggcctcaacgccgccctgcaacccttcgcacccgaaatgcgcgacatcatgcccaaagccgtcagcggcagcgcaagcgcagaagaactcgaacgcttcggacaactctggcaggcacgcgttaaagcatttttaaccgaatcggcggacgacccgcagttcgtcatcgtccgcgaagtgtgagcgttcagacggcattccgaatttcaaatgccgtctgaaccccgccaaacaacaacaaacctacgcccgacaagcatccgccatgattaccatccgcaacgtcagctaccgcatcggcacacgccccatcctcgacaacgtcagcctcgacatccccgaaggcggcattaccgccctcgtcggccccaacggtgcgggcaaatccaccctgttttcctttatggcgcggctgcgaccgcttgaaagcggcagcatcgcctaccgaggcaaaaatcttgccgatacccccaccgccgaactcgccaaaaccctgtccatcctcacccaagaaaacagcatcatgagccgcatcaccgtgcgcgacctgctgatgttcggccgttacccctaccatcaaggcagaccgactgccgaatgccgccgtatcgttaacggtgcaatcgaagaattccacctgcaagacctctccgaccgctacctgaccgagctttccggcggccaacgccaacgcgccatgattgcgatggtgttctgccaaagcaccgactacgtccttttggacgaaccgctgaacaacctcgatatgtatcacgcccgctcgctcatgcaaatcctgcgccggctgaccgacgaacacaagcgcaccaccgtcgtcgtattgcacgacatcaaccaggcagcagcctacgccgaccacgtcgtcgccatgaaaaacggccaagtcgccatgcagggcaaacccaacgatattttcaccgccgcaaacatcaaaaccctattcgatatggacgtcgacgtcctcgattacgaaggcaaaaaattggttatccaccatatctaaatccgacaaaaaggccgtctgaacattcagacggcaacccatatcctgacaaaattaagacacgacaccggcagaattgacatcagcataatatgcacatattaacagatattaatgccgaactacctaactgcaagaattaaataaataaataaataaataaataaataaataaattgcgacaatgtattgtatatatgcctcctttcatatatactttaatatgtaaacaaacttggtggggataaaatacttacaaaagatttccgccccattttttatccactcacaaaggtaatgagcatgaaacactttccatccaaagtactgaccacagccatccttgccactttctgtagcggcgcactggcagccacaagcgacgacgatgttaaaaaagctgccactgtggccattgttgctgcctacaacaatggccaagaaatcaacggtttcaaagctggagagaccatctacgacattggtgaagacggcacaattacccaaaaagacgcaactgcagccgatgttgaagccgacgactttaaaggtctgggtctgaaaaaagtcgtgactaacctgaccaaaaccgtcaatgaaaacaaacaaaacgtcgatgccaaagtaaaagctgcagaatctgaaatagaaaagttaacaaccaagttagcagacactgatgccgctttagcagatactgatgccgctctggatgaaaccaccaacgccttgaataaattgggagaaaatataacgacatttgctgaagagactaagacaaatatcgtaaaaattgatgaaaaattagaagccgtggctgataccgtcgacaagcatgccgaagcattcaacgatatcgccgattcattggatgaaaccaacactaaggcagacgaagccgtcaaaaccgccaatgaagccaaacagacggccgaagaaaccaaacaaaacgtcgatgccaaagtaaaagctgcagaaactgcagcaggcaaagccgaagctgccgctggcacagctaatactgcagccgacaaggccgaagctgtcgctgcaaaagttaccgacatcaaagctgatatcgctacgaacaaagctgatattgctaaaaactcagcacgcatcgacagcttggacaaaaacgtagctaatctgcgcaaagaaacccgccaaggccttgcagaacaagccgcgctctccggcctgttccaaccttacaacgtgggtcggttcaatgtaacggctgcagtcggcggctacaaatccgaatcggcagtcgccatcggtaccggcttccgctttaccgaaaactttgccgccaaagcaggcgtggcagtcggcacttcgtccggttcttccgcagcctaccatgtcggcgtcaattacgagtggtaagcagcatctcccgataaagaaaccgcagccctgcaaggctgcggtttttattttctatccggccgtcagactgccgcgtccgaacgttcgcccgtgcggatacggattgcctcctcaaccggcagcacaaaaatcttgccgtcgccgatttttcccgaacgcgccacctcgaaatcacgtcaatcgcgcgttccacagcatcatccgccaacaccagctcgattttgattttgggcaggaaatcgacggcgtattccgcgccgcgatagatttccgtatgccccttctgcctgccgaaccctttgacctcgctgacggtcatgcccgtaatgccgatttccgtcaacgcctcgcgcacgtcgtcgagtttgaacggtttgacaatcgcctcgatttttttcataaaatttcctttgaacaaacaatacaaacacatccgaaaaacgggaacctcccgtcagattgtcaacattttaagccaaaatacccaagcaatacagccccgttgcgcgtataatgacagattttccaaccgcatttgagagccgaatccatgtctgtcgttttgcccttgcgcggcgttaccgccctttccgatttccgtgttgaaaaactcttgcaaaaagccgccgcactcggtctgcccgaagtcaaattaagcagcgaattttggtatttcgtcggcagcgagaaagcacttgatgccgcgactgtcgaaaaactgcaagccttgttggcggcgcaaagcgttgaacaaacgccaaaagcgcgcgagggcttgcatttgtttttggtcacgccccgtttgggtacgatttcgccgtgggcttccaaggcgaccaatatcgcggaaaactgcggtttggcaggcatcgaacgcatcgagcgcggtatggcggtgtggctggaaggtcgtctgaacgatgaacagaaacagcaatgggcggctttgctgcacgaccgcatgaccgaaagcgtgctgcccgattttcagacggcctccaaattattccaccatctcgaatccgaaactttctccggcgtcgatgttttgggcggcggtaaagaagctttggtcaaagccaataccgaaatgggcttggcactttccgccgacgaaatcgattatctggtcgaaaactatcaggctttgcagcgcaatccgtccgatgttgaattgatgatgttcgcgcaggcaaacagcgaacactgccgccacaaaatcttcaacgccgatttcatcctcaacggcgaaaagcagcccaaatccctcttcggtatgatacgcgacacacacaacgcgcatcccgaaggcacggtcgttgcctataaagacaattcgtccgtaatcgaaggcgcgaaaatcgagcgtttctatccgaatgcggcggaaaaccaaggctaccgtttccacgaggaagacacgcatatcatcatgaaagtggaaacgcacaaccacccgaccgccatcgcgccgtttgcgggtgcggcgacgggcgcgggcggcgaaatccgcgacgaaggcgcgacgggcaaaggttcgcgtccgaaagcgggcctgaccggctttaccgtgtccaacctcaatattcccgacctcaaacagccgtgggaacaagactacggcaagccggaacatatttcctcgccgctggacatcatgattgaaggcccgatcggcggcgcggcgttcaacaacgaattcggccgccccaacctcttgggctacttccgcacttttgaagaaaaatttgacggtcaggttcgcggctatcacaaaccgattatgattgccggcggcttgggcagcattcaggcgcagcagacgcataaagacgaaatccccgaaggcgcattgctgatccaactgggcggcccgggtatgcttatcggcttgggcggcggcgcggcttcttcgatggataccggcacaaacgacgcgtctttggacttcaactccgtgcaacgcggcaaccccgaaatcgaacgccgcgcgcaggaagtcatcgaccgctgctggcagctcggcggcaaaaacccgattatctccatccacgacgtaggcgcgggcggcctgtccaacgccttccccgaactggtcaacgatgccagacgcggcgcagtattcaagctgcgcgaagtgccgcttgaagaacacggcctcaacccgctgcaaatctggtgcaacgaatcgcaagagcgttatgtgttgtcgattttggaaaaagatttggatgctttccgcgccatctgcgaacgcgaacgctgcccgtttgccgtagtcggcacggcgactgacgacggtcatttgaaagtacgcgacgatttgttcgccaacaatcccgtcgatttgccgttgaacgtcttgctcggcaaactgcccaaaaccacgcgcaccgacaaaacggttgcaccgtccaaaaaaccgtttcacgcgggcgatatcgacattaccgaagccgcctaccgcgttttgcgcctgcctgccgtagccgccaaaaacttcctgattaccatcggcgaccgcagcgtcggcggtttgacgcaccgcgaccaaatggtcggcaaatatcaaactccagtagccgactgcgccgttaccatgatgggcttcaacacctatcgcggtgaagcgatgtctatgggcgaaaaaccgaccgtcgccctgtttgatgcgcctgcttcgggcagaatgtgcgtcggcgaagccatcaccaacatcgcggcggtcaacatcggagacatcggcaacatcaaactctccgccaactggatggcggcgtgcggcaacgaaggcgaagacgaaaaactctaccgcactgtcgaagccgtttccaaagcctgtcaggcattggatttgagcatccccgtgggcaaagacagcctgtcgatgaaaaccgtttggcaggacggcgaggagaaaaaatccgtggtttcaccgttgagcctgattatctcagcgttcgcgcctgtgaaagacgtacgcaagactgttacgcctgagttgaaaaacgtcgaagacagcgtattgttgtttgtcgatttgggcttcggcaaagcgcgtatgggcggttcggcgtttggtcaggtgtacaacaatatgagcggcgacgcgcccgatttggacgatacaggtcgtctgaaagccttttacagtgtgattcagcagcttgttgccgaaaacaaactcttggcgtatcacgaccgcagcgacggcggcttgtttgccgttttggtagaaatggcgtttgcggggcggtgcggcttggatatagatttaaatttattgcttgcacaaacatttattaccaaccataccgctctgtctcaatcattgcggactgaagaggtaaaagcgttggctgaatggcaagaaaccattgcccgcacattatttaatgaagagttgggtgctgttatccaagttagaaaacaagatgttgccgatattatcaatttattctatcaacaacagctgcatcataatgtctttgaaatcggtacgttaactgatgagaacacgttaatcatccgcgacgggcaaacgcaccttatttctgacaacctaatcaaactgcaacaaacctggcaagaaaccagccatcaaatccaacgcctgcgcgacaaccctgcctgcgccgacagcgagttcgcactgattggcgacaacgaacgcagcgcattgtttgccgacgtgaagttcgacgtgaacgaagacatcgccgcgccgtttatcaacagcggcgcgaaacccaaaatcgccatcctgcgcgaacagggcgtaaacgggcaaatcgaaatggccgccgcctttacccgcgccggattcgatgcttacgacgtgcatatgtccgacctgatggcaggccgcatccacctcgccgacttcaaaatgctggcggcgtgcggcggcttcagctacggcgacgtactcggcgcgggcgaaggctgggcgaaatcgattctgttccaccctgctctgcgcgaccagtttgccgccttcttcgccgacccggacacgctgacattgggcgtgtgcaacggctgccaaatggtcagcaaccttgccgaaatcatccccggcacggcaggctggccgaagttcaaacgcaacctgagcgaacagtttgaagcacgcctgagcatggttcacgttccgaaatcagcgtcgctgattctgaacgaaatgcaaggctccagcctgcctgtcgtggtcagccacggcgaaggccgcgccgacttcgcgcttcacggcggcaatatttccgccgatttgggcattgcgctgcaatacatcgacggacaaaaccaagtgacccaaacttatccgctcaaccccaacggctcgcctcaaggcatcgccggcgttactaacgccgacggccgcatcaccatcatgatgccccaccccgaacgcgtgtaccgtgccgcgcaaatgagctggaaaccggaaggctggacggaactgtccggctggtaccgcctctttgccggcgcacgtaaagccttgggctaaccgccctactcaaaccaatgccgtctgaagaatatttcagacggcgttccggcataccatcctttaaacggtatccgtccaccgaggaacactcatgaaaatcacccccgtcaaagccctaaccgacaactacatctggatgatacagcacggcaaccatgccgtctgcgtcgacccttccgaaccctcgcccgtcttggaattcctcgtccgcaaccgcctcatgcttgcccaaacatgggtaactcacccccatcccgaccacgagggcggtgcggcggcactctggcgcggctacatggaatcgcccgtttacggcgaatccgacatcgaagcagcaacccacaccgtaaccgccggcacccaattcaccttcggcgacggacaggttaccgtttgggcaacacccggccacacagaccgccacaccagctaccttctcgaaacttcagacggcatacacgtcttttgcggcgacacccttttttccgccggctgcggacgcgtgtttaccggcacaatcgaacagctttacgacagcttccaacgcttcaaccgcctgcctgaaaacaccctgttctatccggcgcacgaatacaccgccgccaacctgcgtttcgccgcccatatcgagccggacaacgccgacattcagacggcactgaaagcggcggcgcatacgcctaccctgcccgttaccctcgcgcacgaacgccgcgtcaatccgtttttgcgcgtcgacctgccgcacgtcagagaccgcgccgaggcattgagcgggaaaacgttaaacagcagcctcgatacctttgtcgcgctgcgtgaacttaaaaaccaataccggacgaaataaaacaacgggaaaacgcagccattcctaggatttttattaaaatcttaaataaaatcatacaatcatcgccaatagacgaaaggacaccgttgccttataatcaaacaaaaacaaaatatataatatagtggattgaatttaaatcaggacaaggcgacgaagccgcagatagtacggcaaggcgaggcaacgctgtactggtttttgttaatccactatattgttaatccactatataaatccagcacaaaacgggatcggtgattcttgtccgcaagaatcgttgattttctctattacacggataatcatcatgcgcttcacacacaccaccccattttgttccgtattgtccaccctcggtctttttgccgtttcccctgcttactcatccattgtccgcaacgatgtcgattaccaatattttcgcgactttgccgaaaataaaggcgcgttcaccgtaggtgcaagcaatatttccatccaagacaagcaaggcaaaatattaggcagggttctcaacggcatccccatgcccgacttccgcgtcagcaaccgccaaaccgccatcgccaccctggttcacccccaatacgtcaacagtgtcaaacacaacgtcggctacggttccatacaattcggcaacgacacccaaaatccagaagaacaagcctatacctaccgcctcgtatcacgcaacccgcacccggactacgactaccaccttccccgcctcaacaaactggttaccgaaatctcacctaccgcactcagcagcgtacccttgcttggaaacggccagccaaaggccaatgcctacctcgataccgaccgcttcccctactttgtacgactcggctcaggcacgcaacaagtccgcaaagcagacggcacgcgtacacgaaccgccccggcataccaatacctgaccggcggcacgccgctgaaagtattggggttccaaaaccacggcttactcgtcggcggcagcctgaccgaccaaccccttaacacctacgcaatcgccggagacagcggttcccccctgtttgccttcgacaagcatgaaaaccgctgggtgcttgcgggcgtactcagcacctacgccggcttcgataatttcttcaacaaatacatcgtcacgcaacccgaattcatccgttccaccatccgccaatacgaaacccggctggatgtcgggctgaccaccaacgaactcatatggcgcgacaacggtaatggcaacagcaccctgcaagggctcaacgaacgcatcaccctgcccattgcaaacccttcgcttgccccacaaaacgacagcaggcacatgccgtctgaagatgccggcaaaacgctcatcctatccagcaggttcgacaacaaaacactgatgctggcagacaatatcaaccaaggcgcaggcgcattgcagttcgacagcaacttcaccgtcgtcggtaaaaaccacacatggcaaggtgcaggcgttatcgtagccgacggcaaacgcgtcttctggcaagtcagcaaccccaaaggcgaccggctctccaaactgggcgcaggcacgcttatcgccaacggacaaggcatcaaccagggcgacatcagcatcggggaaggcactgtcgtactcgcccaaaaagctgcttcagacggcagcaaacaagcattcaaccaagtcggcatcaccagcggcaggggcacggccgtcctcgccgacagccagcaaatcaaacccgaaaacctctatttcggcttcaggggcggacggctcgacctcaacggcaacaaccttgcctttacccatatccgccatgcggacggcggcgcgcaaatcgtcaatcacaaccctgaccaagccgcgacactgacgctgaccggcaaccccgtcctcagtcccgagcatgtcgagtgggtgcaatggggcaaccgtccgcaaggcaacgcggcggtttacgaatacatcaacccgcaccgcaaccgtcggaccgactacttcatactcaaacccggcggcaacccgcgcgaatttttcccgttaaatatgaaaaactcaacaagctggcaatttatcggcaacaacaggcaacaggccgccgaacaagtcgcccaagccgaaaatgcccgccccgacctgattaccttcggcggatacttgggtgaaaacgcgcaaacgggcaaagccgcgccgagttacagcaaaaccaatgaagcagccatagaaaaaacccgccatatcgcaaatgccgccgtatacggccggcccgaataccgttacaacggcgcactcaacctgcactatcgtcccaaacgcaccgacagcacgctgttgctcaacggcggcatgaaccttaacggggaagtcttgattgagggcggcaatatgattgtgtcaggcaggcccgtaccccatgcctacgaccaccaggccaaacgcgaacccgttcttgaaaacgaatggaccgacggcagcttcaaggctgcacggttcaccctgcgaaaccatgcccgactgacggcagggcgcaataccgcgcatctggacggcgacataaccgcatacgatctgtccggcatcgacctcggctttacccaaggcaaaacaccggaatgctaccgctcctaccatagcggcagcacccactgcacacccaacgccgttttaaaagccgaaaactatcgtgcactacctgcaacgcaagtacgcggcgacattacccttaacgaccgttcagagctccgcctgggcaaagcacacctgtacggcagcatccgtgccggcaaagacaccgcagtccgcatggaagcagacagcaactggacactttcccagtccagccacaccggcgcactgacgcttgacggcgcacaaattaccctgaaccccgatttcgccaataatacacacaacaaccgcttcaacacactgaccgtcaacggcacacttgacgggttcggcacattccgattcctgaccggcatcgtccgaaaacaaaatgccccccccctcaaactggaaggggacagccgcggcgcattccaaatccacgtcaaaaacaccggacaagaacctcaaacaaccgaatcgcttgcacttgtgagcctcaatccgaaacacagccaccaagcccgattcaccctccaaaacggctatgccgatttgggtgcctaccgctacatcctccgcaaaaacaacaacggatacagcctgtacaacccgctcaaagaggccgaacttcaaattgaagccacgcgtgcggaacatgagcgcaaccaacaggcatacaaccaattacaggcaaccgacatcagcagacaggttcaacatgactctgacgcgaccaggcaggcactacaggcctggcagaacagtcaaaccgaacttgcccgcatcgacagccaagtccaatatctgtccgcccaattgaaacagacagacccgctgaccggcattctgacgcgtgcccaaaacctgtgtgccgcacaaggatacagtgccgatatctgccgtcaggttgccaaagccgccgacacgaacgacctgacactcttcgaaaccgaactggatacgtatatagaacgtgtagaaatggccgaatccgaacttgacaaagcacggcaaggcggcgatgcgcaagccgtcgaaacagcccggcacgcctacctgaacgcactcaaccgtctgtcccgacaaatccacagtttgaaaaccggcgttgccggcatccgtatgccgaacctggccgaactgatcagccggtcggccaacaccgccgtttccgaacaggccgcctacaataccggccggcaacaggcgggacgccgcatcgaccgccaccttaccgatccgcagcagcaaaacatctggctggaaaccggtacgcaacaaaccgactaccatagcggcacacaccgtccctaccaacaaactaccaactatgcacatatcggcatccaaaccggcatcaccgaccgtctcagtgtcggtacgattttaaccgatgagcgcacaaacaaccgttttgatgaaggcgtatccgcccgaaaccgcagcaacggcgcacatctgttcgtcaaaggggaaaacggcgcactctttgccgcggcagatttaggctacagcaacagccgtacccgatttaccgattatgacggggctgccgtccgccgccacgcatgggatgcaggcatcaacaccggcatcaaaatcgataccggcatcaacctcagaccctatgccggcatccgtataaaccgcagcaacggcaaccggtacgtactcgacggcgcagagataaacagcccggcgcaaatccaaaccacatggcatgccggcatccgtctcgataaaaccgtcgaactgggtcaagccaagctgacccccgccttcagcagcgattactaccatacccgccaaaacagcggttccgccctcagcgtcaacgaccgtaccttactgcagcaagccgcccacggcacactgcataccctgcaaatcgacgccggatacaaaggctggaacgccaaacttcatgccgcttacggcaaagacagcaacaccgcccgccacaaacaggcaggaatcaaaataggctacaactggtaacaagccgataaaaatgccgtctggaacccgcgtttcagacggcatttgcgttaaaaatagtaaaccgttccaaaagggagtagaatagtgccgtttccaaccctgcgcctgtaccgtcaggcttttattatggaccttcccagttcgtttttactgaacaccccatccgattcaaacccgcaataaccatcccgccggaatgcctccccgcacacggcgggcggagcatttatgagcatcgaaccaacccctccgaaccttgaaaacgacggtatcgaaaacgatgtagaacgcgtttccgccgatttcgaccgtgtccactccctctgcgaaatcctcgaacctgcttttgaacaaatcgaaaacggtacaccgctcgaagacgcgccgctgcgcgacaagctgaccgagctgaccgtcctcttgagcgagctgcaccctgccgacgtggcggcggtattggaatcgctaccgccgcgcgaacgcaatatcgtctggattctggtcaaaccggaagacgacggcgaagtattgctggaagtatccgacgcggtgcgcgaaacgctgatcgagtcgatggacaaagacgaattgttggcagcggtcgatgatttggacgcggacgaattggcggaactggcagacgatttgccgcaccaagtggtttacgaagcgctacaaacccgcgatgaggaagaacgcgcccaagtcaaagcggcaatgtcctacgaagacaaccaagtcggtgcgattatggacttcgagttggtcagcatccgcgccgatgtcgcctgtgaagtggtgctgcgctatctgcgccgcttcgacagcctgcccgaccataccgacaagatttttgtggtcgatgaaaacgacgtactgcagggcgtgctgcccatccgcaaacttttggtcgccgatcccgaagacttggtggaaaacgtgatggcgaaagatgtcgtgcgtttccgcgccgaagatgacgtggaagaagcggcgcaggcgtttgaacgctacgacttggttaccgcgcccgtcgtcgatgaaaacaaaaagctcatcggcaggattaccatcgacgagatggtggacgtgatccgcgaagaatcggaagcggatatgctgaatatggcgggtttgcaggaagaggaagacctgttcgcccccgtgtgggattcggtgaaaaaccgctggatgtggctcgccgtcaacctctgcaccgccttcctcgccagccgtgttatcggcgcgtttgaaggcagcatcgaaaaaatcgtcgcactcgccgcgctgatgcccatcgtcgccggcataggcggtaactcgggcaaccagacgattaccatgattgtccgcgcgatggcgatggggcagctgacggatatgcaggcggggcgtttgctgaaaaaagaagtcggtgtcgccttggtcaacggcatcatttggggaacggtcatgggcgcagtatcttggctgctttacggcagcctcggcatcgggctggttatgattgccgcgatgacgctcaacctcctgctggcggcaaccgtcggcgtattaattcccgtggtaatggaaaagttcggacgcgatcccgcactgggcagctcggtgctgattaccgccgttaccgactccggcggcttcctgattttcttggggctcgccaccctattcctgctttaaatgccgtctgaacccgcgcaaaaatgccgtctgaagcggaagctgcttcagacggcatttgactatttatccttgttgcacaagattattggacggtatgccggggcagccctttggcaacgccgaccacatcctccccgaacagcgcgttgacatcggtttcgtcaaacacatatttgctgtggcagaaatcgcaatcgacttcgatgctgccttgttccaccaccacgccgccgacttcttccccgcccagcatcaacagcatatcgctgactttgccgcgcgaacaggtgcatgaaaattcaaacgtttccggctcgaacacgcgcggcggcgtttcgtggaacaggcggtataaaacgtgttgcgcgtccagtcctgccagctcctccgccgtcagcgtgcgcgccagcgtactgacgtgttcccatgcctcttcatccaatacctcttcaggcagacgctgcaccagcagaccgcccgccgcttcgtcgcttgcagacaggacgatgtgcgtatcaagctgttcggaacgtttcatatagttcaccaacatttgcgcgataccgccgccttccaaaggcactacgccctgccagggttcgccgtctttgggctgcagcgtcagcacgaatacgccgccctcgcccaaaaggtcgccgaggctttcgtcatcggctatttctgcggtttcgtcccaacgcgcggttgcacggacggtacggtcggaagccgcttccgcaaccagcattttcagccgcccccgcccctgaacctgcacaatcagcgtgccttcgtttttgaggttgcccgacagcaacacacccgccgccaacaactcacccaaagcgcggcggatggcggcgggatagtttttctgttttacaatgtgctgccacacgttttccagacggacgtgcagcccgcgcacgggcatatcgtcgaagataaagcgggtacgcacatcggcgcggttgatggcggtttgattcatgattttctctgactgattgttcggatggcggctatatggttgcggtcggcgcgaaaacaagacggacggcggatgcgcttcccaaattatcaataaattatataaaaatcaacatattaactcaatctaacaagccgttttttgccaaacagccgtttttttatatacaatcaacaagatattttcgactgatacagcataacatcgcacggcggcacgatgcctcctgcgcggaaacaccgatatggattcttttttcaaaccggcagtttgggcggttttgtggctgatgtttgccgtccgccccgcccttgccgacgagttgaccaacctgctcagcagccgcgagcagattctcagacagtttgccgaagacgaacagcccgttttacccatcaaccgagcccccgcccggcgggcgggcaatgccgacgaactcatcggcagcgcgatggggcttaacgaacagcccgttttacccgtcaaccgagtccccgcccggcgggcgggcaatgccgacgaactcatcggcaacgcgatggggcttaacgaacagcccgttttacccgtcaaccgagcccccgcccggcgggcgggcaatgccgacgaactcatcggcaacgcgatgggacttttgggtattgcctaccgctacggcggcacatcggtttctaccggttttgactgcagcggcttcatgcagcacatcttcaaacgcgccatgggcatcaacctgccgcgcacgtcggcagaacaggcacggatgggtacgccggttgcccgaagcgaattgcagcccggagatatggtgtttttccgcacgctcggcggcagccgcatttcccatgtcggactttatatcggcaacaaccgcttcatccacgcgccgcgcacggggaaaaatatcgaaatcaccagcctgagccacaaatattggagcggcaaatacgcgttcgcccgccgggtcaagaaaaacgacccgtcccgctttctgaactgatttcccaaggaatacgcaatgagtatgcccgaaatgcccaaatggtacgacgatgacggacagatcgtgtcctgtaccgaaaaggtcaaagtgatgtccgaaaatatggccgagctgtatcagacggcacaagacgcgtttgaagacgcgctgctgatgggttgcggcgaacgtcagttgcgcgattacctgctcgcgctgattgaaggtttggaaaatccctaccgcaaagtctgaacacgccccggttgctgcggcacggtttatccgtgccgtttttgcgtttgtgcgcggcttcggcttttcagacggcatatttgacgttatgattaaacagttaacaagatttatcacaacgccgtcaaaagacagacacacaacatgaacatcatccgcgcgctcctcatcatcctcggctgcctcgccaccggcgaaaccgccgttttcctagcaggcatcaaactgcccggcagcatcgtcggcatgggcgtgctgtttgcgcttttgcaggcgggttgggtcaaaacgtcttggctgcaacagcttaccgacgcgctgatgtcgaacctgacgctgttcctcgtgccgccctgcgtggcggtcatcagctatttggatttgattgccgacgattggttttcgatactggtttccgcctccgccagcactttgtgcgtactgctggttacgggcaaagtccaccggtggatacggggtattatccgatgaacgaaatcctcaggcagcccagcgttctgcttttcctcacgcttgccgtgtacgcgcttgcgattatcgtgcgcacgcgcacgggcaatatcttctgcaaccccgtactcgtcagcactatcgtgctgattgcctacctgaaaatcctcggtatcgattatgcggtgtaccacaacgccgcgcaattcattgatttttggctgaaacccgccgtcgtcgtgcttgccgtgccgctctaccaaaaccgccgtaaaatcttcaaccagtggctgcccgtcatcgtttcacagcttgcgggcagcgttacgggcattgttacagggatgtattttgccaaatggctgggcgcggaacgcgaagtcgtcctctcgctcgcgtccaaatctgttaccaaccccatcgctattgaaatcacccgctccatcggcggcattcccgccattaccgccgccaccgtcatcattgccggtctggtcggacagattgccggttacaaaatgctgaagaacacggtcgtcatgccctcgtccgtgggtatgtcgctcggcacggcttcgcacgcgatggggattgccgcctcgctcgaacgcagccgccgtatggcggcatacgcggggctggggctgacgttcaacggcgtactgaccgcgctgattgcgccgctgctcatccccgttttgggattttgaacccgtttcagacggcatttcagcccatgctgtctgaacgccgacacactcgcaaggagaaccgttatggctgtcaacctgaccgaaaaaaccgccgaacaactgcccgacatcgacggcattgccctctacaccgcccaagcaggcgtgaagaagcccgggcataccgacctgacactgattgccgtagccgccggcagcaccgtcggtgcagtcttcacgaccaaccgtttctgtgccgcgcccgtccacatcgccaaatcgcaccttttcgacgaagacggcgtgcgcgccctcgtcatcaacacgggcaacgccaacgcgggtacgggcgcacagggcagaatcgatgctttggcagtgtgtgccgccgccgcccggcaaatcggctgcaaaccgaaccaggtgctgcccttctccaccggcgtgattctcgaaccgctgcccgcagacaaaatcatcgccgccctgcccaaaatgcagcctgccttctggaacgaagcggcacgcgccatcatgaccaccgacaccgtgcccaaagccgcctcgcgcgaaggcaaggtcggcgacaaacacaccgtccgcgccacgggcatcgccaaaggctcgggcatgattcatcccaatatggcgaccatgctcggtttcatcgccaccgatgccaaagtttcccaacccgtcctccaactgatgacgcaggaaatcgccgacgaaaccttcaacaccatcaccgttgacggcgacaccagcaccaacgacagcttcgtcatcatcgccaccggcaaaaacagccaaagcgaaatcgacaacatcgccgacccgcgttacgcccaactcaaagaattgttgtgcagcctcgcgctcgaactcgcccaagccatcgtccgcgacggcgaaggtgcgaccaagttcatcaccgtccgcgtcgaaaacgccaaaacccgcgacgaagcccgccaagccgcctacgccgtggcacgttcgccgctggtcaaaaccgcctttttcgcctccgaccccaacctcggcaggctgctcgccgccatcggttatgccggcgttgccgacctcgataccgacctcgtggaaatgtatctcgacgatattttggttgccgaacacggcggacgcgccgcaagctacaccgaagcacaagggcaggcggtgatgtcgaaggccgaaatcaccgtccgcatcaagctgcatcgcggacaagccgccgccaccgtctatacctgcgacctgtcgcacggatacgtttccatcaacgccgattaccgttcctgacccgacacggcttcagacggcatacataaaatgccgtctgaaccgccggacaacataccatgacctccacattcccccgccgcctcgcccgcaaaatccgccaaacccgccgcctgtcgcgcaaaagcatcgcctttctgttccttttggcaggttcggcactcgtcgccctgaccgcgctgttttttgcccatcttgccgattttgcgctggaactgaacgccaaactggttcaacaatacccgtggttcgcgtgggtcgcgcttcctttgggtttaccgcttattgcgtggctcacacgcaaattcgcccccttcaccgccggcagcggcatcccgcaggtcatcgcctcactgtcgctgccctacggcgcacagaaaacgcggctgatccgcctcgggcagacgctgctgaagattccgctaacctttttgggtatgctgttcggcgcgtccatcggacgcgaaggtccgtccgtgcaggtcggcgcggcagtgatgggcgcgtggggcgcgtggtgcaagaaacacggcttggcattcaaagggatgcaggaaaacgatttgatggcggcgggcgcggcgggcggtttggcagccgcgttcaacgcgccgctggcgggcgtgattttcgccattgaggaactcgggcgcggcatcatgttgcgctgggagaggcaaattcttttgggcgtgctcgcctccggtttcatacaggtcgccattcagggcaacaacccgtatttttccggcttcaacggcggcgtattggaacatatctttctgtgggtcgcactgtccggcctggtttgcggcgcggcgggcgggctgttcggacgtttgctctatcgcggtgcggcggcgtttgcaccgcgcaagatacgcggcttcatccgcaaccgtccgctgctgctggcggcactgatggggctgctgctcgccctgctcggcacgttctaccaaggcaaaacctacggcaccggctaccacgaagccgcccaagccctgcacggcatctacgaagcccccttcggactcgccgccgccaaatggctcgccaccgtattcagctattgggcaggcgttccgggcggcattttcactccctcgctgaccataggcgcggttttgggcgagcatatcgccgccatcgccgacatatcgcagggtgcaaacatcatcgtcctcatctgcatggcggcatttctggcgggcgcgacacaatccccgattacttccgccgtcgtcgtcatggaaatgacgggcggacaaagcctgctgttttggatgctaattgcctgcattttcgcctcgcaggtttcgcgccagttttcgccgcgtccgttctaccacgcatcgggaatgcgcttccgccagcgcgtgcttcaagaaaccgccgcccaaaccggcaatgcgcccgcaagaccgcaaacagcaaacagcaaaacgggaatgccgtctgaaaattaaaacgcccccgatcaaacgccggcagccgccttgatttgaataccgttccgccgccgcttgaaatttcagcaacaatgccgtctgaacgacagaatgcggttttcagacggcatttccccatcccgatattgcctaaacaaaaccgaagcgtttgctataattctattttttaccgcatacgcaccaatcatgtttcccgatttctcccaaaccctctccaaagaccgccacttcctgcgttccgccttcaaaaatcccaacaaatacggcggtttgtccaaaatcgaagaaaaataccgaaaatcgcacgaaatctttttgaagcgtttggcagccttgccaaaacccgaattcgacaacaccctgcccgttcacgagaagctcgaagaaatcaaaaaagccattgccaagaatcaggtaacgattatttgcggcgaaaccggttcgggcaaaaccacgcagttgcccaagatttgcttggaactcgggcgtggggcggcaggattgatcgggcatacccagccgcgccgtttggccgcgcgctccgtagcagagcggattgccgaagagctgaaatccgaaatcggcagcgcggtcggctataaagtacgcttcaccgaccacacctcgcgcgatgcctgcgtcaagctgatgaccgacggcatcctgctggcggaaacgcagaccgaccgttatctcgccgcctacgacacgattatcatcgacgaagcgcacgagcgcagcctgaacatcgacttccttttgggctatttgaaacaactcctgccgcgccgccccgatttgaaagtcatcatcacctcggcaacgatagacgcagaacgcttctcccgacacttcaacggcgcgcccgttttagaagtgagcggacggacgtatcccgtcgaaatcctctaccgaccgctgaccggcaaagacgaagacgacgcagaagtggagttgaccgacgcgattgtcgatgcggcggacgaattagcgcgacacggcgaaggcgatattttggtattcctgccgggcgagcgcgaaatccgcgaaactgccgaagccctgcgcaaatccacgctgcgccgcaacgacgaaatcctgcccctgttcgcacgcctgtcgcacgccgagcagcacaaaatcttccacccctcaggcgcgaaacgccgcatcgtattggcaaccaacgtcgccgaaacctcgcttaccgtgccgggcatcaaatacgtcatcgacaccggcctcgcgcgtgttaaacgctattccgcacgggcgaaagtggagcagcttcatatcgaaaaaatctcccaagccgccgcccgccaacgatccggccgctgcggacgcgtctccgcaggcgtgtgtatccgactgttttcagaagaagattttaacagccgccccgaatttaccgaccccgaaatcgtccgcagcaacctcgccgccgtcatcctgcgcatggcagcattgaaactcggcgatgtggcggcattcccgtttttagaaatgcccgattcacggtatatcaatgacggttttcaggtgttgttggagttgggggcggtggaggccgtctgaaaacaggcagacataaaagaaaatccgcgtagagtgatgtaaacttacccttgctttaataagtagaaaatggtgggtttacgtccccccctgcggctactaaaaaaatataagagtaaacaacctttttgaaagaaaaatgtatggacgaaattcaaatacccaaaaaagtggaattacaaaccaaactagaaaatgaaaagattgttttatcgaaaggttctaccacgattattgttggtgctaatggcacagggaaaacaagattagctgtttatattgaagaacaattaaaggaaaaagcacacagaatttcggctcatagagcattaaaattaaaccctaatgtcaataaaataccagaaaagagtgccaaaacatatctatcttatggtcagaactgggatggaatcgatgtatcaaatagaaaaaattatagatgggataataactcatatactcatttactcaacgattttgattggttattacaatatttattcgctcaacaaaataatattgcggtagcaaataatcaaaagctcaaccgtaatgaaaaagtaaccaattcaaaaacaaagctagatattttgcaagaagcatgggaaacattattaccacacagaaaattacatattacagcagatgatattcaagtctctgctgtagataatgaggaattgtattctgcctcaaatatgagtgatggagagcgagcacttttctatattcttggacaagttttgtcagtagatgacggttctgtcttaatttttgatgagcctgaattacatattcataaatcaattatttcaaatctatgggataaaattgaagaattacgacctgattgttcatttctaatcattacacacgatattgaatttgctgcaactcgagtagctaaaaaatatgttatcagaaattattatccgacccctgcttgggatatttctgaagttcctgaaagtaattttgatgaagaaacaataacgatgattttaggtagccgtaagccaatattatttgttgagggcaacaataatagtttagatattgctacttaccgctattgttatcctgattggaccatcatacccaaaggggcatgcaaagatgtcattcaatcagtatcatcgctgaaaaaattaagtaatgaaatgccattactaaacttaaaatgttcaggtattgtcgatttagatagtagggatgaaagagaaattgaacaattaaataatttgggtatttacattttacctgtatccgaaattgaaaatctttttagcttaactgatgtagcaaaagagatattgaaactaaatcaatattcagatgaagaattactcaataaacttaatggatttaaatccgaactaattaaatatatagataatgaattaaaagacgataaattagacgaatttgttgtaaaacaggttcgacgtaaaattgataattatttaaaaaatattgatttatcctccaaaataacaagtactgatatgaaaaaatcattacttaatgaaatttctactttaacagaacagaaaattgaaacatggatttcagaaattaaaaatgaaattcaaagatgtattgaacagcaagatttggataaattacttactatatatgataataaaggactcttggctaaatcagcttgtgttttaaaaggaatgcgtaacaaacatgaatttgaaagctggataatgagaacattaaaaggaaggaataaagattttattgatgcaatcagacagaaacttccaattctggattaaataaaaccatctgaaaatttaccttcagatacagatatatttcatgaaaaatcatcaaactacactctctttccctacttcgagtagcctgaaaccttgcgcagacaaacaaggcctgtctgaagaccgcagccaataccgcctgaccaaactcggcgaacaaatggcgcacctgcctatcgacccgaaaattgcgcgtattttgttagtattattccgtttttaaaaatgcccgattcgcggtatatcaatgacggttttcaggtattgctggaattgggggcggtggaggccgtctgaaaataaaatctttctttataaaaaggcaggccatgtttcattttcagacggcctaaatcattgagaaactaaaaactattaaaaagggaatattgggttttaaaactcaatcggtaaatttttattgtgaaatattaatgatgaaaaaatctttccttacgcttgttctgtattcgtctttacttaccgccagcgaaattgcctatcgctttgtatttgggattgaaaccttaccggcggcaaaaattgcggaaacgtttgcgctgacatttgtgattgctgcgctgtatctgtttgcgcgttataaggtgacgcgtttgttgattgcggtgttttttgcgttcagcattattgccaacaatgtgcattacgcggtttatcaaagctggatgacgggcatcaattattggctgatgctgaaagaggttaccgaagtcggcagcgcgggtgcgtcgatgttggataagttgtggctgcctgtgttgtggggcgtgttggaagtcatgttgttttgcagccttgccaagttccgccgtaagacgcatttttctgccgatatactgtttgccttcctaatgctgatgattttcgtgcgttcgttcgacacgaaacaagagcacggtatttcgcccaaaccgacatacagccgcatcaaagccaattatttcagcttcggttattttgtcggacgcgtgttgccgtatcagttgtttgatttaagcaggattcccgcctttaagcagcctgctccaagcaaaatcgggcagggcagtgttcaaaatatcgtcctgattatgggcgaaagcgaaagcgcggcgcatttgaagctgtttggctacggacgcgaaacttcgccgtttttaacccggctgtcgcaagccgattttaagccgattgtgaaacaaagttattccgcaggctttatgactgcagtgtccctgcccagttttttcaatgcgataccgcacgccaacggcttggaacaaatcagcggcggcgataccaatatgttccgcctcgccaaagagcagggctatgaaacgtatttttacagcgcgcaggcggaaaacgagatggcgattttgaacttaatcggtaagaaatggatagaccatctgattcagccgacgcaacttggctacggcaacggcgacaatatgcccgatgagaagctgctgccgttgttcgacaaaatcaatttgcagcagggcaagcattttatcgtgttgcaccaacgcggttcgcacgccccatacggcgcattgttgcagcctcaagataaagtattcggcgaagccgatattgtggataagtacgacaacaccatccacaaaaccgaccaaatgattcaaaccgtattcgagcagctgcaaaagcagcctgacggcaactggctgtttgcctatacctccgatcatggccagtatgttcgccaagatatctacaatcaaggcacggtgcagcccgacagctatctcgtgccgctagtgttgtacagcccggataaggccgtgcaacaggctgccaaccaggcttttgcgccttgcgagattgccttccatcagcagctttcaacgttcctgattcacacgttgggctacgatatgccggtttcaggttgtcgcgaaggctcggtaacgggcaacctgattacgggtgatgcaggcagcttgaacattcgcgacggcaaggcggaatatgtttatccgcaatgagtggcgtaaaaaccaataaagacaaatttagatgatgtcggggaagatgcccgaccgacaagactatgcaaaatatgaaaaaccaagtacgcggatcaggcatggatgcccgatccaatccggccaatgtttcagacggcctgcaaaacagttcgggtcatatcggtaccaacacgcgttaccgcctgaccaaactcggcgaacagatagcgcgcctacccatcgacccgaaaatcgcgcgcattttgctggcggcgaagaaacacgactgcatggcggaaatattggtgattgcgtccgcgctgtcgattcaagacccgcgcgagcggccgctagaagcgcgcgatgcctcagccaaggcgcacgagcgttttaccgacaagcagtccgatttccttgcctatctgaacatttgggacagcttccagcgcgaacgcgataaaggcttgtccaacaagcagctggtgcagtggtgccgccaatatttcctgtcgcacctgcggatgcgcgagtggcgcgagctgcaccaccagcttgcccaaaccgcgattgaaatgggtttaaccaccaaggaagccgctttcagacgacctcccgaagtcaggcagctcacgtcgtctgaaaatgcgggtgaccaagacctatctgctaaactcaaacaaaaacaactggataaaaagcaacaccgcgcccaaatccgcgccgccaaagaagcgggctacgaacaaatccaccgcgccctgctcactggccttatcgccaacgtcggcatgaaatcgcccgacggtaacgactacaccggcgcgcgcggcagccgcttccaccttttccccgcctccgccctgttcaaagccaaacccaaatgggtgatggcggcagaattggttgaaaccacgcgcctttacgcgcgcgacgtcgccgttatccagcccgaatggatagagcaggaagcgccgcacctcgtccgctatcattatttcgagccgcattgggaacaaaaacgcggcgaagtcgtcgccagcgaacgcgtgacgctttacggtctgaccgtattgccgcgccgccccgtgtcttacggcaaagttgcccccgaagaagcgcgcgaaatctttatccgcagcgcgttggtggcgcaggaatgcgatttgaaagcggatttttttgtccacaacaaaaagctgattaaagaaattaccgaactcgaacacaaatcgcgcaagcaagacgtgctggtcgatgacgaagccctgtttgcgttttataacgaacgactgcccgaaatggcttggaaagacgcgcaaggcagcgtttggggaagtgaagattccgtacggattattgaatctgacaaagccgagaggtcgtctgaaaatgagcgcaacgagtttcgtaaaaacaagcgtaatgggtctcgccaaaatgaaaatcacggcaacaccgtaggttgggttgaaaacccaacatcagccgcaactgcaaaaactgttgggtttgacaatccaacctacgctgcccaacaaaccaccccctcccccgtgggggagggtcggggagagggcaaaacagttgccgcacaaaccaacttttccgcaaccgcagcaaaccctctccctaaccctctcccgcaggagagggaacagagtgccgcagcttcaacgatttcagacgacctgcgtcctgcaaatctgcagcaaaccgccccctcccccgtgggggagggctggggagagggcaaaacagttgccacacaaaccaacttttccgcaacctcaacaaaccctctcccgcaggagagggaacagagtgcctcagcttcaacgttttcagacgacctgcgtcctgcaaatctgcagcaaccctctccctcccccgtgggggagggctggggagagggcaaaacagttgccacacaaaccaacttttccgcaacctcaacactttcagacgactccaaacccaaaaagcagcctgcaccccaaaaaaaccgtctgaaacccctacccctcgccgacatccgcaccttccaagcctggctcaaaaccgccgagcgcgacaatccgcgcctgctgttcctcagccgcgacgatctgatgcaacacgccgccgcacacattaccgaagaacagttccccaaattctggcaaaccgcagacggcaaattcaaactttcctaccgcttcgagccgcaccatccgctagacggcgtgaccatgaccgtgccgctgaccgtcctcaaccgcctgcacgcgccgtcgctcgaatggctggtgcccggcatgatacgcgaaaaaatccagttgcaaatcaaagcactgcccaagcaaatccgccgcatctgcgtgcccgtgcccgaattcatcacccaatttttaagccaaaaccccgaccgcaacgcccccatcctgccccaactcgcccaagccatcgccaaaaccgcaggcgacatccgcatattcgagcaaatcaaccaagacgaatgggccgcgttcaggctgcccgaacactgctatttcaacctccgcattatcgacgacggcggacaagagcttgccggcggccgcaaactgcacgaattgcaacaacaactcggtcaagctgccgccgttaccttccgtgacaacacccaagaatttgagcgcgacaacgtcaccgcatgggacatcggcaccctgcccgaatccatcaaattcgcacgcggcaaacaacagctcaccggctatctcggcctacaaaaagaaaaagacggccgcatcgccctgcgcctgtttgataccacagaagccgcagagcaggcacaccgtcaaggtgtcatcgaattgatgaagctgcaattaaaagagcaggtaaaggatttgaacaaaggcatccaaggcttcacccaagctgccatgctgctcaaacacatcaacgccgacactctgcgcgacgacctcacccaagccgtctgcgaccgcgcctttatcggcgaagacgagctgccgcgcaacgaaaaagccttcaaagaacaaatcaaacgcgcccgcagccgcctgcccgccgtcaaagaagccctcagccgctacctgcaggaaaccgccgccgtctacgccgaactcaacagcaaactcggcaaacacccattgacccaccttctaagactacgcctgcaaaccctgctcgccgccggcttcgccacccgaaccccgtgggcacaatggccgcgcctccccatctacctcaaagccatgaccctgcgcctcgaaaaatacagcagcaaccccgcccgcgacgcagcccgcgaagccgatatccaagagctggaacaaatgtggcaggaaaaaacagacagcctgattaaacaaggtctccccatttcagacggcctcgccgcgtttaaatggatgattgaagaattgagggtgtcgctgttcgcgcaggaattgaagacaccgtatccggtgtcggtgaagcggctgttgaaagagtgggaaaaaattgaaaaataaaaaaacagcctgaaaagtttcaggctgtttttttatttgactaatcgaagtttcctatatctatttaagtccctctcaactaatccaaaagttaaatcagcaacatctttgggggatacgtttaaattttcagcaatctgttcaataccaatgccatcattttttaaaatagtaagcattttacgtaatgcgcttgatatttccctttccattggctctggttcgatagttcgatattttttctttgcaaacaaaggacaaagattgtgtatatacatcctatcagtaatcattcctaatttatgcatccgatatgctaaggcaacaagtgatacaccaaatcgtcttttgatttttaataaattttcaatagtgataggaacatgacgatataagcgtagtgcagcctccggcattaaaaaagctgaagcaaaggcattagcctctttttcgataatatcacgaggttcatcttctgtaatttcactatttttactatgttccatactgtatttatcacggattaagtgccctaattcatgggcagcatcaaatcgactacgttctgcagatttttgtgtatttaaaaatacaaatggatgattttcataccaagtacaaaaggcatcaatgtcctttgtatctaaagataatgaaaatacacgaacacccttaacttcaagtagggtgatcatattcggaataggttcattgccaagcccccattctaatcttagttcctgagcagcctcttcaggagaaatatcagaaaaatcaggcaatacggcttgacttagtgtaaattctgtctcgagccagtcatttaacaaaaaagccgtaatgctatgatttaatgcttgtttttcaagcctcttcgaggtgcgtgaacgagcacgaaaacttactgcctgagatttcaactcaggcagtctttcgtcattagtaaagaaatgaactggaaactctaataaattggctaattcatttaaatcaggtatttgctcatcttttacatagtttctaacctgtcgagcggtaatacctaataactcagctaattttgtttgcgtacaaccacgtttatccagcgcaaattccagtctctcacgattaaatgtctgcatgatttatcattcaaattatcctgctttttgttttctttcaaccaaaggctcatattcttcaacaggttgcttacgttcaagctcatcaaatttagttaaatcaacatcagctaatataattcgctgcttgtacccagttatttgatgactaacaaaaccactcggtaaagataattcaagttgcactttattatacttccagtgaaacagcagaacccaaaactgcacagtatcaggcaaatctagttttgaattacgaatagcctcctcaaatcccttacctttccttgcggttgtcattggcatcccgtgatgcctaccaacatctgaagtagcagtagccacaataatacttttagttcgacatggcgagagacatagaaatgcaccacccgaccaaggctcaagcgtccagccatctttacttaaatatacccttagagcaaatgtaatttctgcttgccgatacatccccaatgtatttctgtcagataatgctgctttgtcctgaatattattatgcgcagtaagtacaatctctttaagcatctcctgagataagtacttgctgatttcacttaaagcaatatcactattttgttgctcgactatttctcctacttcaaatgggaaaggttctgataatgcaaattccaccataaaaatttcctaattttatacgtaatgtttacacaatatatcaggaaatatgaaaacgtacaactatatctataaagcaattaataagtagcctgcccaaccgtgtccttatctttcggcacacccgacctgcaaatcacgcaaaacttggaatccgtgtgtagggtgtgtgcggtacatacgcacgcagtctttttaaaccacagcccttcccaactaaaccaaaaggtcgtctgaaccctattttcagacgaccttttgccactttgtaaaacaaatcttcccaccatcctctccccaaacatcgcccgaaccagtaaacttctcatatttcaacaactccttggaagcaaaccatgtctggtatctacctaccccgcctattcccgccccatatcgccgaacgcggcctgttgtattttcagcagggcaaggttctcgatgtccgaaaaacttccgccgggcattatcgggcggaggtgtgcggttcggaaaactattgggtatagttgaagctggatagtgatttgtatattaaagacgaaggctgcaattgtccttatatctaagagtgcaaacataccttaaattactatattgcataggcaaaatacaagcctataacgaattggaaacaaaatgccgtctgaaaacatcttcagacggcattataaaatctgttcaccttttcagatgagtaatgtacacccttatacaatttttgctactatgccccataaatccacggctaaagatatccttattatgtcctatgatttatcgaaacgacttgtaatcggcttagcatcaagtgccctattcgacttatccgaatcggataatatatttagaatggaaggggcagaaacctataggcaatatcagagagaaaaacaaaaccatcccctaaaaaaggcgttgtctttccatttattaaaaaacttctgtcaatcaatgaaataaacccaaacgacccaacgattgggtttattcttttatccagaaacaatccagatacagattacgagtcataactataggcttaatattacacgattctcattccatcaaggcggaaaaccgcacaaatactgaaacactatcgatcgatttgtaaacaagcctacttaagtaacttgcagtccttatcatttcctttaaaataatccagcccgtcactacacgaactggcggacttcttgcaaataaaggttactagattttcattcatcttaataataaaaggatttttatctttatctatggctaccgccttcaacatgaatttactgtctaaagccccgcgcgcgattccattcaaacggatacaaaagccttctgcctctttaatcggcaaacttggccacttggtagatgtttgtttaaacctcccattctgcagataaaacttttccataaaatgtgcattttctaacaaggctgcccgcactgcatttatctttgctttctcaacataattgcgatagctcggataaacaattaaagcaagtacagacaatatcaagaccactgatattaattcaaccagcgtaaacccccgattatcagtcattactttacttccaataagaacagattattcaacatatttctttgaacagacttactatcccattcaacagtatgcatatttcccactctattttttagcggccggtatagccggtttggctgggccttttggtgcgggcgcgccgaccgaagcctggtccttcagcttcgccagcaccgcagggccgatgccctttaccttggtcaaatcgtctacagacttgaacgcaccgttttgcgcacggtattccgcaatggccttcgccttcgccgggcctatgcccggcagcgcctccaactcctgctgcgaagccgcattgatgtttaccgccgcaagggagaaggcgcaggagaacagcatacagaacagcacgaacattttcttcatggtttttcctttaagggttgcaaacaataaaccgcatcttgcgacgataaaacgagtcattctaaaatgaatatcccaaagtttcaagccgttcctccgcaaacccgaccggacaccgtacggatgccgtcccgccatcaccgacattttttccgggcaaagcaaacattttttccgggcaaagcaaaaacccccgaataatcgggggttttctgaatgggtgtttggcagtgacctactttcgcatggaagaaccacactatcatcggcgctgagtcgtttcacggtcctgttcgggatgggaaggcgtgggaccaactcgctatggccgccaaacttaaactgttacaaatcggtaaagccttaatcaatatattcggtaatgactgaatcagtcagtaagcttttatctcttgaagttcttcaaatgatagagtcaagcctcacgagcaattagtatgggttagcttcacgcgttaccgcgcttccacaccccacctatcaacgtcctggtctcgaacgactctttagtgcggttaaaccgcaagggaagtctcatcttcaggcgagtttcgcgcttagatgctttcagcgcttatctcttccgaacttagctacccggctatgcaactggcgttacaaccggtacaccagaggttcgtccactccggtcctctcgtactaggagcagcccccgtcaaacttccaacgcccactgcagatagggaccaaactgtctcacgacgttttaaacccagctcacgtaccactttaaatggcgaacagccatacccttgggaccgactacagccccaggatgtgatgagccgacatcgaggtgccaaactccgccgtcgatatgaactcttgggcggaatcagcctgttatccccggagtaccttttatccgttgagcgatggcccttccatacagaaccaccggatcactatgtcctgctttcgcacctgctcgacttgtcggtctcgcagttaagctaccttttgccattgcactatcagtccgatttccgaccggacctaggtaaccttcgaactcctccgttacgctttgggaggagaccgccccagtcaaactgcctaccatgcacggtccccgacccggatgacgggtctgggttagaacctcaaagacaccagggtggtatttcaaggacggctccacagagactggcgtctctgcttctaagcctcccacctatcctacacaagtgacttcaaagtccaatgcaaagctacagtaaaggttcacggggtctttccgtctagcagcgggtagattgcatcttcacaaccacttcaacttcgctgagtctcaggaggagacagtgtggccatcgttacgccattcgtgcgggtcggaacttacccgacaaggaatttcgctaccttaggaccgttatagttacggccgccgtttactggggcttcgatccgatgctctcacatcttcaattaaccttccagcaccgggcaggcgtcacaccctatacgtccactttcgtgttagcagagtgctgtgtttttaataaacagtcgcagccacctattctctgcgaccctccggggcttacggagcaagtccttaaccttagagggcataccttctcccgaagttacggtatcaatttgccgagttccttctcctgagttctctcaagcgccttagaattctcatcctgcccacctgtgtcggtttgcggtacggttcgattcaaactgaagcttagtggcttttcctggaagcgtggtatcggttgcttcgtgtccgtagacactcgtcgtcacttctcggtgttaagaagacccggatttgcctaagtcttccacctaccggcttaaacaagctattccaacagcttgccaacctaaccttctccgtccccacatcgcatttgaatcaagtacaggaatattaacctgtttcccatcgactacgcatttctgcctcgccttaggggccgactcaccctacgccgatgaacgttgcgcaggaaaccttgggctttcggcgagcgggcttttcacccgctttatcgctactcatgtcaacattcgcacttctgatacctccagcacactttacaatgcaccttcatcagcctacagaacgctcccctaccatgccggtaaaccggcatccgcagcttcggttatagatttgagccccgttacatcttccgcgcaggacgactcgaccagtgagctattacgctttctttaaatgatggctgcttctaagccaacatcctggctgtctgggccttcccacttcgtttaccacttaatctatcatttgggaccttagctggcggtctgggttgtttccctcttgacaacggacgttagcacccgctgtctgtctcccgaggaaccacttgatggtattcttagtttgccatgggttggtaagttgcaataaccccctagccataacagtgctttacccccatcagtgtcttgctcgaggcactacctaaatagttttcggggagaaccagctatctccgagtttgtttagcctttcacccctatccacagctcatccccgcattttgcaacatgcgtgggttcggtcctccagtacctgttacggcaccttcaacctggccatggatagatcactcggtttcgggtctacacccagcaactcatcgccctattaagactcggtttccctacgcctcccctattcggttaagctcgctactgaatgtaagtcgttgacccattatacaaaaggtacgcagtcacaccactagggcgctcccactgtttgtatgcatcaggtttcaggttctgtttcactcccctcccggggttcttttcgcctttccctcacggtactggttcactatcggtcgatgatgagtatttagccttggaggatggtccccccatattcagacaggatttcacgtgccccgccctacttttcgtacgcttagtaccgctgttgagatttcgaatacgggactgtcacccactatggtcaagcttcccagcttgttcttctatctcgacagttattacgtacaggctcctccgcgttcgctcgccactacttgcggaatctcggttgatttcttttcctccgggtacttagatggttcagttctccgggttcgcttctctaagtctatgtattcaacttaggatactgcacagaatgcagtgggtttccccattcggacatcgcgggatcattgctttattgccagctcccccgcgcttttcgcaggcttacacgtccttcgtcgcctatcatcgccaaggcatccacctgatgcacttattcacttgactctatcatttcaagaacttctttgactttgcctaacattccgttgactagaacatcagacttgaatttcctactttgataaagcttactgctttgttgtgtcttaatcctgccttttgtgtttcaggattaagtcgatacaatcatcacccaaatactgtgtttgttttcttttctcttgcgagagatttttatcctttgcaaagaataaaaaatcaaaacaaacgctttgtctttgtttgttgatttcggctttccaatttgttaaagatcgatgcgttcgatattgctatctactgtgcaaatcaaaacgagctgattattatatcagcattttgttcttggtcaagtgtgacgtcgccctgaatggattctgttccattcttccgttttgatttgtacagtattggtggaggcaaacgggatcgaaccgatgaccccctgcttgcaaagcaggtgctctaccaactgagctatgcccccgttcttggtgggtctgggaggacttgaacctccgaccccacgcttatcaagcgtgtgctctaaccagctgagctacaaacccggattctcttcttaagcgaatcttgccttcactcaagcttcttccgcatctttttcagtttaccgataagtgtgaatgcctaaagcctcttctttctctagaaaggaggtgatccagccgcaggttcccctacggctaccttgttacgacttcaccccagtcatgaagcataccgtggtaagcggactccttgtggttatcctacctacttctggtatcccccactcccatggtgtgacgggcggtgtgtacaagacccgggaacgtattcaccgcagtatgctgacctgcgattactagcgattccgacttcatgcactcgagttgcagagtgcaatccggactacgatcggttttgtgagattggctccgcctcgcggcttggctaccctctgtaccgaccattgtatgacgtgtgaagccctggtcataagggccatgaggacttgacgtcatccccaccttcctccggcttgtcaccggcagtctcattagagtgcccaactgaatgatggcaactaatgacaagggttgcgctcgttgcgggacttaacccaacatctcacgacacgagctgacgacagccatgcagcacctgtgttacggctcccgaaggcactcctccgtctccggaggattccgtacatgtcaagaccaggtaaggttcttcgcgttgcatcgaattaatccacatcatccaccgcttgtgcgggtccccgtcaattcctttgagttttaatcttgcgaccgtactccccaggcggtcaatttcacgcgttagctacgctaccaagcaatcaggttgcccaacagctaattgacatcgtttagggcgtggactaccagggtatctaatcctgtttgctacccacgctttcgggcatgaacgtcagtgttgtcccaggaggctgccttcgccatcggtattcctccacatctctacgcatttcactgctacacgtggaattctacctccctctgacacactcgagtcacccagttcagaacgcagttcccgggttgagcccggggatttcacatcctgcttaagtaaccgtctgcgcccgctttacgcccagtaattccgattaacgctcgcaccctacgtattaccgcggctgctggcacgtagttagccggtgcttattcttcaggtaccgtcatcagccgctgatattagcaacagccttttcttccctgacaaaagtcctttacaacccgaaggccttcttcagacacgcggcatggctggatcaggcttgcgcccattgtccaaaattccccactgctgcctcccgtaggagtctgggccgtgtctcagtcccagtgtggcggatcatcctctcagacccgctactgatcgtcgccttggtaggcctttaccccaccaactagctaatcagatatcggccgctcgaatagcgcaaggcccgaaggtcccctgctttctctctcaagacgtatgcggtattagctgatctttcgatcagttatcccccactactcggtacgttccgatatgttactcacccgttcgccactcgccacccgagaagcaagcttctctgtgctgccgtccgacttgcatgtgtaaagcatgccgccagcgttcaatctgagccaggatcaaactcttatgttcaatctctaactttttaacttctggtctgcttcaaagaaaccaacaggacaatgttcaaaacattatcttgtctgtctttcaaacagtgtgagactcaaggcactcacacttatcggtaatctgttttgttaaagagcgttgcgaattataaagtattccttccgcctgtcaagatatctctcgatatccccaacattctgtgctatacttttcagttcgtccgccacttctgcagcagcgaagaaccgaactatacgcccacagggaaaaacggtcaatgcttttctgaagaaatttttttaaaaatatttatctatttgtttataaatttaatttatatcagtcaattttattttccatacagaattcttccagtgcccgatggatattttcagtctgccattcgttttttaagggtgcaacaatttcgatttgtcggttttggtagtcaaattgtattttccatgcatacagaaacatggtttcggattctgttccgccgtataagctgtcgcccagaatcggactgcccaaacttttcatcgccactctcaattggtgcgttttgcccgtatgcggttctaggatgaacagccgcagtttttcggcgatactgatgctgtggaatcgggtaacggcgatattttctgtattgcgcgtcaacttccacattccacatctggatttttccattccgcctttaatccaaccctgctttttggacggcttgcggtcggacagtgccaaataggtttttttgatgcttttgccggcaaactgtccgctaagggcggacgcgctttctttgttgagggcaaacagtaaaatgccgctggtctgtttgtccaatcggtgcagcagccacacacgctctacgcccaactgtatggcgagtgttcgggccagtccggtctcgccgctgtcttggtggacggatatgccgcccggtttgttgatggcgacgaagtcttgatggcggaacaaaatttccaacatatccatatatgccttgcaaaaatagaagggttcaattttcgtgttgatgttcggcaaggattttttcgtacacagcttgcggcacgtagcggtggatcgtttccgtccagccttccggcccgaccagtcctttgaccatagtggacgacacttcggcgatttcgcgcggcggcatgaggaatacggtggatatttcgggggcgaggtcgctgttgatatggcgcatggaacgttcgtattcgtaatccgaagcagaacggatgccgcgcacgatgaatcctgcatctacctcacgggcgtaatgcaccagaaatcggttttcaaatacatcggttctgacgttgggaaacattttagtaatatcgcacaacatatcctgcctttcagcgacggtataggtgctgcgtttgtcggggttaatgccgatggcgacgatgagttcgtcaaacatagattgcgcctgccgtatcatccacagatgccccaatgtgggcggatcgaaactgccggcataaacggcgcggcgcggtgtattcggtaacatttgattcctcccggcttcatagtcggctgtgtgttggtgcgtgtgcatccgtattgtatgcccaaagtaaaatgccgtctgaagcattttcagacggcatagtcggacggcgttttaccggcatcaatcctcgccgtttaaagacaacaggatgttcagcaggctgctgaagatgttgtaaagcgagataaacagtgtcagtgccgcgctgatgtggctgtcttcgccgccgtcgatgacggtgcgtacctgccacataatcattaaggaactgaacaagacaaaaccggcggaaatggtcagggcgagtgcgggaatacccaaaaacagattggcaaccacggcgaccatcagaatgaccgcacctacggtcaggaagcgtccgagcgcgttcatatcgagccgggttcggcgcgccaaggcggacatcgttaaaaagacggcggcggtcatcgcggcggcaatgccgacgattttcgcaccgtcggcaatatggagcgcgtattgcagcacggggccgatcaatacgcccataccgaatgtgaataccatcagcagggtaacgccggtattgctgtaacggtttttctcgatgaagtggatcataccgtagaaaaacgccaacacgacggcaaaccctatccagcgcgaaccgaaggcggcgtaaaaattgaaaccggcattggcggcaagtgccgcgcctgcggaagccggaataaatgaaaatccgagcaggcggtaggttttctgcaggacggtgtttttagaaaccgtatgcgcggtgtagtcgtaaacgtcgtgttgcatatcatctgctcctgaaagcgcggttgggaataatgggggattttaacattgcccaatgtcaaaatttgtccggttgcgtgaagataaagttgtccggcgtattttaaaggccgtctgaagcagtttcggacagcctgtgttcaaaacggaaaaccgttattgcggaacgtatccctgaacggcatccgcgccgtcgccgaagaaatactgctccatctgctgagccaggtattcgcgcgcgcgcggatcggcgaggcttaaacggttttcgttaatcagcatcgtttggtggcgcgtccacgccgcccacgcttcttgcgatacgttttcaaaaatgcgcttgcccaattcgttgggaagcggcggaaatttcatgccttcggcttctttgttgagcttgacgcagaataccatgcgtgccatagcggattcctttgctgtgttcagaaataacggggtgattttaaccgattagggatacggacaaaagccttcttattcccgatgatagggatggttgtgcaggatggaaacggcgcggtagagctgctcggtcagaaagacgcgcaccatgccgtgcggcagggtcaggctggacaggcgcatcatcatgcgtgcctgctgtttgaggcggtcggtcatgccgtccgcgccgccgatgacgaagcagacgtgttcgccgttttgccgccagcttttgaggtgttccgccagctcgacggaggtcggtgctttgccgcgttcgtcaagaacgacgaggaacgcgccttgcggaatggcttcaaggatgcgtttttcttccgccgccataccttgggcggcattcacgcccgcgccgcgtttttcgggtttgatttctttgagtgcgtaggcgacgtcgcgtccgaagcgtttggcgtattcggcgacggcctcatcaacccagcgcggcattttggtgccgactgccaaaacggtgatgttcaatgctttctcccttacaggaaaatgccgtctgaaggttcagacggcatcgggaatcagtctgccgcgtgccacggcttctgcattccggcgtggaaactcggtttctcgccgccccagagggtgtcgatgtcgtagaagtcgcgcacggcagggagcatgacgtggacgacgaggtctcctgcatcaaccagcgtccattcgccgctgtcgccttcggtactgaggatttcaaaaccggcttctttcaaatcgacggcaacgttgttggccagtgctttgacttggcgcgtactgtcgccgctggcgataatcattctggcaaacagcgaagttttgtcttgggtttcgagaacggaaatgtctttggctttgatgtctccgagggcgttgacggcgaccccgaccattttttgcaggtcttgcagttcttgttcgttcattattttcctaacgggatgttttcagacggcattatagccgtttcttactgatttgactttatttttcatacaaaccgtgttcgcggatgtagcgtgcggcggcaggcgggatgccgtctgaaacgccttggccggcaaggttgcggcggatttccgttgacgacacattatgcatcggggcggacaagatgcggacgctgccgtcctgaagggacttgcccagccacgcgtgcagttcgcgcggggtttggtgcaggctgtcgccctgcctcatggcgacggcgatattggtttcgcgcacgagcatctgccattttttccatgtgtgcagcttcatcaggctgtcgctgcccatcagccaccagagttgcgcggatgggaactgctggcggaagatttggacggtatcaaaagtataggttgcaccttctcggacgatgtcgcaatcgctgacggcaaaacgcgcgtcttctgccgtcgccaattcgaccatggcaaggcggtcggcggcggaagcggaggctgcgtctttgtgatacgggccgcctgtcggcaggaaaacaaccgcgtccaagccgatttcgtcggcaaaggcacgggcgatatgaagatgtccgttgtgtatcgggtcgaaagtaccgccgaacaatccgattttcttcatgatgtttccattccttccgataagtccatgccgtctgaaacactgccgtccacaaccagcgtcagtttgccggtaacgggatggatgaccagtccgtgaacggcgatatggcgcggcatcagcggatggttacggataaggtccaccgtgtggcgcacgctgtcttcgacgttgtcgaaaccggtcagccagccgtcgaggtcgataccggcataacgcagggtttcgatacggtcttcgggaatccggctttcccggacgcgcccgaggaattcttcggcattcagcccctgcataccgcaatcgtgatgggcgatgaccataatctctctgaccttcagttcaaacacggcaaccaaaaggctccgcatcaccgaaccccacgggtgcgtaaccagcgcgccggcatttttaatcagcttggcatcgccgtttttcaaacccaacgcgtcgggcagcagcccgataatccgcgcatccatacaggacaaaactgccagcccgcgttcggggtatttgtcggtaaagtatttttcatattcgcccgactcgacaaactgccggttatgggcaaggatgttatccaactcgctcattttgccgtcctctgaaaaagggttcacattataacgtttccgtctgttttccgccttcgccgccgtccaacagcaggaaaatacccagcgcgaacgccgccaacagcaatgtcagcaccatcgcccgcgcgtaattatcctcacccgcgcgtcccaaataggcataaatcaaagtcgtcagcgtctgccattccggacgcgacagaaacaatgtcgccgcaaattcgcccacgcaggttgccgccgccaaagtcagaccgcgccgcaacgccggtttcaagagggggaacgtgatgcggcatgccgtctgaaagccgtttgcacccaaacccgccgccgccctgccgtaatccggcggcagtgcatcccaggctgataaaacatcttttgccacaaacggatacgccagcagcgcatacatcgccagcagcaacggcaacgaagccgtccactgcggataaagcagcagcacgcccgccgaaacacaaaccggcgacaccataaacggcaaaaacatcagcccgcgcatccacgccgaccgccgcgccgccgccgcatacaccacacccaaaaccgccgccgcatacaccgccgccgccgagaagcgcaaagtattccacaccgcctgccacgtttcactttccattaacacacgccacgattcgccggccgaccacgctttcacaacaattgccaacaaaggaaacaggcagcacacagacaacaccgccgccgcaaacgccagcagcacatattccccgaccgactgcggcggcgacggcatcacaggggaaaccgccttatccgaaaccgcgcgcctgccgaaccacgcatacagcaaccctgccgccgccgttacccccaacaccagccacaccagcaccgaagcaaccgccatatcgagttcgaacatgaccaactggtaaatttccacttcgaccgtggcataacggctgccgcccagcagcagcgccagcccgaacccggaaaaacaatacagaaagacaaggcacacgccgccggcaagccacgggcgcaaaacgggcatttcaatgtcccaaaaccgccgccacgcccccgcgcccaacgtccgtgccgtctgaagccgtgccgcaggcacttgcacaaacccctgatacgccgccctgaccaacacaggaaggttgaaaaacacattgccgtacaacaacagatacggcgtatcctgcctgccgcgccacaacagcccgtccgccccgaacagggccagcacgcccacgcccgccaccaacgtgggcatcacaaaaggcagcatcagcaggcgcagcaccaaagcccgccccggaaacgccagccgcgccagcacccacgcgacaggcacgcccaaaggcagcaccagcacacaggttgccgctgcctgaaataccgtccacgccaaacgtttgagcatataggcatccgacagcaccgcgcgccacgccaaaccgtcatacgccgccaccgcccacaaaggcgcaacgaccattaccgccaaaaaagccgaaggcagcagggcaaaagcaccccataccacccaacgccgtccatccatcgccttccccacttgaaacactgatgttgcgattgtacccaaaagcccccacataccgtatatttcaatccgactacataccgtatccgccttcctcccgccgtctgaaatatagtggattaacaaaaatcaggacaaggcgacgaagctgcagacagtacaaatagtacggaaccgattcactcggtgcttcagcaccttagagaatcgttctctttgagctaaggcgaggcaacgccgtactggtttttgttaatccactataaatcgttcaaataaacaggaatataacttcagacaaacaacttaccgcccgatttgtgctatcgttttcgcacaacttaaaaaaacctgacaattttgtacttttattacagagaaaggctttacaaatggacggctggacacagacgctgtccgcgcaaaccctgttgggcatttcggcggcggcaatcatcctcattctgattttaatcgtcaaattccgcatccacgcgctgctgacactggtcatcgtcagcctgctgacggctttggcaaccggtttgcccacaggcagcattgtcaacgacatactggtcaaaaacttcggcggcacgctcggcggcgtggcgcttctggtcggcctgggcgcgatgctcggacgtttggtcgaaacatccggcggcgcacagtcgctggcggacgcgctgatccggatgttcggcgaaaaacgcgcaccgttcgcgctgggcgttgcctcgctgattttcggcttcccgattttcttcgatgccggactaatcgtcatgctgcccatcgtgttcgccaccgcacggcgcatgaaacaggacgtactgcccttcgcgcttgcctccatcggcgcattttccgtcatgcacgtcttcctgccgccccatccgggcccgattgccgcttccgaattttacggcgcgaacatcggccaagttttgattttgggtctgccgaccgccttcatcacatggtatttcagcggctatatgctcggcaaagtgttggggcgcaccatccatgttcccgttcccgaactgctcagcggcggcacgcaagacaacgacctgccgaaagaacctgccaaagcaggaacggtcgtcgccatcatgctgattcccatgctgctgattttcctgaataccggcgtatcggccctcatcagcgaaaaactcgtaagtgcggacgaaacctgggttcagacggcaaaaataatcggttcgacaccgatcgcccttctgatttccgtattggtcgcactgtttgtcttgggacgcaaacgcggcgaaagcggcagcgcgttggaaaaaaccgtggacggcgcactcgcccccgtctgttccgtgattctgattaccggcgcgggcggtatgttcggcggcgttttgcgcgcttccggcatcggcaaggcactcgccgacagcatggcggatttgggcattcccgtccttttgggctgtttccttgtcgccttggcactgcgtatcgcgcaaggttcggcaaccgtcgccctgaccaccgccgccgcgctgatggctcctgccgttgccgccgccggctttaccgactggcagctcgcctgtatcgtattggcaacggcggcaggttcggtcggttgcagccacttcaacgactccggcttctggctggtcggccgtctcttggacatggacgtaccgaccacgctgaaaacctggacggtcaaccaaaccctcatcgcactcatcggctttgccttgtccgcactgctgttcgccatcgtctgacagacggaaaggatagtaaatgactacgcattttgtcgttatgggcgtatgcggctgcggcaagaccaccgccgcgctgtccctgcagaaacacctcggtcaatgtccctatgccgaaggcgacgagttccacacccaagccaaccgcgacaagatgggcgcgggtattccgctgaccgatgaagaccgctatccgtggttgggcaatctgcgcgactggatgacgcaacaggcgcaaaacggtgcgaaccacaccatcgtaacctgttccgccctcaaacgcggctaccgcgacattctgcgcggagccgaaggcaaagctgccttcatccacctcagtccgccgcaagacatcaacctcgagcgcatgatgtcgcgcaaaggacattacatgaaagcagggatgctcgattcgcaactggaaatcctcgaggaactgggcgaaggcgaatacggggtcaaaatcgccaaccccggcacgcccgaagcggtcgaagccgatattctgaactgggttgcctcggaaaacctgctttgaagcaatatgccgtctgaagcccgacacaggatgggtttcagacggcataaacatcgggaacagaatggattacattgatttatagtggattaacaaaaaccagtacagcgttgcctcgccttagctcaaagagaacgattctctaaggtgctgaagcaccaagtgaatcggttccgtactatctgtactgtctgcggcttcgtcgccttgtcctgatttttgttaatccactataaaatggaaaatacccggctatcgtctcattttcgttttaatcagccataaaaatgccgtctgaaaccctttcagacggcatttctgtcaaacgccggacgcactcaacccaaactcaacagcaggttgcggaacgcgttcgggtctttgataaacgtcatctcgcccgcctgcggaaaatgaaaatccaacaggcgcgacacccaaaaacggatgcagccggcacgttgggcggtcgggaaatacgccttttcttcggcactcaaggggcgcacgccctcataaccgccgataaacgcctttttcaacgcctcatccaacttattgtccgccgtccttgcccaatcgttgaccgcaatcgccaagtcatacataaaattgccccggcaggcgtaatagaaatcgatgaagcccgatacctgaccgccgtcaagcaacacattgtctttaaacagatcggcatggatgatgcccgaaggcagatgattgccgagattgtccttcaacgcatcgatttcggaacacagcagtgcggcatcgtcttgcgacaggacgggcagcagccgggcgcacgcctccgtccaccacgcattgtaacgcgggttttccatttccaaagggaaatcggcggcggcaaggtgcattttcgccaacatcgcaccggtatgaaaacactgctcagccgtcggcagcgcggtatccgaacctttcaggcaggcaaccaggcaggcaggcttacccgccaaaacggaatcaagccggccgtctttgcgcgcaaccggcgcggcaaccgccacgcccttcatactcaaatgccggttaagctccagaaaaaacggcagctcttcctgtttcaacacttcaaacacggtcagcacataacgtcccgaagtcgtcgtcagaaaataattgctgttggtaatcccctgcgcgatgccctgcagggaaacaaattcccccaaatcgtaaccgctcaggaagccgcgcatttcatcatcggaaacactggtatagacagacatatcaactcacttgctcaaaaacgggcaaacccgccgtcagaacgccggacggcaggcaaacatataattcacatcggtcgaatcgcacagggcataagtttgcgacaacacatggtaagtcatacccttcgtatccgccacatccaagcctgcctgacggcacattcgcgccagctcggcaggtgcgatgaattttttccagtcgtgcgtgcctttggggacaaacttcaacagatattccgccgccacaatcagatgcaggtacgatttcgggtttttattgatggtggaaaaaaacaccatgccgtccggtttgaccagattggcacaagcacgcacgatggcggcgggatcggggacgtgttccatcatttccatgcacgttaccacatcgaacgagtgcggttccgcctcggcaaggtcttccacgcggatacattcgtattcgatatcggcgacattgttcaaagccgcgtgcaggcgggcggtttccaacgactgctccgccatgtcgatgccctttacaaacgccgcgccgcgccgcgccatactttccgccaagatgccgccgccgcagcccacgtccaaaacccgtttgccgcacaaatccgcgtgtccgtcgatataatccagccgcagcggattgatgtcgtgcaaggttttgaactcgcccgacttgtcccaccatttgtcggcaatccggctgaatttggcgatttccccctcatcgacattatattttttgtcggacattttccctcccatctgacgaaccgcccactccaaaacccaagattatactatggaacacaatgccgtctgaaagccttttcgggcggcgcggcgcaaataccttacaaatccttacactttacggcataatggcggctcgctttttctggcagaaagacaaaatatgcccaacaaaaccccttcactgttcggcggcgcgatgattatcgccggcacggtcatcggcgcaggcatgctcgccaacccgaccgccacatccggcgtatggtttaccggctcgctggccgtgttgctgtacacctggttttctatgctttccagcggcctgatgattttggaagtcaacacccattatccgcacggcgcaagtttcgacacgatggtcaaagacctgctcggacgcggctggaacatcatcaacggcatcgccgtcgccttcgttttatacctgcttacttacgcttatatcttcgtcggcggcgacctgaccgccaaaggcttaggcagcgcggcaggcggcgacgtttcactcaccgtcggacaactcgtcttcttcggcatcctcgccttttgcgtatgggcatccgcacgcttggtcgaccgcttcaccggcgtccttatcggcggcatggtattgacctttatttgggcggccggcgggctgattgccgatgccaagccgtccgtcctcttcgatacccaagcccccgccggcacaaactactggatttacgccgccaccgccctgcccgtctgcctcgcttccttcggcttccacggcaacgtctccagcctgctcaaatactttaaaggcgacgcgcccaaagtggctaaatccatctggacgggcacactgattgcgctggtaatttacgtcctctggcaaaccgccatccaaggcaacctgccgcgcaacgagttcgcccccgtcatcgccgccgaagggcaagtctccgtcctcatcgaaaccctgtccaaattcgcccaaaccggcaatatggacaaaatattgtccctgttttcctatatggcgatcgccacctcgtttttaggcgtaacgctcggactcttcgactacatcgccgacatcttcaaatggaacgacagcatctccggccgcaccaaaaccgccgcgctgaccttcctgccgcccctgatttcctgcctgctcttccccaccggcttcgttaccgccatcggctacgtcggcctggcggcaaccgtctggacaggcatcatccccgccatgctgctctaccgttcgcgcaaaaaattcggcgcaggcaaaacctataaagtttacggcggcttgtggctgatggtttgggtcttccttttcggcatcgtcaacatcgccgcacaggtattgagccaaatggaactcgtccccgtatttaaaggataaaggcaaaatgccgtctgaagcccgccggcggcttcagacggcattgccgcaacaaacggcaaccgtattccggcacacagcgcattaccctgcccctcacgcacaaatcccgccccgacaaaccgggacgcaaccataaaggaacaatgatgaagctcaaaatagacattgcaaccaacaacttcaaacacggcggcggcacggaacgctacacattggatttggtaaagggtctgaacagacaaaacatcacaccggccgtttatgcgacgaaatttgatcacagcattcctgaatacgccctaatcgaaccccatcttgtcgatcaacaccggacgctgaaaaaactacgctcattcctcttttcaagccggctcgctcaaaccagaaaaaacagtgccgccaaactgattgcctgccaccacgccgattacgccgacctcctcatctgcggcggcacacacttgggctacctgcaccatatggcgcaaaaaccgaacctgctcgaccgcctcgccatacgccgcaaccgcagcaactacgccaccgccaaactgattatggcgcattcccatatgatgcggcgcgaactggtcggactgtacggcgttccccctgaaagaatccaagtcgccccccccccccgcagatacggaacgcttctttccacaacccggagaaactgccgacctgcgcgccaaatacggctttgccgaccatgaaaccgttttcctgttcccatcgaccggccacacgcgcaaaggtctggaactgcttgccgactttttcgaacataccagcctgcccgtcaagctcgccgttgtcggctccccgcttccccgccctatgaaaaacgtcgtcggactgggcttctgcaccgatatgcccgaactctaccgcgccgccgactttaccattatggcttccctgtacgaacccttcgggctggtcggcgtcgaatccgtcctatgcggcacacgcgtcgtcctctccgaaaacatggcatgtacagaggtcatgaacgaagaagccggcttctttttctcacgccaaaacccggaaaccctggcgcaagccgttgcccaagccgtcagccttaaaaaacagggcggacaccgcctgtccgacccgatgcgggcactgaactacaacccggctttagacaaacacatcgggctgattcttgaaatgcttgccgcctgaccgcgtccccaaacggcattgccccgcaacttccgcgccgagacttttgcagcggaaaatacgtccggcagaaaatccgccgttgcaggagcaggcaggaaaacatcggcaaccgcccccgaaacgccgtacccgcgcattgcaagcggttgccggaacaggcgcgttatcgcgcggcacaggcgcatttccaccgatatttcagtataatgccacccccgacctgccccaatccaaaggaaacgcgatgaaactcatcattctcgaccgcgacggcgtcatcaatcaggaccgcgacgacttcgtcaaatccgttgacgagtggatacctgtcgaaggcagcatggatgcggtggcatttctgacgcaggcaggctacaccgtcgccgttgccaccaaccaatccggcatcgggcgcaaatattttaccgttcaaaaccttaccgaaatgcacgccaaaatgcaccgcctcgtccgtcaggcaggcggcgaaatcaacggcatctggttctgcccgcacaccgatgccgacaactgcaactgccgcaagcccaaaccgggtatgattgaagacatcatcggacgcttcaacgcccaagcctcggaaacctggctggtcggcgacagcctgcgcgatttgcaggcaatcgatgccgtcggcggcaaacccgcgctggttctgaccggaaaaggcaaaaaaacgctctcccaacacggacacgaattgcccgaacacacacaggttttcgataccctgctcgatttctcacaatacatcatgcaggaaaacaccgcaccgcaagccgactgaacataccgcattccgacaaggcaaaaccatgctcatcatccgcaacctgatttactggctgatactctgttccaccctgattttcctctttccctttatgctgctcgcctcgcctttccgggacggggcgcacaagatggcgcgggtctgggtcggcattctcaactggtcgctcaaacacatcgtcgggctcaaataccgcatcatcggcgcggaaaacatccccgaccgccccgccgtcatctgcgccaaacaccaaagcggctgggaaacgctcgcccttcaggacatttttccgccgcaggtttacgttgccaaacgcgagttgttcaaaatcccctttttcggctggggcttgaaactggtcaaaaccataggcatagaccgcaacaaccgccgcgaagccaacgagcagctcataaaacaggggttggtgcgcaaaaacgaaggctattggattaccattttccccgaaggcacgcgccttgcgcccggaaaacgcggcaaatacaaactcggcggcgcgcgcatggcgaaaatgtttgagatggacatcgtccccgtcgccctcaacagcggcgaattttggccgaaaaactcctttctgaaatatccgggggaaatcaccgtcgtcatctgtccgaccatcccgcacgcaagcggcagcgaagccgaattgatggaaaaatgcgaacatctcatcgaaacgcaacaaccgcttatttccggcgcaggcccgtttgccgccaaaatgccgtctgaaaccgcatgaccgcctttgtccacaccctttcagacggcatggaactgaccgtcgaaatcaagcgccgtgccaagaaaaacctgattatccgccccgccggcacacataccgtccgcatcagcgtcccaccctgcttctccgtctccgctctaaaccgctggctgtatgaaaacgaagccgtcctgcggcaaacactggcgaaaacaccgccgccgcaaactgccgaaaaccggctgcccgaatccatcctcttccacggcagacagcttgccctcaccgcccatcaagacacgcaaatcctgctgatgccgtctgaaatccgtgttcccgaaggcgcacccgaaaaacagcttgcgctgctgcgggactttttggaacggcaggcgcacagttacctgattccccgcctcgaacgccacgcccgcaccacacaactgttccccgcctcctcctcgctgacctctgccaaaaccttctggggcgtgtgccgcaaaaccacaggcatacgcttcaactggcggctggtcggcgcaccggaatacgttgccgactatgtctgcatacacgaactctgccacctcgcccatcccgaccacagccccgccttttgggaactgacccgccgcttcgccccctacacgcccaaagcgaaacagtggctcaaaatccacggcagggaacttttcgccttaggctgacgcggaccggaccgacccgccgctttcagacggcatccgtgccggaacaggcacgcgcccgcccgattcaaaccgcgatgacgctttgccgccggttcggggcaggatggcggcacacacgccgtctgccgcgtttcatttcacaccgctcttccgaaacccgaaacccgcccggtccgacgtgcggtatgaaacgcttaagctgacgcgaagtcttttactgatttgcccgcgaaaatgccgtctgaaaggttttcggacggcattttttttgcgtttcccaggatggcggcggattcgtaaaaggcggtcagggtggattgtaggatgggttgagacctgccgaatccgccgcatctgccaaatctaccgccgtcattcctacgaaagtgggaatctagaacgcggggttaagaaaacctgcatcccgtcattcccacgaaagtgggaatccagttttttgagtttcagtcatttccgataaattgccttagcattgaatgtctagattcccgactgcgcgggaatgacgaatccatccatacggaaacctgcaccgcgtcattcccacgaaagtgggaatccaggacgaaaaatctccagaaaccgttttatccgataagtttccgcactgacagacctagattcccgcctgcgcgggaatgacgaatccatccatacggaaacctgcatcccgtcattcctacgaacctacattccgtcattcccacgaaagtgggaatccagaatcccagactttcagataatctttgaatattgctgttgttctaaggtctagattcccgcctgcgcgggaatgacgggatttgaggtttctgttcgcgtcattcccacgaacctgcatcccgtcattcccacgaaagtgggaatctagttttgtcggtgcggaaacttatcggatatagtggattaacaaaaatcaggacaaggcgacgaagccgcagacagtacaaatagtacggaaccgattcacttggtgcttcagcacctgagagaatcgttctctttgagctaaagcgaggcaacgctgtactggtttttgttaatccactataaaatggtttctttagattttacgtcctagattcccgcctgcgcgggaatgacgattcgggcactcctgacagggtaaattcacaggatagcgattcgtagcaactgcatcccccccccccaacaactccccaaacaacgccgctcgccctgggcgtttgccgtttccctgcaaaatctgcgatacaatgcagtctgaacatttatccgaatcccaaatccgatggataccgcacaaaaacaacgctgggcaataaccctatcctatgacggcagccgcttttacggctggcagaaacaggctgacggcgtaccgaccgttcaggcggcattggaaaccgcgctcgcccaaatagcaggggaagcggtttccaccaccgttgccggcaggaccgacaccggcgtgcatgccaccgcccaagtcgtccacttcgacacaactgccgcccgtccccaacaggcatgggtgcgcggcgtaaatgcccacctgcccgaaggcattgccgttttgcacgcccgacaggtcgcccccgaatttcatgcacgatttgacgcatacggacggcactaccgctacctgctcgaatccgcccccgtccgttcccccctgctcaaaaacagggcaggctggacacacctcaaactcgacatcgggcagatgcggcaggctgccgccttattggtcggcgaacaagacttctccagcttccgcgccgccgaatgccaagcaaaatcccccgtcaaaaccatctaccgcgccgaccttacccaaagctcaggactcgtccgcctcgatttgcacggcaacgcctttttgcaccacatggtacgcaacatcatgggcgcgctcgtttatgtcggcagcggcagactcagcgtcgaaggcttcgccgcactgattcaagaacgcagccgcctcaaagccccgccgaccttcatgcccgacggactttacctgaccggcgtcgactatcccgaggcatacggcatcatccgcccccaaatccccgaatggctttaaaacatgcttgtcgcggagattttgaaatcggacaaactgtcaggcaatctttttccatgttgacactacctcatcaaggtactaacattgttattacataaacaggtgaatatggtacgtatatgattctcaacatacgcaaaatgggaaactcgcaaggcgtgattctgcccaaatcattattgggtcaaataggggcagtagacagcttggctgttacagttgaaaagggcaatattattttaagctgtcctaccgttcgcaggggatgggcagaagctgccgcaatgcttgtcgaaaccgagcaggagcattttttttccgaaattgaaaacgaagcggataaagaatggatatggtagtacgcggcggaatctatctggtctccttagacccgaccgtaggaagcgaaatcaaaaagacacgtccttgtgtcgtagtctctcctcctgaaatacacaactatctcaagactgtgctgatcgttcccatgacgagcggaagccgtcctgccccgttccgcgtcaatgtccgctttcaggataaagacggtttgcttttgcccgaacagattagggctgtggataaagccggattggtcaaacatcttggcaatttagacaacagtacggctgaaaaactgtttgcagtattgcaggagatgtttgcctgattgaatagtctgaatggattgtgttcattatagtggattaactttaaaccagtacggtgttgcctcgccttagctcaaagagaacgattctctaaggtgttgaagcaccaagtgaatcggttccgtactatttgtactgtctgcggcttcgtcgccttatcctgatttttgttaatccactataaagaccgtcgggcatctgcagccgtcattcccgcgcaggcgggaatctagaacgtggaatctaaagaaaccgttttacccgataagtttccgcaccgacagacctagattcccgcctgcgcgggaatgacgggattttaggtttctaattttggttttctgtttttgagggaatgacgggatgtaggttcgtaagaatgacgggatataggtttccgtgcggatggattcgtcattcccgcgcaggcgggaatctagaacgtggaatctaagaaaccgttttatccgataagtttccgtgcggacaagtttggattcccgcctgcgcgggaatgacgggattttaggtttctaattttggttttctgtttttgagggaatgacgggatgtaggttcgtaggaatgacgggatataggtttccgtgcggatggattcgtcattcccgcgcaggcgggaatctagaccttagaacaacagcaatattcaaagattatctgaaagtccgagattctagattcccgcctgagcgggaatgacgaaaagtggcgggaatgacggttagcgttgcctcgccttagctcaaagagaacgattctctaaggtgttgaagcaccaagtgaatcggttccgtactatttgtactgtctgcggcttcgtcgccttgtcctgatttttgttaatccactctaaagaccgtcgggcatctgcagccgtcattcccgcgcaggcgggaatccagaccttaaggcagcggcaatattcaaagattatctgaaagtccgagattctagattcccgcctgagcgggaatgacgaaaagtggcgggaatgacggttagcgttgcctcgccttagctcaaagagaacgattctctaaggtgctgaagcaccaagtgaatcggttccgtactatttgtactgtctgcggcttcgtcgccttgtcctgatttttgttaatccactatctcctgccgcaggggcgggttttgcatccgcccgttccgaaagaaaccacgtgcgcgttttttgccgtctttataacccccggtttgcaatgccctccaataccctcccgagtaagtgttgtaaaaatgcaaatcttaaaaaatttaaataaccatatgttataaaacaaaaaatacccataatatctctatccgcccttcaaaatacacatcgaattccacacaaaaacaggcagaagtttgttttttcagacaggaacatctatagtttcagacatggaatcgccgaaaacgtcggcggtaaatgcaaagctaagcggcttggaaagcccggccggcttaaatttcttaaccaaaaaaggaatacagcaatgaaaaaatccctgattgccctgactttggcagcccttcctgttgcagcaatggctgacgttaccctgtacggcaccatcaaagccggcgtagaaacttcccgctctgtatttcaccagaacggccaagttactgaagttacaaccgctaccggcatcgttgatttgggttcgaaaatcggcttcaaaggccaagaagacctcggtaacggcctgaaagccatttggcaggttgagcaaaaagcatctatcgccggtactgactccggttggggcaaccgccaatccttcatcggcttgaaaggcggcttcggtaaattgcgcgtcggtcgtttgaacagcgtcctgaaagacaccggcgacatcaatccttgggatagcaaaagcgactatttgggtgtaaacaaaattgccgaacccgaggcacgcctcatttccgtacgctacgattctcccgaatttgccggcctcagcggcagcgtacaatacgcgcttaacgacaatgcaggcagacataacagcgaatcttaccacgccggcttcaactacaaaaacggtggcttcttcgtgcaatatggcggtgcctataaaagacatcatcaagtgcaagagggcttgaatattgagaaataccagattcaccgtttggtcagcggttacgacaatgatgccctgtacgcttccgtagccgtacagcaacaagacgcgaaactgactgatgcttccaattcgcacaactctcaaaccgaagttgccgctaccttggcataccgcttcggcaacgtaacgccccgagtttcttacgcccacggcttcaaaggtttggttgatgatgcagacataggcaacgaatacgaccaagtggttgtcggtgcggaatacgacttctccaaacgcacttctgccttggtttctgccggttggttgcaagaaggcaaaggcgaaaacaaattcgtagcgactgccggcggtgtcggtctgcgccacaaattctaatctgcaaagattggtatcaacaaaaagcctgtcgccagacaggcttttttctgtttggctttttcctgttttctgtttggctttttcctgttttctgtttcgctgttttctgtttcgctgttttctgtttcgctgttttctgtttcgctgttttctgtttcgctgttttctgtttcgctgttttctgtttggcttttttctgtttggcttttttctgtttggctttttcctgtttttagtcttttttattcaatgtcaaaatatgccgtcattcccgcgcaggcgggaatctagtgcgttgagtttcagctatttagaataaattttgaaactttaatcccgtcattcccacgaaagtgggaatccaggacgcaaaatctcaagaaaccgttttacccgataagtttccgcaccgacagacctagattcccgcctgcgcgggaatgacgggatttgaggttgcggcatttatcgggagcaacagaatccgctctgccgtcattcccacgaaagtgggaatctagttcgttcggtttcgcttgttttaagtttcgggtaacttccacttcgtcattcccgcgcaggcgggaatccagtgcgttgagtttcagctatttagaataaattttgaaactttaatcccgtcattcccacgaaagtgggaatctagttttttgagtttcagtcattcccgataaattgccttagcattgaatgtctagattcccgcctgcgcgggaatgacggcggaaagattctatttttcccgataatcgcccacaatctcaaattccttcattctctcaaaaacaaaatcagaatcctaaatcccatcatccccatctatgtgaatataaaaattttaaaaattatagtggattaacaaaaaccagtacggcgttgcctcgccttagctcaaagagaacgattctctaaggtgctgaagcaccaagtgaatcggttccgtactatctgtactgtctgcggcttcgtcgccttgtcctgatttttgttaatccactatattttcacaagcgaaagaatgccgtctgaagccttttttccggttttcagacggcattttttgcttgacgtttaactgtaaatcttcgcgccttttttgacgaactcgaccgctttttcctccatgccctgccgttgggctttttgcttgtcggcgtagtcgcgcacttcctgcgtgattttcatcgagcagaatttggggccgcacatcgagcagaagtgggcgattttcgcgccttcggcaggcagggtttcgtcgtggaagctctcggcacgttcagggtcgaggcttaagcgaaattggtcgcgccagcggaactcgaaacgcgctttgctcagggcgttgtcacgtaattgtgcgcccggccagcctttggcgagatcggcggcgtgggcggcgagtttgtaggtgatgatgccggtgcgcacgtcttctttgtcgggcagccccaaatgctctttcggggtaacgtaacaaagcatcgccgtgccgtaccagccgatattggccgcgcctatgcccgaggtgatgtggtcgtagccgggtgcgatgtcggtaacgagcgggccgagcgtgtaaaaaggtgcttcaaagcagtgttgcagctcttcggtcatgttttctttgacgcgttgcagcggcacatggccggggccttcgatcatgacttgtacgtcatgtttccacgctttatcggtcaattcgcccaaggtgtgcagttcggcgaattgggattcgtcgttggcatcggcaatgcagccggggcgcaggccgtcgccgaggctgaacgatacgtcatacgctttcataatttcgcagatttcgtcgaaatgcgtgtagaggaaattttcccgatgatgtgccaaacaccatttcgccataatcgaaccgccgcgcgagacgatgccggtgaggcggttggcggtcatcggcacataacgcagcaacacgcccgcgtgtatggtgaaatagtccacgccttgctccgcctgttcgatgagggtgtcgcggaacaaatcccaagtcaaatcttcggcgatgccgccggttttttccaacgcttggtaaatcggcacggtgccgatggggacgggcgcgttgcggataatccattcgcgcgtttcatggatgtgcgcgccggtggacaaatccataatcgtgtccgcgccccaacgcagcgaccacaccattttttcgacttcttcggtcaggctggaggtgacggcggagttgcccaagttgccgttgattttgacacgaaagttgcggccgataatcatcggttcgagttcggggtggttgatgttggcgggaataatcgcgcgtccggcggcgatttcttggcgcacgaattcgggcgtgatttggtcgggatgggtcgggatgttcgcaccgaaactttgccccgcgtgctgttccaagagtttggcgtattccggtttttgggacaattcgtctaattttaaacgttcgcgtatggcgacaaactccatttcgggcgtgataatgccttggcgcgcgtagtgaagctgggttacgttgctgccgcttttcgcgcggcgcgggcgggtgatttggttgaaacgcagatgggcggttttcggatcgtgtgcgcgttcgatgccgtattcgctggagagcttgggcaggatttcggtatcgccgcgttcgtccagccacgcggtgcggatgtgcggcagaccttgtttcaggtcgatatgcgccgccgggtcgccgtacacgccgctggtgtcgtagacgggaatcggcggattggcttccgtaccttgcgccgtgtaggtgtcgtcctgacggatttcgcgcaaaggcacgcggatgtcgtcgcggctgccttgcagatacacgcgttccgagttcggatatttaaagcagatgccgatgtcttcgctcaagtcggcaagctcgcgcgcttcgttgccggaagttttggcggttttttttggcgtagtcataaaaaaatgctcctgttttctcgtttagaattaaagaaacaggagcgttttgcgttttcagacggcatttgaaaaccaatgccgtctgaaaagcagaatccgtgaaaactccccacgcaggtattatcccgatcgggtgtaaagggtatttctcagccgcctaaacatcaggcagcacccctgtttcaatgttaaccaaaattaaatcacgaacatgaacttttgtaaagaaaataatatttcaaatcaggcataaaccgccggacggcaaaattttatgatttttcgcggaagtaatgtttgacaacataaaaaatctgccgtatagtttcatcttctgacgcgggatggagcagcatggtagctcgtcgggctcataacccgaaggtcgtaggttcgaatcctgctcccgcaaccaaatatcaaacccctcggttcaatgccgaggggttttgttttgcctgtttcctgtttcctgtttcctgccgcctccgttttttgccggattttccttccggccgcaatatcggaacggcagaccgccgtctgtttgcggttgcaaattcaggcagtttggctacaatcttccgcattgtcttcaagaaagccaaccatgccgaccgtccgttttaccgaatccgtcagcaaacaagaccttgatgctctgttcgagtgggcaaaagcaagttacggtgcagaaagttgctggaaaacgctgtatctgaacggtctgcctttgggcaacctgtcgccggaatgggtggaacgcgtcaaaaaagactgggaggcaggctgctcggagtcttcagacggcatttttctgaatgcggacggctggcctgatatgggcggacgcttacagcacctcgccctcggttggcactgtgcggggctgttggacggctggcgcaacgagtgtttcgacctgaccgacggcggcggcaaccccttgttcacgctcgaacgcgccgctttccgtcctttcggactgctcagccgcgccgtccatctcaacggtctgaccgaatcggacggccgatggcatttctggataggcaggcgcagtccgcacaaagcagtcgatcccaacaaactcgacaatactgccgccggcggtgtttccggcggcgaaatgccgtctgaagccgtgtgtcgcgaaagcagcgaagaagccggtttggataaaacgctgcttccgctcatccgcccggtatcgcagctgcacagcctgcgctccgtcagccggggtgtacacaatgaaatcctgtatgtattcgatgccgtcctgcccgaaaccttcctgcctgaaaatcaggatggcgaagtggcgggttttgagaaaatggacatcggcggtctgttggatgccatgttgtcgggaaacatgatgcacgacgcgcaactggttacgctggacgcgttttgccgttacggtctgattgatgccgcccatccgctgtccgagtggctggacggcatacgtttataggatgcgccatgcttgaactgaacggactctgcaaacgcttcggcaataaaaccgtcgccgacaacatctgcctgactgtcgggcgcggcaaaatactcgccgttttggggcggtcgggctgcggaaaatccaccctgctgaatataattgcggggattgtccggccggacggcggggaaatatggctgaacggagaaaacattacccgtatgccgcccgaaaaacgccgtatctcgctgatgtttcaagattacgcgctgtttccccatatgagtgcgctggaaaatgcggcattcggtttgaaaatgcaaaaaatgccgaaagccgaagccgaacgcctcgccatggcggcacttgccgaagtcggactggaaaacgaggcgcaccgcaagcctgaaaaactttccggaggcgagaagcaacggctggcgttggcgcgcgctttggttgtccgcccttccctgctgctgttggacgaatcgttttccagtttggacacgcatttgcgcggcacgctgcgccgtatgactgccgaacgtatccgaaacggcggcatccctgccgttttggtaacgcattcgcccgaagaagcctgtacgacggcagacgaaatcgccgtgatgcataaagggaggattctacaatacggtacgcccgaaacattggtcaaaacaccatcctgcgtgcaggtcgcccgactgatgggtttgcccaataccgacgataaccgccatattccgcaacatgcggtgcgtttcgaccaagacggcatggagtgccgcgtattatcccgtacctgtttgcccgaatcgttcagcctgtccgtcctccatccggaacacggcatcctgtggctgaacctcgatatgcggcacgccggggcggtatcgggcaaggatacggtacgcatccatatcgaagaacgggaaatcgtccgcttccgctgatgcttcttaaaaacaaaatgccgtctgaaaacctttcagacggcatttttttaccaaagcagccatatttttttatcagggctgcaaaattttatccgaaacaacaacaatcttttcatcgtcattcccgcgcaggcgggaatctagaacgtaaaatctaaagaaaccgtttttcccgataagtttccgtgccgacagacctagattcccgcctgcgcgggaatgacggattttaggtttctgattttggttttctgtttttgagggaatgacgagacttgagatggcggcatttatcgggagcaactgaaaccaccctgccgtcattcccgcaaaagcgggaatctagaacccaacacggcaaaaatttatccgaagcgacaacaatcttttcatcgtcattcccgcgcaggcgggaatccagaacgtaaaatctaaagaaaccgtttttcccgacaagtttctgtgccgacagacctagattcccgcctgcgcgggaatgacgggattttaggtttctgattttggttttctgtttttgagggaatgacgagacttgagatggcggcatttatcgggagcaactgaaaccaccctgccgtcattcccgcaaaagcgggaatctagaacccaacgcggcaaaaatttatccgaagcgacaacaatctgagacctttgcaaaattcctttccctcacaacagccgaaacccaaacacaggttttcgtctattttcgccccaaatacctcctaattctacccaaatacccccttaatcctccccggatacccgataatcaggcatccggtcgccttttaggcggcagcgggcgcacttagcctgttggcggctttcaacaggttcaaacacatcgccttcagatggctttgcgcactcactttaatcagtccgaaataggctgcccgggcgtagcggaatttacggtgcagcgtaccgaagctctgttcgaccacataacgggtcttcgacaaatatcggttgcgtttggtttgcgcctccgtcagcggacggttgcggcaggctttgcgcataatatagtggattaaatttaaaccagtacggcgttgcctcgccttgccgtactatctgtactgtctgcggcttcgtcgccttgtcctgatttaaatttaatctactataatgtgcagtttctcgatatagccttccgcatcggtgcgggtatgttgtttgtaaccgagtttgtagaggccgtttttcttgatccaacgcgcatcgctgtccttactccgtgtggtttggccgctgacttgtccttcttcatcgacttctatggcctgacgctgtttgccgtcggcggtctgaataatggtggcgtcaatgacggcggcggatgctttctctacttttaaacctttttcggtcagttggcggttgatcagtttgagcaattcggacagggtgtcgtcttgcgccagccagttgcggtagcggcataaggtgctgtaatcggggatgctcagttcgtcgaaacggcaaaacaggttgaagtcgatgcgggtaatgaggctgtgttcgagttcgggatcggagaggctgtgccattgtccgagcaggacggctttgaacatggacagcagcggataggcgggacggccgcggtggtctcgaaggtaacgggttttttgacggttcaggtattgttcgatcggctgccaatcaatcacttgatccaacttcaatagcgggaagcggttgatgtgtttggcaatcatggcttgtgcggtttgctggaagaaggtgctcatggaaaatctcctaaatgtcttggtgggaatttaggggattttgcaaagttttcaacaagtttccgcaccgacaaacctagattcccgcctgcgcgggaatgacgggattttaggtttctgatttcggttttctgttttaagggaatgacgagacttgagatggcggcatttatcgggagcaacagaaaccactctgccgtcattcccgcgaaagcgggaatctagaacccaacgcgacaaaaatttatccgaagcgacaacaatcttttcatcgtcattcccgcgcaggcgggaatctagaacgtaaaatctaaagaaaccgtttttcccgacaagtttctgtgccgacagacctagattcccgcctgcgcgggaatgacgggattttaggtttctgatttcggttttctgttttaagggaatgacgagacttgagatggcggcatttatcgagagcaactgaaaccactctgccgtcattcccgcgaaagcgggaatctagaacccaacacggcaaaaatttatccgaagcgacaacaatcttttcatcgtcattcccgcgcaggcgggaatctagaacgtaaaatctaaagaaaccgtttttcccgataagtttccgtgccgacaaacctagattcccgcctgcgcgggaatgacggattttaggtttctgattttggttttctgtttttgagggaatggccgattttgggtttctgtttcggttttctattttgcaagaatggcaaaatttcagattgcgggcattgttaagtatttctattttttacctgccgtatttatttccgccccttgaagtcggcttcttcctcgacagacacgctgttcatctgtttgatcagcttttccgacttctcttcgtcttcgcagcggatgactttcacaatatcactttcgagctgtccgacattgctgtgcagaatgatgtttttgacgggcaggatgttgttggggttcatggaaaaacggcgcagccccatacccaataaaacgcgggtaaacgcggtatcgcccgccatctcgccgcatacggatacgtctttgtccatgcggttggcggtacggatgacgtgttgcagcattttcagcacggcgggatggccgggctggtagaggtggctgacgctgtcgtcgccgcgatcgacggacaagatgtattgaatcaggtcgttggtaccgacggagatgaaatcgaccagtttcaaaatactgccgacggtcagcgcggcagacggaatttcaatcatacagccgatgccgactttaccgaaggcatcgccgcgttcggcaagctggcgttgcgcggtgtcgaggtggatgaggcactggcgcacttcggatacggaggtaatcatcggccacatcatccgcacggggccgtgtaccgccgcacggaggatggcgcgcatctgggtgcggaacatgaccggttcggcaaggcacaggcggatgccggtcatgcccagcgcggggttgaggctgccgttgggcgtgctgtttttcccgaaccagcgcgggtttttgtccacacctaaatcgactgtccgtatcgttacgcttttgcctttcatttttttgacaatcgcgctgtacacttcgtactgctcgtcttcagacggcatcgtatcgcggttcaggtaaagaaactcgctgcggaacagcccgatgccgtctgcgccgaggttgtgcagcggtttcacgtcttcggcggattctatattgcccacaagctcgatgcagaccccgtcggcggtggcggcggcggtttttttgagcttgttcaaatcgcgtttgtggctgcggtattcgcgggcacggcggcggtattcgttcaacaccgactcatccggcgcgataatcaacacgccgttgataccgtccacaatgaccgtttcgccttcggtaatcagtttgcgcgcgttgtgcagcccgacgacggacgggatgtccaagctcctgcccaaaatcgccgtatgcccggtggggccgccggcatcggtaacgaaggcggcaatgcgctgctctttaaacaaaaccgtgtcggcgggcgaaaggtcgtttgcaatcagaacggtttcgtcaaacaggttgtcggcaacttccaactcgttgccctgcccgatcaggttgttgtggatgcggcggacgacttgcagcatatcctgcttgcgttcgcgcaaataggcatcgtccatattgtcgaattgggcggcgagtttgtcgctctgctgcttcaatgcccactcggcgttgattttttgttcccttaaaatatcgacgggttcgcgcgacaaggtaacatcggtcaagagcatcaggtgtagcgagatgaacgcgcccaactcggtcggggcgttttcgggaatcgcgctgcggagctgttccaactctttgcgcgtggctttgacggcggcatcgaaacgttcggcttcggcatcggtgtccgcctccgcaacatcatactgcggcacttcctccgtaccgcgcgcaatcaggtgggcgcaaccgacggcaatgcctttgcccgccgccacgccgtgcagcacgatactcattattcgccctcgccgaagtagccgttgattaagtcggtcagggcgcgcatcgcttccgcctcgtccgcgccgtccgtctccagttcgatgaccgtacccttggcggcggcgagcatcatcagccccataatgcttttgccgttgacgcggctgtcgtttttcgtaacccagacttcgcttttgaattgggacgcggtttgggtgaacttgttggacgcgcgggcgtggagtccgagtttgttgatgatttcgatggattgtttgagcatttcgattcccgtgttatgtatatcggcagcagacgccgtttaaaatgttttcctgccctgccgcttcttcagacggcatcgccgctgcgccggcacaccaaatcttcgggcgcggacgtgatggcgaaaatgccttttaccgccgcctccctgacgcattcggtaaaggcggcaaggtcttccgccgccggcgaatattggacggccttaaccatcatcggcgcgttcagcccggtcaaaatcgccgatttgttttcgcgcacgaggcggcgggcggcattgcagggggtcgcaccgaaaatatcggtcataatcagcacgccgtcgttgtcgggaaattcctgaagcgcggcaatggcgttgttgttgatgtcgtcttggtcttccgtcggctgcacgccgagtatgcggacgttttcaggcagtccgcccggaaaaaaatgatgcgccagcttgcggtaggcttcgcctatggtttcgtgtgtgatgattaaaagccctatcatattatgcgtcctgttcctcattatcctgccggcgtatgggcgcgatgccgtctgaacagccttcagacggcatcgcgcccttattttccgcccaatgcgtaaatctcgcccagattgcgccagcagcccgccgcatccatgccgtaaccgaaaacataacggttcggcacatccagtccgacataatcggctcggataggcttgggtttgtcaatcagcttgttggcgaacaccgccgcacggcagcttgccgcacccatttccaaaagtttggcttgaatggcggacatcgtatgcccttcgtccaaaatatcgtccagcacgacgacgtgcctgccccggatttgttccgcatcgggcatacgcttccagttgaacgcgccgccctccagcttgtcgccgtaacgggaaacgtgaacataatcaaaatctaagggaaaacgcaacagcggcagcaactgccccgtaaacaccaccgcgccgcccatcacgggcagcagcagcggatatttgccgcccaaatcacgcgtaatctcgtccgccactttttgcagtgcggcacggcattggccttggtcgaacaaaagatcggcgttttcaagcatcgcctgtgtttcaaggcgtttggtttctaaatcggtcatatgtcggaatcggtcggtaaaaggaaaattataaaccaaagtatcggatgccgtctgaactgtcctgctcagcggtcggtacgcacgcgcacaaatgtggcaaatttcggcgtgcctttccgcgtaaagccacggtaacggtaggtaatcagtgtgccgattttgggcgggttgtcgcggtctttatctttgaaaccgctgccgatgcggaattcgccgtgccggtttttgcagccgaccgcgcccagccgtccggcgtttcgccctttgccctcatagtgccgcgttaccgtgcattcgtcgtcgtattggcttttcagcttcaataattggctgctcctgccgccgctgtaacgggattcgggctgacgcagcatcacgccttcgccgccctgcgcttcgatttgttttaaaaagtccatcgcgtgctgccggtcgcgcactttgatttgcgggatgatggtaatcggcgcgttcggatgcgttttcagccactgcgttgcgactgccaaacgttggtagaggttgccctgcgccttgggtacatcgaaaacgtgcaggcggatgccgcgccagtctgaagaaacagaacgcacggtagcggaaatctgctcgaactgaccacgtccgctatacaattcgccgtccaaaggataaggcggaaactgagcggtaaaacctttgggcggagcaaacgcgtagccctgacggctcatcaggtgctttccgtcccaataggcgcgcacgccgtcgagtttctcgctcatcgcccagccggcaatatcctgccctttgtattcctgcgccagcatcaaatccgccgcgcctgctgatgcagggatgaaaaccgccgtaaaaatcggtatgatgccgccgattgtcttcttaatcatctgattcccccaatatcaaaacgggcggcaaaccgccataaaacaaacggcaaacccgatgccgtctgaaaaaccgtttaggaacacgccgatgaccctacgttacgaaatcttccccgttacccccttccgccaaaactgcaccctgatttgggacgacgaaagcggcgaagccgtcctgaccgatgtcggcggcgacgtgccgttcctgctgcaagcgttggcaaaccgcaaacttacgctcacggcaatctggctgacgcacggccatctcgatcacgcgggcggcgtggtcgaaatgttgaaaacgcataaagtccctgtcctcgggccgcatccggacgatgaattcctgctccaatcgctgccgcaaaccaccgcgcaatacggatttcccgtctcgcccgcctttgcgccgaaccgttggctcgaagaaggcgaaacgctcacggtcggacgctatgcctttcaagtgctgcatattccgggccatacgccgggacatatcgtcttttattgtgccgaggcggaattgctgattgcgggcgacgtgctgttttacgaaaccataggcagaaccgattttccgcgcggcaaccacgccgacttaatcaataatatccgcaacaaattattcacccttcccgaaaccgtgcaagttgtcgccggacacgggcgtatgacttccatcggacacgaaaagcggcacaatccgtttttctaaccgccttccctacggtcttcagacggcatcatctgcactgatgccgtctgaaacacaaaaggctcagacaaccgccgccttgccggtgtacctcgccggacaaggctttggtaagtacttcaaacaaacccaaaatcagaaccagtacagttacgccgcgctttcggcattcccgccccggctgaaacaatatttttccgcacaagtcagactgcttcatcttctgccgcgtattccaaagattccgacaacgccgttgtttcattggaacgctcgaccaaatcccgttgaagttgtttgcctgccttcacgcccaacagacgcagtttctcggcgcgtccgaccagattcccgcgcccttcggcaagttgcttgaatgccgtctgaaaactgctttgcgcctgatcgatgcctttgccgacgctttcgagcgtctgtacgaagccgacaaacttgtcgtacagcttgccgccttcgtccgcaatcgccagtgcgttctgattttgctgttcgttgcgccaaatattcgccaccgtcctcaaagtcgccagcagcgtactggggccgaccagcataatccgtttgtcgaaacactcttggaacaagcccgcgtcattctgcaacgccaacaggtaggccggttcgacagggataaacataaagacgaaatccaatgtgttcacaccttccaaatcggtgtaatccttcagcgacaagcctttcatgtgtgcacggatgctggcaacgtgtgccgccagttcgcgtgccgccgtatccgcatccgccgcctgcgtgtagcgcacataagctgtcagcgagaccttggaatcaatcacaatctgcttgttgtcgggcaggttgaccaaaacgtcgggctggaggcggcgcgtgccgccgtcttcctcttttcggacggatgccgcctgaaccacatattcccgccctttctgaaggccggaattttccaaaaccgtttccagaatcatctcgccccaattgccctgaaccttattctgcgtaccggtcagcgcgttggtcagggcctttgcctcgctgtgcagctgcgcgttcaacccctgaagccgtttcaattcgttttccaacgtcagccgctcgcgcgattctttatcataggtttgcttgaccaactcgccgaaaccgtggatgcgttcgtttagcgggttcaaaacctgatggagctgctcgcggttctgctcggtaaaacggcggcttttttcttccaaaatcgtgttggcaagattttgaaactgatcgctcaaacttttgcgcgcctcgcccagcaaggacagcttctcttcagaagcaaggcgttcctgttcgatttgcgttgccaaacgttcgttttcaaccgccaaaccctgtgccttttcctgcaactcggtatgcgactgcctcaaccgctccgcttccgcctctttttcctgcaaatgggcaatctgtttttcggctgcggcaaaacggttgccgacatcggaaaggtcgttttgcacgtcgcggacagtttggcggctttcttccaaatcggtttcgattctttggcggatttggcgttccaaggcatattggtcggcaaacgccttccgttcctgtccgagctgcgttgccaaacgttcgttttcaaccgccaaaccctgtgccttttcctgcaactcgatatacgactgcttcagccgcgccgactccgcctctttttcctgcaaatgggcaatctgcttttcggctgcggaaaaacggttgcccaaagcataattttcgtcctgcaaatgccggtatttcccgtccaacaccgccaattccgacacggttttgccgtgtgcctgttcgacaaaatcacatcttgccgccttttccgccaggtgcgcgttcaaaccggcaaactcgccctgaaaccggcccttcatcagcaaccatgtaaacaacacgcccgacaccaacgccgccaaaggcagcaaaacagtcatcagttccatcaattatcctaatattcaaacattttcacaccggacaaaaccgccgcttattccgattctacctgtttgttcgacatagctccaaaaaatatagcggattggctttaaacctgttcgacatcgccttaccatgctgcttgcggtttcagaccttttcctaattcaatatcaatctgccacaaaccctgattaagttcccgatgtctgacatttttagaatgatgccgtctgaaatgttgcagctatgttcagacggcatacggattcaggcttttcaaacggcaggcaaaatgaaaaaagggcaaaccctaaaggatttgcccttttgttccaaacgcttagtgtacgtctttccaatattctttatttaggaagtaagccaaaggcagcataaccgcaaataggaaaatcatcacgacatagcctatacgtttgcgttgcagttgtgcaggttcgcccatgtacacaaggtaattgaccaaatcgcgtacatatgcgtcgtactctttttggatcactttgccgttaggcaggcggcggctgtgcaaaccggtagattcccaatacagcttaggcttcatctcgccgtgttcgtcttttaccataaccggctgacctttggcatccaactcaacggcttgaacaccttgttgctcccacaacgggtggggcataccgactttatcgaatacagtattgttccagccgctcggacgggtcggatctttatagaagccgcgcatataggcgtaaaggtagtctgcacctttggaacgcgcaatcaacgtcaaatcgggcggagcagcaccaaaccattttgccgcatctttcgggttcatcgccgaatgcatgacatcgccgacattatcggtggtaaacatcaggtttttcttgatttcttcgtcagtcaaaccgatgtctttcagacggttgaagcgcataccgcttgcagagtggcaagacaaacagtagtttgtaaagatttgcgcaccgtgctgcaggctgacttggtcacgcaggtcgatatcgactttttcgtagtgtccgccgccgctggcgacggctgcactcataggcactgccagcaataaggcagcaaaccagtttttcagagtttgtttcattttcgctgccctcatcagatattggttgcaaacaagtaagcaccaacaacggtaataccgacgtaaacaaagaacataattttttgtttagtagtgctcatggttacgcgttcaggaactggtttgttggtatccagtttggtatagaacggcatacccaggaagaatgcaaagtagacgaaagacaggatacgtgcaaccaaagtacgcgtatcagttgctaccattgcacccaaaatacccaaaccgatgaaggcaatgatgaacagaaccaatgcggttttgaagattgggccgcgatagcggacagatttaacctcgcctttatccaaccaaggcagcaaggcgatcagtacaactgctgcacccataccgattacaccccatacctgagtaccggcaaaggaaggaatcgcacgcagaattgcgtagaacggagtgaagtaccataccggcgcaatgtgcggaggtgttttcagcgcattcgctgcatcgaagtttggcgcttccaagaagtagccgccgccttcaggtgcaaagaacatcacggcacagaagacaatcaagaatatcgttactgccaatatatcatgcacaacataatacggaaaaaaaggtatgccatctagagggacaccgttttcatctttcagctttttgatttctacaccgtcagggttgttggaacccacttcatgcaaggcaatgatatgagccacaaccaagccgagcaataccaaaggtacagcgataacgtgcagggcgaagaatcggttcaaagtaacatcggaaacgttgaagtcaccgcggatccaagtggacaaatcaggaccgataacagggatggcggagaacaggttaataattacctgcgcaccccagaaggacatttgaccccaaggcagcaggtagcccataaaggcttctgccatcaatgccaagaaaatcagggaaccgaaaatccacaccaattcgcgcggttttttgtacgaaccgtaaatcagaccacggaacatgtgcagataaacgacgatgaagaagaaagatgcgccggtagagtgcatatagcggataatccagccgccggacacgtcgcgcatgatgtactctactgcggtaaaggcagcaggcagatggtaggcgttaaggttgccgtccggtttgtagttcatggtcaggaaaataccgctgacgatttgaatcaccagcaccagcatagacaatgagccgaagaaataccagaagttgaagtttttaggcgcatagtattcagacagatgctctttccacattttacttaatggaaaacgggcatctacccagcctaacaatgcttttgctttgctattggtttggtttgccataattatcgttccttattcttagtcttcgcccaccaagatagttgtgtcgctcaagtatttatatggcgggacaaccaggttggtcggggcaggaacacctttatatacgcggccggccaagtcgaatttcgaaccgtggcaggggcagaagaagccgcctttccagtctgcacccaaatcggcgggggcaatgtcgggacggaaggtgggcgagcagcccaaatgggtgcagataccgatggcgacaaggatgttcggcttaatcgaacgggtctcgtttttagcatactccggctgctgttccgcatcggaattgggatcggtaagttcgccgttcaggcctttcaggtctttaagctgctgatctgtacggttgagcacccaaatcggtttgccttgccactcggcggtcagcagctgacccgcttcgattttactgacatccacctcgacggcagcaccggcggccttggctttttccgaagggaaaaaactggccacaaacggcgttgccacacccaatgctgccactccgcccgcgccgcaggtcgcgagtgtcaggaaacggcggcggccgttgttgatttcttgattatccattattcagtcgtcctaatattttgggaataccgagccattaaacgttgcaattttacccagtttgcagtgatactcaaagcattatttaaaataaggtaaagttttatgatatttctcaagactcaagccggattgttttcgtcaaaatggcacacttccaacccgaaaacctctgccgccgattctgccagcgcgcgtacgccgtaacgttccgtcgcgtgatgccctgccgaaatgaaagccgtacccgtttcattggcaaggtggtattgggcttcagagatttcccccgtcaaatacagatcgacaccttcgtctattgccgtctgaaaaaacccctgcgccccgccgctgcaccatgcaacccgtcggatttcgcgttcgggattgccgataacgacaggcttacgttgcaaaactgtttcaatatgcgccgccaatgcgccgagtgtcttggcttgtttcaggctgcccgagttgagcaggttttgttcgccgaaccgtttttctgtcgcaaaacccaatctgtcggcgagttgggcattgttgcccagtgtgggatgtgcatccaggggcagatggtagcctgccatattgatgtcgtgccgtaacagtgcggcaatccgttcttttttccaaccagtaacggtcggcaactcgtttttccagaacataccgtgatgtaccaaaagcaaatctgccttctgctccacagcaaaatcaatcgctgccctgcttgccgttaccgacgtaacgattttcccgatatattccctcccttcaacctgcaaaccgttaggggcgtaatctttaaacaacgctgtctgcaatgtttcattacaccaagtcagaaaatccctgcacaataccatcttttttcctaatcgctttaaacaagcgggcattctaatcgcaaaatgtccggaattcacatttttccgatttgcacccgcatatgaattattttaatatgcgccggttcaatatgccgtctgaagccccatggattccattatcgaattgcgccacctcaaaaccctgctggcacttgaagaaaccggcagcgtctcccttgccgccaaacgggttttccttacccaatccgccctttcccaccagatccgtatgctcgaaaaccactacggcacgccgctgttcgaacgcaaatccacgcccttgcgctttaccccggtgggcgaaaggctgctgcgcctcgcccacgaacttatacctcaagttgctgttgcagaatgggatttggcgcgaatcacggaaggagaggcgggagagctgcggattgccgtcgaatgccatacctgtttcgactggctgatgcccgccatgggcgaattccgcccgatgtggccccaagtcgaattggatatcgtatcgggattccaagcggatcccgtcggactgctgctgcaacaccgtgccgaccttgccattgtttccgaagcggaaaaacaaaacggtatttctttccaaccgctgtttgcctacgaaatggtcggcatttgcgcaccagaccatccgcttgccgccaaaaacgtttggacggcggaagactttatcggggaaaccctgattacttatcccgttcccgacgagatgctggatttgcccaaaaaaatcctgattccgaaaaacatcaacccgccgcgccgacacagcgagctgaccatcgccattatccaactggttgccagcagacgtggcattgccgcccttccctattggacagtcatgccctaccttgaaaaaggctatgtcgtccaccgccaaattactgccgacggactgcaaagcaaactgtatgccgccatccgtaccgaagatacggacaagagctatctgaacaatttttgccaaatcatacgcgaacgcggttttgcagatttgcccggactgagcgaactggaaccggtctgaccccttattcaaccatacccggcagtttttctattttttcatgtatagtggattaacaaaaaccagtacggcgttgcctcgccttgccatactatttgtactgtctgcggcttcgtcgccttgtcctgatttttgttaatccactatactgtttttgatttttgcccaatctgtaatctttagattgccaatgggaaaccgtctactacaaataaaaaaccctgcgataagcagggttttttgaatttccaacattaacgtttggagaattgttttgcacggcgtgctttgcgcagacccggttttttacgttcgacttcgcgggcatcgcgggtaacaaaaccagcttgagacaaggcgggtttcaacgcggcatcgaagtcgatcagggcacgggtaatgccgtggcggattgcgccggactggccggtttcgccgccgccaacaacattgactttgatgtcgaaagattcggcgttttcagtcagaaccaagggttggcgaacaaccattcggctggtttcccgtgcgaagaattcgtcaacgggacgaccgtttacgatgatttgacctgtacctttaatcaggaatacacgagccactgaacttttgcggcggcctgtgccgtagtagtatttaccgttcatgtcgcgtccttatttcagttccaaaactttgggttgttgcgcagcatgggcgtgttccgcacccgcatacactttcagttttttaatcatggcgtaacccagaggacctttgggcagcataccttttacagcttgttccaaagcgcggcccgggaattgctcttgcatttcgcggaaggtgcgttcgtagataccgcctgggaaaccggaatggcggaagtattttttatcttcgaatttggcaccggttacacgcagtttgtccgcattgataacaatgatgtaatcgccggtatcgacgtggggggtgtattcaggtttgtgtttgccacgcagacggctggcgacttcggccgcaacgcgacccaagactttgtcttgggcatcgatgacgaaccattcgcgcttcacctcgtggggtttcgctgaaaaggttttcatagtggaaatccagatagatatagaaagttgtaaattttaaagacaggattcgattttgtcaatcgcattaccgcgttacggaaggattttccggatttcggcagactgcatactgctttttcgggcggggcggcggccaatgtgaaaaaccgcatcgttgcgatgcggttttgaatgggaatccccgcgagagccgtttcggccgaatccgcttgaaccttgctgacaaggcggctgcctcgggtagtttcgggtgcgtccgcaaaaggacgctcgcgcccactactgctcccggcaaccttaagcgaacttattggttcaaaggaatatatgccttcgcggacaccgcagggaaaaaggggttattcctgcgccaagcgggatagtgctttttggcaggcgttgtccatatcggctattttacgcgcaaaatcgccgattgccaaatcgccgccgttcagggaggttttcaacaggtcgtggacgacgttgagcgcggccataatgacgattttttcgctgtccgcgacgcgtccgccttcgcggatggcttcggctttgccgttgagcattccgactgcctgcaacagtgtgtctttttcttctgccggcgtgttgacggtcagccgggcgtgcatgacttcgatgtggacttgttcgatgttcatcctttaatccttattgctgcgtttcctgccattgggggaggcgcgctgccagtgcgctgattttttccctgctctgttcgagcaggctgcggtatcgtgtattttcttctgtcaggctgtcaattttgttttgcaggtcttctttgagtttgccgacttggacgagcagggcttcgctgagttcgtcgacggcggtttcgtgttcgagtttttgccgctcgtgcgcccgtttgagttcggcgacggtttctttgaggcggcggttttcgctgacgagggtttcgaatttttgtaccaacgtataaacgctgctttcgagtttttcgatattttgtttcataaccttacctgtccgtatgccgtctgaaggcttcagacggcatctgtctgttgtttattcaaaacgcgcgctgcgttccatcagtctttcgacaacctgttgcggggtcatttctttgcggatgagttgcagcagagtttgggtaatcggcatgtcgatttggtacttacaggcagtattgaagacttcttctatcgtgctgaccccttcggaaacgtgtccgatttcgaccagcacctgatgcagttccttgccttctgccaaacccaagccgacgcggcggttgcgcgaaagtgcgccggtgcaggtgaggatgaggtcgccgatgcctgccagccccatcatggttttgggctgtgcgcccattgcggaggcaaggcgggtgatttcagctaatccgcgcgtaaccagtgcggcacgggcgttaagcccgtactctaggccgtcggacaatccggtggcaatcgccataacattttttaccgcgccgccaaccgccacgccgataacatcggtactgccgtaaagcctcatgacggtcgtgttgagctgcggtacgagttcttcaatccactcttggttttcggaggcaaggacgacggcgcagggcagttgtttggcgagttcctgtgcaaaactcgggccggaaagtacgccgattttcttattgtcgggcaatacttctttcaagacttgaaaggtcagcagcccggtatcctgctcgaatcctttgcaggcggcgaggacggggaggtgtcccgcgccgtactgtttgagcagctctgcgctgcttctcaatccggcaacggaggttacgataaggacaagtccgctgtctttgagcgcgtctgccaaatccgcacacacttccaaggtttcgggaaaggaaaagccgggcagtccgcgtttgttttcacgcgcttcctgcatttgacggacttggtctgcgttgcgcgtccacagggatacgcggttgccgtgttgggaaaaatgcagggcgagcgccgtaccccacgaacctgcgccgataacggtaattttcattggtcgtctttcaacatatcactgccgttcactttaaaacaatcggtgtttctctgcaagtgcggtcagggaaatgccgtctgaaaggcgttcagacggcattttgccccgatgcggcactatcagcctgtattgcgcaaaccttgcgccacgccgttgatggtcaggtgcaccatcagaagggcgtgcggattgtcgggttctttacgcaggcgtttgagcatggcgacttgcaaaccgttgagcgcgttcaggtagggaatcctcaaagcgagcgaacgggcgaggctgcggttgtcgcgcaaaagctcttcggtttgcagtaggtcgagcagtgctttgcggctgcggcggtattcttccttaatcatcccgaagatgatttttgccttatcgggcgattcgctcaagccggcatagttttccgcgagggtgatgtcggttttcgccatcacttgttccatattggagagcatggcttggaagaacgggttgctttgggcgtgttcgcgcagggcggcgagcgtttcgggtttgtcttcgcacaaggtttccaccgcgctgccgaaaccgtaccaagccggcagcatgaggcggttctgcatccaggaaaatacccacggaatcgcgcgcaagtcctgaatccgcgccaaggttttgcggctggcgggacggctgcctaggttgagggtggcgatttcctgaatcgggctggtttgcagaaagtagtcgatgaagtcgggatgggtaatcagttcgcggtagtatttgaacgatacgtccgacaatgcctgcatcagtttggcatcagggtcttttttatccggcaggatgctggcttccaaagtcgcggcaaccaaggtttccaagttgcgttgggcattgccggggtcggcgtatttggcggtaatgacttcgccttgttcggtgatgcggatttgtcccgccacgctgcccgccggttgggcgagaatggcttggtaagaagggccgccgccgcgacctacgctgccgccgcgtccgtggaacaggcgcatacggacatcgtattttttgaagagttcgaccaagcccaattccgcctgatagaggcaccatgagctggtaacgtagccgccgtccttgttggagtcggaatagccgagcatgatttcttggatgtttccacggctttcgagcagtgcatcgtaccagtcgaggcggaacatggtttccatgaccggacaggcgttttccaacgcttcaatggtttcaaacagcggcacgatattgatgcggctgtgcggtttgccgttttccaccgccaacaggccggtttctttcagcagcaatgccaaggcgagcaggtcgctgggttgttcgcagttggaaataatgctttgtgttacggcatcttcgccaaattcgtctttgattttgcgcgcttcgttgaaaattgccagttcgtggcgggtatggtcgctgtatgtgataaacgggctgtacagaggacgttgatggctcaattcgcgcaacagggcggtttgtttttgctcttcgttcaggcggttgtagtcttccaagcctgcgtgttggaaaagctcggcaaccacatcggcgtgtttgcctgcgtgttggcgcaagtcgagcggcatcatgtgaaagccgaacacggatacggaacggatgaggtctgccaaacggccttcggcaagcagacggctgccgttgtcgataagggaacgttgcaattttttcaaatcatccagaaactcttgtgccgaagcataaggctcgagaaagccgaatttgcagcccatacccaaaccgagcgcgcgcgctttgcccatagcgcgcgccataatgtaggcgatggcgcggcggtagggttcttcggcgcgggcgatttcttcgtcgggcgatttgtcggacaacgccgttacatcgccgttgactttgacgcggcggatggagagcggcagttcgcggtagagtttgtcgagttcgccgcgatagaagcggaacacggcatcggcgtggcggcggaaggcaaagcgcagggtttcggcagaaacaaacggattgccgtcgcggtcgccgccgatccagccgccgattttgaggatgtccggaacgcggacgccgggataggccgtctgaaagtcgtgttccatcttgcggtagagcttgggcagggcttcgaaaaagctcatcgggaagatggacacgccgttgttgatttcgtcgttgacgctgagtttgtggcggcgcgtttcgctggtctgccacaagcccagcaggatagtgtcgatttcgcggcgcagccgtgccagcgcgtcggcattggtgcagcgttcgcgttgcggcaacagtgcgcggatgcggcggttgaagcttaagacggtttggcgttgcacttcggtcgggtgcgcggtcaaaacggcggtaacggacgtattgtccaactgccgctgcaccgatttgccgtcggctttccccgctttgagcctgcggacggtttccgtcaggctgccttccgcgccgccgcgtccggcttcttcgtggatttggcggcggcgttcgtggtgcacgtcttcggcgatgttcaaaatctgggcgaacaggccgcaggccaaggttaaatcgtgggtttgttgttcgtccaattgcggcaatactttttcaatcaatgccgcgctgtcgtcggaagtggacaagagtttgactgtttcgacaaccaacggcgaggcttcttcgtgcaggaggttgaacagggattgtttcagaaattccgcgtccgccgccaaagccgcgtcctttggattgttcagaatatgcagttgcatgatttttctctctcgtctgccgtaaatattgtaaatgtaccccaaatgccgcatccgtgccaaaccgttcacactttaaccgcccgtgtcccgaaatgccgtctgaagttgaacgccgcccgacggcagcgttacaatcgcccgcaactgtttttttccgaacatcatcatgaccacgaccgaacacgacaacgacgatgcattcctgctgcggtacagccgccacatcctcttggacgaaatcggcatcgaagggcagcagaaactttccgccgcgcatattttggtcgtcggctgcggcggtttgggtgccgccgcactgccctaccttgccgcttcgggtgtcggcacgctgaccatagccgattccgacacggtcgaactgcacaacctgcaacgccaagtcgcatttgacgagggcgatgtcggcaaactcaaaaccgaagccttggcaggccgcctgaaacgcatcaaccataccgtcaacgtccgcgccgtcaacgaaaaactcgacggctgccgcctgaccggtttggttcaagccgccgacatcgttttagactgttgcgacaactacgccacgcggcaagccgtcaaccgtgcctgcgtgcaaacgaaaacaccgctggtttcaggggcggcggtacgctttgaagggcaacttgccgtgtaccgtcccgacttgcccgactcgccgtgttacgcctgcctgtttgacggcggatcggcttcagacggcatctgttctctcttcggcgtgttctcgccgctggtcggcatcatcggcagtacccaagcggcggaggctctgaaaatcctgctggatgcgggcgaaccgtcgcacggcaggctggcggtttaccgtgccttggaagggggctggcaatatttcgacctgccgcgcaaccctgaatgcccggtttgcggcacagcgcgataaaccctgccgccgtttcagacggcatccaaacggatgcggcggaacggttttaaaaatttaaaaatttacatttctttgcaaaaaaaaaaaaaaaaaaataaacttaccttataattgcaattgttttagcaatgtctgtttcgcagactcattgagtaaaacgttttccccgtaatgtgtttggccgtctgtcccctttgggttcggacggcttttttttggctgtgtttgaatacccggttggttttatctgtttgcagcgggggaagccgcttatttccgttcgggcggaaaacggttccatcggataaaaggcattttgtccgactgattaaagttatagtggattaacaaaaaccagtacagcgttggctcgccttagctcaaagagaacgattctctaaggtgctgaagcaccaagtgaatcggttccgtactatttgtactgtctgcggcttcgtcgccttgtcctgatttttgttaatccactatatatcttaggtttgcatcggcggaatattcaaacacagccttttttaaggaaatccggatacggcggcgcatcaataatgcggcggaatctcgtcgcgcagggaatacggctcttgcgcgtcgggattcctgtcctgcattttttgatacagcagcctcaactgagcctgctgcaaatccagcgtctgccgcaattccgccaccatcgcgttcaggccggcgattacgtcctcctgaagcgcggattggatttccagttcgacaatacggcgttccaactcttgaaccgcgtccatttacagcaccatcgcggcaatccagccggcaatcagcagcgggatgttgtagtggatgaaggtcgggataacggaatcgcggatgtggtcgtgctgcccgtcggcgttcagccccatcgtcgggcccagcgtggaatcggacgcaggcgaaccggcatcgcccaacgcccccgccgtgccgacaatggcgacggtggcaagcggcgaaaaacccaaaccgacacacaaaggcacataaatcgcggcaataatcggcaaagtggaaaaggacgaaccgatgcccatcgttaccaaaagccccaccaccagcatcgccaatgccgccatacctttgctgttgccgaatatcgccatactgctttccaccagcggctgaatatgcccggtcgcattcatcacggcggcaaaaccctgcgcggcaatcataatgaagccgaccatcgccatcatcttgataccttcgccgaatacgtcgtttgccttgtcgcggttaatgacccccaacatcataaatacggcgaaaccgagcatcgcgcccaacaccagcgagtcttcatacatcaactggatggcaaagcatacggcaatggcgacggcggcggccaggctgcggtaggcggacggctgcggacggtttgccgcatcggcgttgcccgccgtatcggcattgttgctttggtacaggcgcggtttgcggtaatggacaaacgccagcaggagtccggccagcattcccaacgcgggaatcgccattgccgccatcacgttaatgtttttcacatcaagctgcggcgcggcggaatggatgttgcccaacaggatttcgttcaaaaaaatcgcgccgaagccgtaaggcaggaacatataagtcgtaaccagcccgaaagtgatgacgcacgcaatcaggcggcggtcgattttcaggcggttgaacaccaaaagcagcggcggaacaatcatcgggataaaggcaatgtggatggggatgatgttctgactcatcatgcccatcacaaggatgatggaaagcagcagccatttgaccgcgccctcgcccgaacgcacgctgtcgggcataccgccccggttcagcttgcggacgaccgcgccggcaagctgctgcggcaggccggaatgggtaatcgccattgcaaacgcgccgagcatcgcataagaaagcgcaatcttcgcaccgccttccaaacctttgttgaacacggggataatccccgcctgactgacctgtcccgccgcatcggcaatgttttgcagcggcatacccgccaccgcgccgccgacaaacgcgccgaccgtcaggctcaataccacgtgcacgcgcgacagcgacagcaccagcataacgattacggcaactacgactgcattcattgtttatcgctccaaacctataaatgtttacatatcgaaacacatcataacccaataacgggaaacccgccaattttgcaaacaattatttcaaatgcttcatatacttccccagcgtaaccctgtccaaacccgccaaatccggcagggtttccactcctgaaaaaccattctccgccaacacgccgcgcaccgccgcgccctgatcgaaaccgtgttccagcaataaaaaaccgccttccgccaaacggtcgggcgcgccttgcgccaaggtgcggatgcagcttaggccgtctgaaaagtcggtcagcgcgatttgcggctcaaaccgcaaatcgccttgcaacaaatgtttatcgccgttttcgatatagggcgggttggacacgatgatgtcccatttcccttcagacggcatatcggtgtcgaaccacgaaccgtgtgcaaattcgacccgcgcgcccaaatccgccgcatttttccgcgccgtttcaagggcgggcgggctgatgtcggatgcgcgcacaaacgcatcggggcgttcgagcgcgacggttacggcaaccgcgccgctgcccgtccccaaatcccacacgcgcccgttttcgggcaggcgcgccaatacggcttcgaccaaatgttcggtttcggggcgcggaatcagcacgctcggattgactgtaaagcgtctgccataaaattcgcgcacacctaaaatataggcaaccggctcgccgttcagacggcgttgcgccagcctgtccgcccgctgtcggacttcgtccggcatttcttccccgccccgcgtcaacaactgcacgcgcgtatattccgaaacatattgtagcagcattcttgcttcatttttaggcagttttgacaagcccaaccatttatcaaacgtcatttttatcccgtctgccgctgatgcggcttttctttccttattctttccggcaaacgtaccgatggtggcaaccgcaaatgcggcataccacaaataaaatcctgcaccgtagcgcacaatatccgatgtattccctgcttcatcgacgtatacggctttcacactgaaagccaccaacgccaagccccaaagtgccgcatggacaggcacgaccttcttccgcaacgccagcaaaacaatggccgccaaccaaacataattcgcatagaccgcacaatacctgatatccaaagaagcaaatatcgaccccaaaatcaaaacggtcaaaccctccatgcttccatgattgcccaaataaaatgcaacattggataaagacgctatccacagggcaaccgacaccagcaacatcactatgggaaaacttggtttccgattctgttcctgcatggttttatcctaatgtaaaaggccgcctgaaaacctttcagacggcatcgtgccggattccgcgtcagattgcgctgccgccgacggtcagtccggcatcaatccgcaaagtcggttgccccacgccgacggggacgctctgcccttctttgccgcacacgccgacaccgctgtcgagcgcagtatcgttgcctatcatggaaacgtgtttcagcacttcggggccgttgccgatgatggtcgcgcctttgacgggatattgcagcctgccgccttccacccaccacgcttcggacgcactgaacacgaacttgccgctggtaatgtccacttgtccgccgccaaagttgacggcgtaaatgcccttgtcgatggacgcgatgatttcttccggctcatagctgccgttttccataaaggtattggtcatgcgcggcataggggcggaagcgtaactttcgcggcggccgttgccggtggactgcgtacccgtcaggcgggcattggtttcgtcctgcatatagccgactaaaatgccgtcttcaatcaatacggtgcggcgggtttcgttgccttcgtcgtcgatgttgagcgaaccgcgccggccggcaatatcaccctgatcgacgacggtaacgcctttggcggcgacgcgctcgcctattctgccggaaaagacgctggttcccttgcggttgaaatcgccttccaaaccgtgtccgaccgcttcgtgcagcaacacgcccggccagccgttgcccaaaacgacggtcatttcgccggcgggcgcggggcgggattcgaggttggtgagtgcctgtttgacggcggcatcgacaaaccgatgaaccaagttttcatcgaaataagccaagtcgtagcgtccgccgccgcccgcgctgccctgttcgcggcgttcgccctgtttggcgataacggtaacgttcaggcgcaccatcgggcggatgtcggcggcgtgtttgccgtccagacgggcgaggtaaaccatatcgtattcgcaggtcaaaccggccatcacttgcacgatgcgcggatcggcggctttggcgattgcttccactttgttcaacagcgcgactttggcggcggaatcgaggccggcaatggggtcggacgcggaacaaaccggcttgccgcgcgtttcagacggcattttggcggacaccttgccgcctgccgccccaatcgcgcggacggcgcgggcggaacggtttatcgaatcgatgcacaggctgtcggcgtaggcaaaggcggttttgtcgcccgaaacggcgcgcacgcccacgccctgattgatttggaagctgcccgatttgacgatgccctcttccaaatgccagctttcataagcggtgcgctggcagtagatgtcggcgtaatcgacgtggtgcgcgccgatgatgcacaggcttttggcgagcagttcgggggaaaggcggttggcttcgagcagccgcgcctgtacggcggaataggtcggatgcatagtgtcggcgcataaaaaatcaggggcttgattatacggcatttgttatatagtggattaacaaaaaacagtacggtgttgcctcgccttgccgtactatttgtactgtctgcggcttcgtcgccttgtcctgatttttgttaatccactatagaaatgcgccgtgccgcctgaaatgtaagatttttgccaacgccccctgcttttgtgtacacttaaagctccttgtcggagtgccgccgccgggcggctgagattgcgaaagcagaatccgtagaacctgtcggggtaatgcctgcgtaggaaacaaaccgtcaaatgccttatcaggcttccgttcccttttccgcacttccccgccccattttcatgttttttaaggacttgatatgtcgggcaatgcctcctctccttcatcttcctccgccatcgggctgatttggttcggcgcggcggtatcgattgccgaaatcagcacgggtacgctgcttgcgcctttgggctggcagcgcggtctggcggctctacttttgggtcatgccgtcggcggcgcgctgttttttgcggcggcgtatatcggcgcactgaccggacgcagctcgatggaaagcgtgcgcctgtcgttcggcaaacgcggttcagtgctgttttccgtggcgaatatgctgcaactggccggctggacggcggtgatgatttacgccggcgcaacggtcagctccgctttgggcaaagtgttgtgggacggcgaatcttttgtctggtgggcattggcaaacggcgcgctgattgtgctgtggctggttttcggcgcacgcaaaacaggcgggctgaaaaccgtttcgatgctgctgatgctgttggcggttctgtggctgagtgccgaagtcttttccacggcaggcagcaccgccgcacaggtttcagacggcatgagtttcggaacggcagtcgagctgtccgccgtgatgccgctttcctggctgccgcttgccgccgactacacgcgccacgcgcgccgcccgtttgcggcaaccctgacggcaacgctcgcctacacgctgaccggctgctggatgtatgccttgggtttggcagcggcgttgttcaccggagaaaccgacgtggcaaaaatcctgctgggcgcaggtttgggtgcggcaggcattttggcggtcgtcctctccaccgttaccacaacgtttctcgatgcctattccgccggcgcgagtgcgaacaacatttccgcgcgttttgcggaaacacccgtcgctgtcggcgttaccctgatcggcacggtacttgccgtcatgctgcccgttaccgaatatgaaaacttcctgctgcttatcggctcggtatttgcgccgatggcggcggttttgattgccgactttttcgtcttgaaacggcgtgaggagattgaaggctttgactttgccggactggttctgtggcttgcgggcttcatcctctaccgcttcctgctctcgtccggctgggaaagcagcatcggtctgaccgcccccgtaatgtctgccgttgccattgccaccgtatcggtacgccttttctttaaaaaaacccaatctttacaaaggaacccgtcatgacccgtatcgccatcctcggcggcggcctctcgggaaggctgaccgcgttgcagcttgcagaacaaggttatcagattgcacttttcgataaaggctgccgccggggcgaacacgccgccgcctatgttgccgccgccatgctcgcgcctgcggcggaagcggtcgaagccacgcccgaagtggtcaggctgggcaggcagagcatcccgctttggcgcggcatccgatgccgtctgaacacgcacacgatgatgcaggaaaacggcagcctgattgtgtggcacgggcaggacaagccattatccagcgagttcgtccgccatctcaaacgcggcggcgtagcggatgacgaaatcgtccgttggcgcgccgacgacatcgccgaacgcgaaccgcaactcggcggacgtttttcagacggcatctacctgccgaccgaaggccagctcgacgggcggcaaatattgtctgcacttgccgacgctttggacgaactgaacgtcccctgccattgggaacacgaatgcgtccccgaaggcctgcaagcccaatacgactggctgatcgactgccgcggctacggcgcaaaaaccgcgtggaaccaatcccccgagcacaccagcaccctgcgcggcatacgcggcgaagtggcgcgggtttacacacccgaaatcacgctcaaccgccccgtgcgtctgctccatccgcgttatccgctctacatcgccccgaaagaaaaccacgtcttcgtcatcggcgcgacccaaatcgaaagcgaaagccaagcccccgccagcgtgcgttcagggttggaactcttgtccgcactctatgccatccaccccgccttcggcgaagccgacatcctcgaaatcgccaccggcctgcgccccacgctcaaccaccacaaccccgaaatccgttacaaccgcgcccgacgcctgattgaaatcaacggccttttccgccacggtttcatgatctcccccgccgtaaccgccgccgccgccagattggcagtggcactgtttgacggaaaagacgcgcccgaacgcgataaagaaagcggtttggcgtatatccgaagacaagattaaagccgcccgaaaggacaccttatgaccttcccgcccctaaaatccccgctcaaattctacgccgtcgtccccaccgccgattgggtggggcgcatggtcaaagcaggtgccgacacggtgcaactgcgctgcaaggccctgcacggcgatgaattgaaacgcgaaatcgcccgctgcgccgcagcctgtcagggcagccgtacgcagcttttcatcaacgaccactggcgcgaagcaatcgaagcgggcgcgtacggcgtgcatctcggacaagaagacatggacaccgccgaccttgccgccatcgccgccgccggtttgcgcttgggtttgagtacgcactccgttgccgaactcgaccgcgccctgtccgtacaccctagctacatcgccagcggcgcgattttcccgaccacgaccaaacaaatgcccaccgccccgcaaggcttggacaaactgcgcgaatacgtcaaacaagcaggcggcacgcccgtcgtcgccatcggcggtatcgacttgaacaacgcccgagccgtactcgccaccggcgtttcctcactcgccgccgtccgcgccgtaaccgaagcggcaaatcccgaagcggtggttaaagcgtttcaggctttgtgggatggataaaaccgaaagaagaaaattcaattgccgtgtaggcaaaacttagcccgttatcgcaaacatacttaactttaaatgtggcatatcatcaaattccgtcattcccgcgtaagcgggaatccgccttaaaacttgagaaaccatcatttgaaaaacagtttccgaatttcaaaaatggattcccgcccgtgcgggaatgacggcaaccggtcagttgcgtatcaaaaaataaagtaattcggctagatatagtggattaacaaaaatcaggacaaggcgacgaagccgcagacagtacaaatagtacggaaccgattcacttggtgcttcagcaccttagagaatcgttctctttgagctaaggcgaggcaacaccgtactggtttttgttaatccactataaatacagaaacatcgagaaaccatgaacatcatcttaaacggcggacccgccgaacttcacggcacgaccgttgccgacctcatcgcccaaaccgcgccgcaaaagccctttgccgtggcggtcaacaccgttttcgtccccaaaggcgcgtatgcggaaacggttttaaacgaaaacgacaaaatcgatatcgtgcggccggtggtcggcggctaggcggttttgccttttcagacgacccctgtccccaaaacaacgttatggtggattaactttaaatcaggacaaggcgacgaagccgcagacagtacggatagtacggaaccgattcacttagtgcttcagcaccttagagaatcgttttctttgagctaaggcgaggcaacgccgtactggtttttgttaatccactatacaaaggaacccattatgctcaccctatacggcgaaactttcccctcgcggctgctgctcggcacggctgcctacccgacccccgaaatcctcaaacaatccatccaaaccgcccagcctgcgatgattaccgtctcgctgcgccgcgcgggaagcggcggcgaggcgcacggtcaggggttttggtcgctgcttcaagaaaccggcgttcccgtcctgccgaacacggcaggctgccaaagcgtgcaggaagcggtaacgacggcgcaaatggcgcgcgaagtgtttgaaaccgattggataaaattggaactcatcggagatgacgacaccttgcagccggatgtgttccagcttgtcgaagcggcggaaatcctgattaaagacggcttcaaagtgctgccttattgcaccgaagacctgattgcctgccgccgcctgctcgacgcgggctgtcaggcgttgatgccgtgggcggccccgatcggcacgggtttgggcgcggttcacgcctacgcgttgaacgtcctgcgcgaacgcctgcccgacacgccgctgattatcgacgcgggcttgggtttgccctcacaggcggcacaagtgatggaatggggctttgacggcgtgcttttgaatactgccgtttcccgcagcggcgatccggtcaatatggcacgcgccttcgcactcgccgtcgaatccggacggctggcatttgaagccggaccggtcgaagcacgcgacaaagcgcaagccagcacgccgacagtcggacaaccgttttggcattcggcggaatattgaaaaaggcagcaaaaatgccgtctgaaggcttcagacggcatcgcggtccaaaacggcggcggcctgaaacggacaaaccgccattccccggcatcacggctttgtcggaaaaaatggaaaaaccggccggaaaaccttgccgcccgtcccgatgccgcaaccaacgaaacactcggcctccacggtgtgcaggctgccgcgcaagccctaaatacggcaatagaagaagcgttttgttgttgtttgaatacacttaaaaatacctaaagccgtccgtaagccttcatccgcaacggttttaccgctttcgcatccccgaatccacgctcaaacacccccgaatgacaaccctgtccgcgccaaatcggacggatgttcaaacacgggcaaccttatttccgtcaggcacgaagccctcagctatgcctgccgaccccgatttgtccgacacaatgaaagtttgccgacccgaatcacaaacatcggcggacaggttaatttgtttatttttcatcgtattacaaaaaatctgcatttatttttaaatttttattgataattattattattagcgtataatcaaaaccactcggaagccgtccgttccgaaccattaaacaccatatttccccatcatcactttcacacttggagtcggcatatacgagacatacattccctttttatatatcagatactcaaaaccgaaacgccaaacccaccttcgcggtgggtttggcgtttatcgtccggctttcgcgcctatttgcaagacttgaggttcagtttgccgtatagggacgtgattttacgaatttcgtccgcatcggcggcattcacgccggtaaacaaaaccgtcatacgcgacacgctcaaagaatcgtcctgcctgtcggcttcggcaaagtgttcgacaatatgcgccccgccgaatccggcgccggcaagccggttttgcagggcttgggcgttttcccggctgttgccgacacccaaactcaatgcgccgtcaaacggtatggggttgaaacctttggcagacagctccgccgcctgattttcggcatcggcggaaacgggcaggacgacgcggtaggttttgtcggcaggtttggcttgggcggtgcgtttttcgacgctcctgctggcaacgtgcgaccatttgcccaaaagtcctttgatgcggtggtagtcatcttcgtccatcgtgaggcttgcctgcgcggcgcataaggcatccgccgcgccgttttcgcgttccgcctgcgccttttcggcggcgagtttttcgcggcgggctttttcttcacgctgttttttctctttcagttttttctgttccgcttcttttttcaagcgcaactgctccgcctgttcttcgctcagaatgtcgccctgtttgagcagtgcgcctgtatccgattcagatgccgcctgaacgacaggaccggatgctggaatattccgaacaaccggcatagttggggcaactggttgaacctgcaaattgtttgcggcattctgtgcctccggtattctgccggcctgtttcagtgtcagtttgtaacctaccgtaccgccgaatacggcaatattaatcgcaaccaaaaggataaatagccatttcatctctgtattccttaaatatgttcatattccctgccttcggcggcaatcatgttcaacaacccgtaaatgacgaggttgtccgccacgcgcacggtattttccgccaaaaatgcaggcggcagggcttcggcaacttttgccgcgccgccgccggtaatgatgacatcgacaggcttgcccgccccggttttttctttcaaacgcccgtgcatcatcataaccgagccgcaaaccgcatccatcatgccgctggcgacggcattgcccgttgtggtcgggaaaggataacgcttaccggcgtgccggttgaggttggcggttcggacggcgagcgattctttcatcaggtggaaaccgggcatgatggttcccccgagataatgtccgtcatcggtgagcgcgtcaaccgttaccgccgtgccgcaactgacgacgacgcaggcgttgcggctgaagcggcggctgcccaaggcgttgaaccagcggtcggaaccgtgttcttcggggtggcggtagtggttgcgtatgcccaaagcctgtgcggaagacggcagccactcgatttttcgggcgagctgttcctgcacttgtgcctttttgaattctccgcacacagcgcaaccgacgatgcggacatttccatccgccttttccgcccactccgcgcccaaaggcgacaaatcgcggtacggcgcgctaccgacggttgcgaacgtgccgttttccacccacgcccacttgagccggctgttgccgccgtccaacagcagaaaacgttccgaatcccgccgcttcggcacggaaaccggcctgtcgtcggaccgcaggctgatttcgccgctgacgaccgtctgtttgccctctgccgtttccaagtgcaaaacgccttgtccgtccacgcctttaaccgtgccttcgaacacggtttcgccgtcgcgcaacagcaataccgccttgccgtggtcgcggttggcagcctgatattccgccacaaaaggcgcaaatccgtcccgcgcatattgcaacaacaccgcgtccagttccaccaacagcgtttccagcagcacggcggcatcggcattgccccgccgcgatgccgtctgaaacagcgattgcacggaagcggcattttctacttccttgggcaggacaaaattgatgccgataccgaccacggcaaccgttttgccgcccgtcctgaccgtttcaatcagaatgccgcccaatttgtcgcgtccgacaaccaaatcattgggccacttaatctgcacatccaaacctaaacgcgacaaggcgcgccgacacgccactgccgcaacaggcgacagcgaacccaactcatactgcggccggtcaaacacccagccaaaactgaacatcagacactcgcccaaacggtgcgaccacttccgcccctgccgccccctgcccttactttgcaggtgggtcacgcatatggttttgtgcgccttgtccggcgcaatccgcgccaattccagtatctcgtcgttgctggacgcgcactcgtgcttcaatgccgtctgaaaacccgacctttcccccagctcgcgcaaaccttcggcatcgaaaaccgccaatgggcgcaccagccgccaatagccgtcgtgttggcgcaacagcccgcgtatgtgcgccggcatctgctgccaaaaaccgttgagctgctgcggcttcatatccgccatacgcgccagttgcgagacgtgttgcggcaaaccgtcggcaagctccgccaacacccgccagtgcgaaagcttcaaaaccgtcattttccgccctctgccgcacggatttttgccaaagtcttcgttgtcgaagtctggtgcagaaacggaattgaaaacacctgaccgccgcgcgccaacgtttctgccgcaccgacaatcttatccgcagcccaatcgccgcccttgaccaaaatctcaggtttgaccgcctcaatcaacgccgccggcgtatccccgtcaaaccacgttaccaaatccacactttccaaagcggcggcaacggcggcacggttctccaaaggattaaccgggcggtcaccgcccttgcccagacgccgcaccgaagcatcggtattcaacgccagcaccaacgcgtcccccatcgaacgcgcctgcgccagataagtaacgtgccccctgtggaggatgtcgaaacagccgttggtaaacaccagcgggcgcggcaacaacgccaaacgcgccgccaacgcctcgggcggacagattttcgattcaaaatcagggacagaccaagcgtcaaccatcaaagcctccgacaaaaaccataaaagacagaaaaacccacatgatacagaagcatatgcgaaaggcaaagccggcggcgcggacagtacgcgcaaacgggaaaagacccgtaccgaaaagtacgggcctttatctggggtggctgatggggctcgaacccacgacaaccggaatcacaatccggggctctaccaactgagctacagccaccataaaaacggttttcaatcaaattcttggcacgcccgacaggaatcgaacctgtaacccccgacttagaaggtcggtgctctatccggttgagctacgggcgctcatgccgattcgtgctgattgattggtcggggcggtgggattcgaactcacgaccctctgctcccaaagcagatgcgctaaccgggctgcgctacgccccgacttgaagaagcgaactatacaactcagggaaagatgcgtcaacatttattttcaagacaccaagatgaaaaatatagttttttgatttgaaaaaatatttaatccgtccaaacagccgtattttatttcagggcaaatttattttcggcatcctgctgtaaaaacaaacggaaaatgcgataattttcagcattttctacctgtttaacaaaaggacggatatgtcggcacaactgatcaatggtaaagaagtttcgcaaaaacgcctgcaggcggttgccgaagcggtggcgcaacgccaacagaacaatctgcacacccttgcctggccgtggttttggtcggaggcgaccctgccagcgcggtttatgtccgcaacaagaaaactgcctgccaaaaatgcggcatcaaatcactgtcttacgagctgcccgaatcaacatcgcaggaagaactgctggcactggtcgaccgcctgaatgccgattccgaagtggacggtattctggttcagctaccgctgccgaagcacctcgacagccaggcggttttggaacgtatttcgccggataaggacgtggacggcttccatccttacaatgtcggcaggctggcggtcaaaatgccgctgatgcgcccgtgtacgcccaagggcgtgatgacgcttttggaagcttacggcattgatccgaaggggaaaaaagcggtcgtggtcggcgcgtcgaatatcgtcggccgcccgcaggctttggaactgctgctggcgcgcgcaacggtaacggtctgccacagcgcaaccgaaaatctgacagacgaggttgccggagccgatattttggtggtcggcgtaggcattccgaactttgtcaaaggcgaatggatcaaacctggcgcggtcgttattgatgtgggcatcaaccgtttggacgatggcagcctgtgcggcgacgtggaatttgaaacggcaaaagaacgggcggcgatgattacgcccgttcccggcggcgtgggtccgatgacgattgccacattgatggaaaacaccctgcacgcggcttcactgcacgatgcttgagcggttctgaagataaaaatgccgtctgaaaggctttcagacggcattttgccgtgtccgtttatttgggcagcttgacgacaaccgtatccgccagtatgtcgtaaagcgtgcggcggtcgcgtttgaccataaagagcaggacaaagttggcaaggaatgccagcaggttgatggcgttttctccgttgtcacctactgcaagaccgataacggcggcaataatggcaaccaaaaccgaccatgcgatttcgcgtaccaaaaccgtgccgacaaaaccgggattgcggccgtcggttttcaacacacggattctcatgattttcttacccaatgactgcccgtcccggctcatatagtagatttggatgacggtgtacgccaaaatgcctgccagtcctacccaaaaggaagtcatgcccaaaagcagcccgaatatttcttcgccgctgccaatcctgccttcattcttgatggcgaaagcaatcagtccggcaaacggcaccaacaaaaccaaaaaggtaaacaattggttcagcagcgcggcaagtatccggtcgcctgcaccggcaattccgacttcaatttcctgcccgttgcggttgtcggatgccgcgtcggtgtagtcgtttttttcttccatatccgttcctgataattgttcttaactgaccccgattctaccgccacgacaccgaaaacgccaatacttaaagaaatcccgataaagaactttacattttcccaatacggcgttaaaacgcttcctttacgccatacataattttattaacgatttttcctcaaggagcaacacaatgaaagtaggtttcgtcggctggcgcggtatggtcggttcggttttgatgcagcgtatgaaagaagaaaacgacttcgcccacattcctgaagcgtttttctttaccacttccaacgtcggcggcgcagcccctgatttcggtcaggcggctaaaacattattagatgccaacaatgttgccgaactcgccaaaatggacatcatcgttacctgccaaggcggcgattacaccaaatccgtcttccaagccctgcgcgacagcggctggaacggctactggattgacgcggcgtcctcactgcgcatgaaagacgacgcgattatcgtcctcgaccctgtcaaccgcgatgtcctcgacaacggtctcaaaaacggcgtgaaaaactacattggcggcaactgcaccgtttccctgatgctgatggctttgggcggcctgttccaaaacgatttggtcgaatgggcaaccagcatgacctaccaagccgcttccggcgcgggcgcgaaaaacatgcgcgaactcatcagcggtatgggcgcggttcacgcccaagtggcggacgcgcttgccgatcctgccggctcgattctcgacatcgaccgcaaagtatccgatttcctgcgcagcgaagactatccgaaagccaacttcggcgtaccgctcgccggcagcctgattccgtggattgacgtggatttgggcaacggccagtccaaagaagaatggaaaggcggcgtggaaaccaacaaaatcctcggccgcagcgacaatccaaccgtgattgacggcctgtgcgtccgcgtcggcgcgatgcgctgccacagccaagccatcactctgaagttgaaaaaagacctgcctgtttccgaaatcgaaacgattttggcaggcgcgaatgactgggtgaaagtcatccccaatgaaaaagaagccagcatccacgagctgactcctgccaaagttaccggcacgctgtccgtccctgtcggacgcatccgcaaactgggcatgggcggcgaatacatcagcgcgttcaccgtcggcgaccaacttttgtggggcgctgccgaaccgctgcgccgcgtattgcgtatcgtgttgggcagcctgtgagccctgtttgaatggaaatgccgtctgaagcctgtttcagacggcattttccttgcaaccctgccggataacgccctgccggcactgccgacgtaaaaaataaaggattccatttccggcggtatgcggcagcccgactttatccgaacctgatgcgcctgcacgtcaatgaaaacagcccgattgcggacttcctgctacagccgaaattccgataaggcaagcgttcacgccagcaacatttcctgcatcagcttcataccccactgccagccgccgagcatgccgttcaaactgcccgaatgcggggaaaccaacaggcgggcgttccacaaatccgcctgtttttgcgcccaaccgtgcggcacgccgccgtgttcgggtacaaccaatgcggcacggcagggacagcggacgcgttggaaagcgtgttccgcatcgtcgggaaaaatatcgggacgctgcggtacaaggatgatgttggcaattttcttccgtgtcaggatgtctgcctgatacagccacgccaaaaatgcggccgcgcccgcaccgtgtgcgacaacggcgacgtatttgccgcgtatgcgttcaaatgccgtctgaagccctgcctgccattcccctatgctttgaccggccgacgcttcggacatctgcacgacgggataactgatcgcccaacggtctatccacatctgatcctctccggcatcgcgtatcagccaaagcgtcaaatcttcgagttcaaaaccctgcataccgccccgcctatttcagcaggtcccggagggtaaaggcgatgagcagcgaagcgggtacgctcaatatggcgcagacggtcaggcaggcaaaaatattcaccacccgccgccagcctttccaacccaaacatttggacgcaatcagcaggcagggcaggcaaatcagcagccacaccaacgcccatatcgggtttgccttggtcggcgcaagccagccttgcatccgcgacaacataaatatcgcccacaccaacatgggcaggataaacgcagcgacgacccatgccgcgcctattcctgtttttccgtccacattccaatcatatttacccaaaaccttattcggcagcatagtcatactccacgaccagcggcgcatggtcagaaaatttttcatctttataaacgtgtgcggacacggctttggcagcaagttcgggcgtaaccatctgataatcgatgcgccacccgacatctttcgcatacgcctgccctcggttgctccaccaagtgtagcccggcacatcgggataaagcgtgcgccacatatccgtccaaccgagcttgtggataaccttgcctatccactcgcgctcttcaggcaggaaacctgaatttttctggttgcctttccagtttttcaggtcgatgttttggtgggcgatgttccagtcgccgcagacgacaatgtcgcgcccttcgtttttcatcgcttcgagcatagggtaaaacgcatcaaggaaacggtatttcacctgctggcgttcttccgcgctgctgccgctgggcaaataaagcgagataacgctcaacctgccgaaatcgcaacgcacaaaccgcccttccctgtcgaattcttcaatgcccataccgatttgcacattgtcgggtttgcgtttgctgtacaccgccacgccgctgtaaccgcgcttctcggcgcaatgccaatgaccgtgcatcccgtgcggatttttcatatcggcagacaaatcagcctcctgcgctttgagttcctgcacgcagacaatgtccgcgcccgatgcggcgatgtattcgtaaaaaccttttttgtaggcggagcggatgccgttgacgttggcggaaatgattttaagcataataaaaataagttctcacaataaaaatgccgtctgaacaaaaaagggcaaaatgcggcacatttacccttttcgatggattttaaccgcgccgccaagtcgtgccgccggcgttgtcttccaaaatgattttgtgttcgttcagaaggtcgcggatgcggtcggattccgcccagtttttatcggcgcgcgcctgtttccgccgggcgatcaagtcttcgatttcttcgttggagagaccgtctgaagccgcgccgccttgcaggaactcggtcggatcgcgttgcagcagtccgatgatgccgcccaaggctttcagacggcctgccagttgcgcgtcattggttttgttcacttcgccggcaagttcgaacaacaccgccaccgctttcaccgtatcaaaatcatcattcatcgcaacataaaagcggcgcgtgtagtcatcgccggcttcagacggcatcggatcggcgggcggcgtatttttcaaagtcgtatacaaacgcgtcaacgcgccttttgcatcatccaaatgcgcgtcggaatagttcaacgggctgcggtagtgggcgcgcaggatgaagaagcgcacgacttccggatcgtattgtttcaacacttcgcggatggtgaagaagttgcccagcgatttggacatcttttcgccgtccacgcggataaagccgttgtgcagccagtatttgacgtggctggcgatgctttgcccgtggtgggtttgcgcgtgatgatgaccgcaggtatgccccgtcgcgccgacgctttgggcaatttcgttttcgtggtgcggaaactgcaaatccgcgccgccgccgtggatgtcgaaggtatcgccgaacaggttttcactcatggcagagcattcaatgtgccaacccggacggccgttgccccacgggctttcccacgccggttcgcctgctttggcggctttccacaacacaaaatcaagcggatcgcgtttgaaaccgtccacttccacgcgttcgcccgcacgcaggtcgtccaacgatttgcccgacaattgtccgtaagcggcaaactcgcgcacggcgtagtaaacgtcgccatttgcggcaggatatgccttgccgttttgaatcagggtttcaatcatggcaatcatttgcggaatgttttccgttgccttcggctcaatatccggacgcaacacgcccaaagcatcggcatcttcgtgcatggcttggatgaaacgcgcagtcagtttgccgatggtctcgccgttttcagccgcgcgggcaatgattttatcgtcgatgtcggtgatgttgcgtacataagtgagcggatagccgcactcgcgcaaccaacgggcaatcatgtcgaacaccaccatcacgcgggcgtgtcccaaatggcagtaatcgtaaacggtcataccgcagacgtacatacgcacgttttcagggtcgatgggggaaaagggttctttttgacgggttagggtgttgtagatggtggtcatgggattatggattaatctttgttgctcggatgataatttctgttctgttcctgtagatacggaccaaggaacattacgtagttgcggattattaatatggctgatatttgtgaaaattggttctgcataacagtttgcaaaattttttgtaaattctgataatttaaacttatcttttaataagtttgctaaatctgatgacgagggataaagtttacttcttatactaggcatttcaatatgaaggactatttttatttcgttacaatctaaagccaagcgagaaaaatctttttcttcctgtttttctgctttaaatttagcagaaaccaatcctgccaatgaatctcgaatttttcttgcgattaaatatggtaggtcagaaagtttttcatctattgattgggcatttggctcaagcccaagtcggtaataatctttaatttcgattagccaaagtgtcgattcatgaagggctattatatctacacctgagctgccattatcgtcatctacactttgatttatcccgttctttcccttttcatttgtatcaattttattacgtaaattacaactgttctgaaaaattttataatgttcccattcgtcatacttggtaacgtaataatcttcaggaaaagcaaaggttaatctcttttctgtgattgtagtcatagcttaacctcaaatattcagatacctgtctgcctgcataatgttttcatctaacaatatcaatgtgttcaaatcattaatactgttcccttgctccacttttgttccatcatcggaagcaatcaacgagaaaaaacgtacaggtaaatccgtgttattttcaagcttcaaaagttccaattctctcaataagaataaagagtgtgttgcaataaaaacctgaataccctgttgagataaagaccaaataatacgggcagccactttgatcaatttaggattcagattagcttccggttcatcccaaaatagatagcctttatccagcaatgcccctgttgcgattaaccgggcaatcatgacaaatttccgcaaaccctctgctaccaaaggtgcttcaatcttaccgcccgtatttgtcagcgatagataaaaccttccttgttcttcagatacttttccgcccatcgcgttctcaataggttcgagcaattctcgaatttttgtttctctggggcctttggcaagcgggtgatttaattgcatacaggtatcaaaccaagtttcttcgaaagggatgctttggttttgatacaaagaagtgaaccaagggcaaagtgtaattaattcgcggctgggtaagaagataggtgtcggagtatattcattttctttcaatccgatgctttgaacattgacttgcgatgatgagttactggaaaaattcagactactatgcgtagtgccgttttgcagttttaaaacgatttccgtacgcccgcgcccctgcaaacgtttgctcaacctacccaaggaatcgggacggaaaacattcagtaatttatcggcaaaacttttttgcaattctgttttcagtaatctgtttttggtgttagatgttacttctagcaggctgtataaaatttttaacaaatgtgttttgccacaaccgttttcggcaacaataacattgagattttcagaaaattcaaaagtatcgtttggaagaacggtaaagtttgtcaactcaagcgactggatatattggttagatgacatttttaatccatttcaatcttgctttaaaattgtttcaaacaaccttttgtagaacaaatatcgtctgaaaccctttcttttttcactccggcttaaacacgcctgtatccgttttaggctgctgttcgataatttcaacatttgccgctgctttctccgcttctgctttttcagcttcgatacgttttttctcggtcaggtattggttgatttggtgtaccaattcctgcgtgccttggtgggtcagcgcactgatttggaagaggcgcggggtttccatgtcaaattggaaacggtcgtcgggtttggggtagtcccagccgacggcttcgaggaaggcggcagtgcgcgtttgggcttcttcttcgtcaagcatatcgagtttgttcagtaccagccagcgcggtttgccgtagagttcttcgtcgtatttgcgtaattcgttgatgatggcgagtgcttcttcggcggggttgacggtttcgtcgaagggcgccaaatcgacgacgtgcagcagcaggccggtacgtgataagtgtttgaggaaacgatggccgaggcctgcgccttctgccgcgccttcaatcaggccggggatgtcggccatcacgaagctgtggttttcgtcgatgcgtaccacgcctaagtttggatgcagggtggtgaaggggtagttggcgattttggggcgtgcggcggatacggcggtaatcagggtggatttgccggcgttgggcatacccaataagccgacatcggcgaggactttaagttcgagttgcagggaacgggcttcgccttcttcgccgggggtggattgtttcggggcgcggttgacggacgatttgaagtggatgttgcccaagccgcctttgccgcctttggcgaggcagacgcgctgtccgtgataagtgaggtcggcaacggtttcgccggtgtcgaggtcgcggataagggtgccgacgggcattttgaggacgatgtcgtccgcacctgcgccgtaacggtcggaaccgtggcctttttcgccgtttttggcttggtagcgtttaacgaagcggtattcgacgagggtgttggtgttttcgtcggcttctgcccagacgctgccgcctttgccgccgtcgccgccgtccgggccgccgcgcggtacgaatttttcgcggcggaaactggttgcgccattaccgcctttgcctgcggcgacttcgatttttgcttcgtcgatgaatttcattcaatgctcttgtttgttggtttcaaatggggggttcagacggattaccgtgtgttttgatgccgtccgaacagaatttcggacgctattataagggataagcggtatttcaacacgccgtacccaaactatttgttccgcccatcttaatgaatttttaagcaaatcttcagcctgcaaacaaaattatgtccaacttctttggtacaatcgcgcctttttgacattccgacccgacggaatgtccgttcaaaccgttacatataataagttttttatgaacacaaaccaacctgccgtttacgacccgttgacacgcgcgctgcactggctgaccgttgccggcttcatcggcattctgaccaccattgtcctgtggacgatttatagtggattaacaaaaatcaggacaaggcgacgaagccgcagacagtacaaatagtacggcaaggcgaggcaacgccgtactggtttttgttaatccactatacgaagaggcggaatgggtgggcagcctgttcggcctgcacaaatctttcggtttccttacgctgacggtgattacattgcgcatcgtgtgggcggttgccaaccgcgccaagcgtccgcaaagcgactgcaaggctgcggcggcaggccacggcattctgtatctgctcatgcttgctgttcccgttatcggcatgatccgccaatacggcagcggccgcggcccgttgaaagtgttcggcgttgaagtgatgcaagggttcgccggaaaaaatcgagtggatggcaaacttgggcaacacgttccacggcaatttgggcttgctgctgtttgccgccgtcgccggacacgtcgccatggtcgtcgcccaccgtgttcagggtagagatgttctgtgccgcatgacgggtcgtgtccgctgattccgttcacactatggtgccggctcgtccggcactatttgtttttccaagacagagccagatcgtacaaagctttctttccctcgcccgtgattttggcagcaagctccgccgcctgtttggtcggcagctcggctgtgaggattttcatgatgttttgcgcggactcggacaagccttcgtgtttttcatcctgcgccggataaagcaccaacaccatctcgccgcgcgattggttgccgtcggcagacaatgccgtctgaatttccccaaccgtgccgcttaagaacgtttcaaacgttttcgtaatttcgcgcgccagcattaatcggcgttcggggaacagttccgccatatcggcaagcgtcgcaccgatgcggtgcggcgtttcaaacatgacgataggaaacgccgcccgcacccatttggcaaacagtttcctgcgttctcccgatttcggcggtacaaaaccgttgaaataaaaatcggatccttccacaccggccacgctcaaagccgccatcaccgcgcttgcgcccacgacgggaacgactttaaacccggcctcacgcacgcggcgggcgagtttcgcgcccgggtcgcacacggccggcgtacccgcatcggaaacctgtgccacaaccatgccgtctgaaagatagccgacaatcttgtccgccatctgccgttcgttgtgttcgcgcacactgacgagtttgccctgaatgccgtacgcgctcaaaagctgtgcggtaacgcgcgtgtcttcggcacagatgatgtccgccttttgcaataccgccaaagcgcgcagggtaatgtccgccaaattgccgatgggcgtggcaaccacgtataatgtccctccgacgacgctgtcggaggctttctgcaaatgtttctgaaacataagaatgccgtctgaaaaacaaacattataaaggttaaaccgattatgcgcctaaaccacaaacagggcgaggcaggggaagatgccgcgcttgccttcctccaatcccaaggctgcacgctgcttgcccgcaactggcactgcgcctacggcgaaatcgacctgattgtcaaaaacggcggcatgattctgtttgttgaagtaaaataccgcaaaaatcggcaattcggcggtgtcgcatacagcatttccccatccaaattattgaaactgcaacgaagtgtagagtattatctgcaacagaacaggttgacaaacgtaccgtgccgcctcgatgcggtacttatcgaaggcagccgcccgcccgagtggatacagaatattacaggttgacgatatgacgacattacaagaacgcgttgccgcccattttgccgaaagcatccgtgccaagcaggaagccggaaaagtattggtcgagccgaccgtacaggctgccgagctgatgctgcaatgcctgatgaatgacggcaaaatcctggcctgcggcaacggcggttcggctgccgacgcgcaacacttcgccgccgaaatgaccggccgttttgaaaaagaacgcatggaactcgccgctgtcgcgctgacaacagacacttccgcgctgacagccatcggcaacgactacggtttcgaccacgtattcagcaaacaggtgcgcgcgctcggacgtgcaggcgatgtattggtcggcatttccacctccggcaattccgccaacgtcatcgaagccgtcaaagccgcacacgaacgcgatatgcacgtcatcgccttgaccggccgcgacggcggcaaaatcgccgccatactcaaagacaccgacgttttgctcaacgttccccatccgcgcaccgcccgtattcaagaaaaccacatcctgctgatacacgccatgtgcgactgtatcgactccgtactgctggaaggaatgtaacccttttcagacggcatggcgcaaagcaatgccgtctgaaacgcccaagaaaggaagcacccgatgaaacccaaaccgcacaccgtccgcaccctgattgccgccattttcagccttgcccttagcggctgcgtcagcgcagtaatcggaagcgccgccgtcggcgcgaaatccgccgtcgaccgccgaaccaccggcgcgcaaaccgacgacaacgttatggcgttgcgtatcgaaaccaccgcccgttcctatctgcgccaaaacaaccaaaccaaaggctacacgccccaaatctccgtcgtcggctacaaccgccacctgctgctgctcggacaagtcgccaccgaaggcgaaaaacagttcgtcggtcagattgcacgttccgaacaggccgccgaaggcgtgtacaactatattaccgtcgcctccctgccgcgcactgccggcgacatcgccggcgacacttggaacacatccaaagtccgcgccacgctgttgggcatcagccccgccacacaggcgcgcgtcaaaatcgttacctacggcaacgtaacctacgttatgggcatcctcacccccgaagaacaggcgcagattacccaaaaagtcagcaccaccgtcggcgtacaaaaagtcatcaccctctaccaaaactacgtccaacgctgactcggcaatgccgtctgaaccgccttcagacggcattgcccgacaccccaaaagcacaatcaaaatggcaaaaaaaccgaacaaacccttcaggctgacccccaaactcctgatacgcgccgtattgctcatctgtatcgccgccatcggcgcattggcaataggcatcgtcagcacattcaacccgaacggcgacaaaacccttcaagccgaaccgcaacacaccgacagcccccgcgaaaccgaattctggctgccaaacggcgtagtcggacaagatgccgcccaacccgaacaccaccacgccgcctcatccgaacccgcacagccggacggcacagacgaaagcggcagcggactgccgtcccctgccgcacccaagaaaaaccgggtcaaaccgcaacctgccgacacagctcaaaccgacaggcagccggacgacgccggaacacaagctgaaaacacactcaaagaaacccccgtactgcccacaaacgtcccccgtcccgaaccccgaaaagaaacacccgaaaaacaggcgcagcccaaagaaacgcccaaagaaaaccataccaaaccggacaccccgaaaaacacgccgcccaaaccccataaagaaattctcgacaacctcttctgacccggcacggcaggcacacccgcaatccaaggaagcattatgaacggcatcatcatcaaaacccccgaagaaatcgaaaaaatgcgcgagctgggcaaactcgtcgccgaagccctcgactacatcggacaattcgtcaaacccggcgtaaccaccgacgaaatcgacaaactcgtttacgactaccacgtcaacgtccaaggcggctatcccgcccccctgcactacggcaacccgccctaccccaaatcctgctgcacctccgtcaaccacgtcatctgccacggcattcccgacgacaagccgctcaaagaaggcgacattatcaacatcgacctcaccatcaaaaaagacggcttccacggcgactccagccgtatgtttaccgtcggcaaagtctcccccatcgcccaacgcctgatcgacgtaacccacgcctccatgatggcgggcatagaagccgtcaaacccggcgcgacactgggcgacgtaggttacgcctgccaacaggttgccgaaaacgccggctattccgtcgtacaggaattctgcggacacggcatcgggcgcggtttccacgaagccccgcaagtgttgcactacggaaaaaaaggacagggccccgttctaaaaccgggtatgatttttaccgtcgaaccgatgatcaaccaaggcaaacgccacctgcgtatcctcaacgacggctggacggtggttaccaaagaccgctccctctccgcccaatgggaacacgaagtcttggtgaccgaaaccggctacgaaatcctcaccgtcagccccgcctccggcaaaccctgaaaccggacgtatccgccccataaaaacaaacaatgccgtctgaaagaaacggcagatatgatatataatataaaaacaggcttgacccggcacattacgaaaacaaagcaaatcggaatttgccccgcaaccagacaaacttaaaggaagttttatgaaaatatttgaaaatatagaagatgttaaagccatccgtaaaaagaccgggctgaaccagatagacttctggggcaaggtcggcgttacccagtccggaggatcgcgctacgaaaccggccgcaaaatgcccaaacccgtacgcgaactgctccgcctcgtccatatcgaatgcatcgatttggcgaaagtcaacaaaaaagatatggaaatcgccgccctgttgaaaaaacaccatcccgacctgtatgccgagttgtccaaacagaccaagtccgaaagaaaaaaacaaagttaaaccgcaacctccggatgcccgacagtttttcatttccgaaaaacgcaaacaatgccgtctgaaacaccggacaggtcgccgtatcccgcctgccgcccctgcctcaaaccgccgaaccgcccgaacccgcctttttacaaactttatccaatttcctgtttatttcgggatacgccgacattagaatgtcaaacagctcgaaacgggcaaactccacatccatccaaaggaataaaaatgaaacttctgaccaccgcaatcctgtcttccgcaatcgcgctcagcagtatggctgccgccgctggcacggacaaccccactgttgcaaaaaaaaccgtcagctacgtctgccagcaaggtaaaaaagtcaaagtaacctacggcttcaacaaacagggtctgaccacatacgcttccgccgtcatcaacggcaaacgcgtgcaaatgcctgtcaatttggacaaatccgacaatgtggaaacattctacggcaaagaaggcggttatgttttgggtaccggcgtgatggatggcaaatcctaccgcaaacagcccattatgattaccgcacctgacaaccaaatcgtcttcaaagactgttccccacgttaatcaggcaacaaaaaacagcgttttcagaaatgaaaacgctgtttttttgaccgttccattattcacaaaagggaaaaaacgattacctgccccgtgtatcaaaacctgccctgccggatgaagggcataaccggcagggacggcgtcaacaccatatgggggtacggcttttcttgaaagattcggcttaaatatccaatactttcgcggtataggcgataatttcatccgccctttcagggttttcgttcaacttgatgccgtaacccggtaccagctctttcagacggtcttcccaagacggggcgcgctcggggaagcattggtgcatcagccggatcatcagcggcacagcggtcgatgcgcccggcgacgcgcccagcaatgcggcgagtgagccgtcggcgtgggcgacaatctccgtaccaaactggagcacgccgcctttttcggagtcttttttaatgatttggacgcgttgccctgcggtgatgagttcccagtcgtcggggtttgcctcggggtagtattccagcagggaggcgaagcgttcttctttggttttacgcaattcgcccagcaggtatttggtcagcggcatattcgcccagccggcgcacagcataggatagaggttgtccatatggatggacagcggcaaatccataagcgagccttgcttgaggaagttggaacggaagcctgcgtaagggccgaacataaggtggcgtttgccgtccacgttgcgtgtgtcgaggtgcgggacggacatcggcggcgcgccgacggaagcctgcccgtacactttggcgttgtgttgttcggcggtttcggggttgctgttgcggaagaacaggccggacacggggaagccgccgtagcctttgccttcggggatgccggatttttgcagcagggtcagcgcgccgccgcccgcgccgaggaagaggaagcgggtacggagggtgagctgcccgtcggggttgcgggtatcggcggttttgagcacccacgcgccgtcggattcgcgtttgatgtcttcgacgtggcggttgaactcggtttttacgcccttgccctgcaaatatttcaccatttggcgcgtcagccgtccgaaatcgacatccgtaccttcggcggagtagttggcggcgacgggttggttttcgtcccggccgcgcatcatcagcggagcccaatcggaaattttgttccgatcggtggaaaattccatattttcaaaaagtttttgggttttaaacgcgtcataacgtttttgaagataagaacaatggtcttcattcatcaccaaagacatatgcggcacggcattgatgaaggaattgtcttccaacttgccttccgcgaccagcgtcgcccaaaactggcggctgacatgaaactgttcggcaatattgagggcgcgcgccggatcgataatcccatttgcacccaacggcgcatagttcaattcgcacagcgcggaatgccccgtgccggcgttgttccacgcgtttgacgattccaacgccacatcttccaagcgttcaatcagggtgatttcccaagacggttcgagttctttgagcaaaacgcccaaagtcgcgctcataatgccgccgcccaccaagacaacgtctgtcgcttcagccatggtttactcctaaaaaacaggcatcttctgcccttatggttatttgccgtactacaaacgcctgaatcgcaaaagcagggaaaaccggcaatggtgtgtgtccgagtatgctgtttcggggttggaatgcgttgcaagcatggcttccgacaccgcttcaggggcttgtaatatgttatcgtgaatgtagtggattttactgggaaatgcaaagtttttctgtcgcccgccaagtcgggaaactgcgaaatgaaaaataaaaatagttatttatctatatatatcaaatttttaatagataaaaaatcaaaattgtttatatattaatttttaaaagattgtcagcatattgcgttaagttttttatagtggattaacaaaaatcaggacaaggcgacgaagccgcagacagtacaaatagtacggaaccgattcacttggtgcttcagcaccttagagaatcgttctctttgagctaaggcgaggcaacgctgtactggtttttgttaatccactataaatttgaaaatactgcctcacacctgcacgccataccctgccaacctgccggtcaggatttccctgtttttgcaccaatcttccctcagcatactgtacacgaccgtatcgcgcacactgccgtctttacggagcatatgcatacgcagcacgccgtctttttccgcacccagccgttcgatggcacgttgcgaggcaaggttcagaatatccgtgcgccatcccacgcaacggcaagccaaaacatcaaatgcggaatccaacagcatgattttgcaacaggtgtttatccgtgtccgccgtgccgatgccgcataccatgtgaatccgatatccaaacgcggaatctgcggttcaaaatgataatacgccgttgtcccgaccaccctgcccgcctcttcatcgacaaccgcaaacgccaaacgcgttgccaatgctgtcccgatatagtctgccaccctatccggatggggcgcggacgttacccccagcttccaaacctccccatcgcaaaccgcctcgcgcaaacccgtttcatgatgcacatccaacggttcgagacgaacgccgcccaacgacaagaccggcagtattatcttttccgacatccttttctcccaatattccgccttcagacggcatttccgcccggaatgccgtctgaacggctaaaaacacaatatccccgcctccgacacaaaaccgtccaaagaccggtcgtgcgcctcgaccggcagcctgtccaccaactggcaggcaaagcccacgcccacggtttttgcctgcaaacggtatttcatcgctgaaagcgtcgcatcgtaatagccgcctgcctgtcccaagcggtagcccagcctgtccataccgaccactggcacaagcaggaggttcaaatcatgcacacgctttttccgacctgcaaactgagggacatgcagcttcgccctaccgcgcttgcgttcttgttttactccatcggcaggatacggcgtaaaccacatccgccgcgaacgcggttcgatataaggcaggtagagttccgcaccgcgtttttgcgccgcgcggacaaagccgtccaaacgcaattccttgcccatcggccaatacacgccgattttccgcccttttttaatataacgtttgagcaggtggttgatttttaccgttgccgccgcccgcacgtcccgccccatttgcgaacgccgcccgcgcaattcgcggcgcagggcgcgtttttcctcgttcctcatttcagacggcctttcaggattgcggtagaatgttgcgattataacgattttgttaacattcaaacaggacgcacacaatgtggcacatcgtcgccatcggctatctttttgttgccgttatgtattccgccgcgcagccgagtattgcgcgcgccttgatttatttggttttttgggcggtgctgcccaccgtgttcacggttttcaccattaccgtccgccgccgcaaccacctgatgaggcagcaggaacaggcggaatccgaacagcagcgcgcacaacggcaaaaagacagcggcacaaaaccctgaatcccttttcagacggcatcttatccgctataatccgtcagttttccatttcggaaacacactattttttaaaacttatgcccactttcgccgaagggtgcttgacaataggcgtgacctatcaagttctatgcgattgaatgtgtgctcttaaccctttcaaggaaataaaatgtctcaaattactatgcgtcagatgattgaagccggtgttcacttcggccaccaaacccgtttctggaacccgaaaatggcacaatacattttcggtgcgcgcaacaaaatccatatcgtcaacctggaaaaaaccctgccgatgttccaagacgcgcaagaagccgtacgtcgtctggttgccaacaaaggtacagtattgttcgtaggtaccaaacgccaagcccgcgacatcatccgcgaagaagcgacccgcgccggtatgcctttcgtcgattaccgctggttgggcggtatgctgaccaactacaaaaccgttaagcaatccatcaaacgcctggaagaaaaaaccgcagccttggaaaatgctgccgaaagcggtttcagcaaaaaagaaattctggaaatgcaacgcgatgttgaaaaactggaacgttctttgggcggtatcaaaaacatgaaaggcctgcctgacgcgattttcgttatcgataccggctaccaaaaaggtactctggttgaagctgaaaaattgggcatccctgttatcgccgtagtcgataccaacaacagccccgacggcgtgaaatacgttatccccggcaacgacgactccgccaaagccatccgcctgtactgccgcggcatcgctgacgcagttttggaaggcaaaaaccaagcgctgcaagaaaccgtagccgctgcccaagaagccgctgccgagtaatccggcaaaccgaagaggggcgttatgccccttttctcaaatatgccgtctgaacgtccgttcgcggcacacgattcccgaatgcggaaaatcctttccgtatttcccaaaaatctaggagattcaaaatggcagaaattactgcaaaaatggttgccgacctgcgcgccgctaccggcctgggcatgatggaatgcaaaaaagccttggttgaagccgaaggcaacttcgacaaagccgaagaaatcctgcgtatcaaatccggtgcgaaagccggtaaactggccggccgtaccgctgccgaaggcgtattggcttacgcgatcaacggcaatgtcggcgcattggtcgaagtaaactgcgaaaccgacttcgttgctaaagacgcgggcttcgtagaatttgccaacttcgttgcgaaaactgctgccgagaaaaaaccggcttctgttgaagaactgagcgaactggttgaagcagaacgcaaagccatcatcgccaaattgggcgagaatatgtctgtccgtcgcttccaagtgatcgacactgccaaccaactggttgcctacatccacggcgcattggcgaccgaaggcgtattggttgagtacaaaggctctgaagacgtagcacgcaaaatcggtatgcatattgttgccgctaaaccacaatgcgtaagcgaagccgaagtagatgccgaaaccgttgaaaaagaacgccacatctacaccgagcaagccatcgcttccggcaaacctgccgacatcgccgctaaaatggttgaaggccgcatccgtaaattcttggctgaaatcactctgaacggccaagcattcgtgatgaaccccgatcaaactgttgcccaattctctaaagaaaacggcactgaagtgatcagcttcgtacgctacaaagtaggcgatggtattgagaaaaaagccgtcgattacgcagccgaagttgctgccgctgctaaagtgtaaggcacttatgaaaaagaaagcacctggattccaaacgaatcagggtgcttttttttgagaaaaccgtttacggtacctattttaagacgaccgaatattcagaccgtcttaaaacaaaacaataataaaccgacacaccctatcattaatattccgaccgttggaaattcagacggcccaactccgaccgacgacattcaagaaagcaaggtatccatgacacagcaaatcaaatacaaacgcgtattactgaaactctccggcgaatccctgatgggttccgatccgttcggcatcaatcacgataccatcgttcaaactgtcggcgaaattgccgaagtcgttaaaatgggcgtgcaagtcggtattgttgtcggcggcggcaatattttccggggcgtatccgcccaagcaggcagcatggatcgcgccaccgccgactacatgggcatgatggcgaccgtgatgaacgcgttggcactcaaagacgcatttgaaactttaggcatcaaagcgcgcgtacaatccgcactgtctatgcagcaaatcgctgaaacctacgcccgccccaaagccatccaatatttggaagaaggcaaagtcgtgatttttgccgccggtaccggtaacccgttcttcacgaccgacactgccgccgcattgcgcggtgcggaaatgaactgcgacgtgatgctcaaagccaccaacgtcgacggtgtgtacaccgcagacccgaaaaaagacccgtccgccacgcgctacgaaaccattacttttgacgaagccttgttgaaaaacctcaaagtcatggacgcgaccgctttcgccctctgccgcgaacgcaagctcaatattgtcgtcttcggcatcgccaaagaaggctcgctcaaacgcgtcattaccggcgaagacgagggaacgctggttcactgctgattgaccatagtgtcggcagatatagtcgcatatgggcttcagacagccatttattatatggagattatagtggattaaatttaaaccagtacggcgttgcctcgccttgccgtactggtttaaatttaatccactatatttacaattttgatacaatttgtttttcatcaaaggagaaaatctatgcaagcacggctgctgatacctattcttttttcagtttttattttatccgcctgcgggacactgacaggtattccatcgcatggcggaggtaaacgctttgcggtcgaacaagaacttgtggccgcttctgccagagctgccgttaaagacatggatttacaggcattacacggacgaaaagttgcattgtacattgccactatgggcgaccaaggttcaggcagtttgacaggggggtcgctactccattgatgcactgattcgtggcgaatacataaacagccctgccgtccgtaccgattacacctatccacgttacgaaaccaccgctgaaacaacatcaggcggtttgacaggtttaaccacttctttatctacacttaatgcccctgcactctctcgcacccaatcagacggtagcggaagtaaaagcagtctgggcttaaatattggcgggatgggggattatcgaaatgaaaccttgacgactaacccgcgcgacactgcctttctttcccacttggtacagaccgtatttttcctgcgcggcatagacgttgtttctcctgccaatgccgatacagatgtgtttattaacatcgacgtattcggaacgatacgcaacagaaccgaaatgcacctatacaatgccgaaacactgaaagcccaaacaaaactggaatatttcgcagtagacagaaccaataaaaaattgctcatcaaaccaaaaaccaatgcgtttgaagctgcctataaagaaaattacgcattgtggatggggccgtataaagtaagcaaaggaattaaaccgacggaaggattaatggtcgatttctccgatatccgaccatacggcaatcatacgggtaactccgccccatccgtagaggctgataacagtcatgaggggtatggatacagcgatgaagtagtgcgacaacatagacaaggacaaccttgattcacactaccataaccgcttgctaccaaggaaaacaaaatgaatttgcctattcaaaaattcatgatgctgtttgcagcagcaatatcgttgctgcaaatccccattagtcatgcgaacggtttggatgcccgtttgcgcgatgatatgcaggcaaaacactacgaaccgggtggtaaataccatctgtttggtaatgctcgcggcagtgttaaaaagcgggtttacgccgtccagacatttgatgcaactgcggtcagtcctgtactgcctattacacacgaacggacagggtttgaaggtgttatcggttatgaaacccatttttcagggcacggacatgaagtacacagtccgttcgatcatcatgattcaaaaagcacttctgatttcagcggcggtgtagacggcggttttactgtttaccaacttcatcgaacagggtcggaaatccatccggaggatggatatgacgggccgcaaggcagcgattatccgccccccggaggagcaagggatatatacagctattatgtcaaaggaacttcaacaaaaacaaagactaatattgtccctcaagccccattttcagaccgttggctaaaagaaaatgccggtgccgcctctggttttttcagccgtgcggatgaagcaggaaaactgatatgggaaagcgaccccaataaaaattggtgggctaaccgtatggatgatgttcgcggcatcgtccaaggtgcggttaatccttttttaatgggttttcaaggagtagggattggggcaattacagacagtgcagtaagcccggtcacagatacagccgcgcagcagactctacaaggtattaatgatttaggaaaattaagtccggaagcacaacttgctgccgcgagcctattacaggacagtgcttttgcggtaaaagacggtatcaactctgccaaacaatgggctgatgcccatccaaatataacagctactgcccaaactgccctttccgcagcagaggccgcaggtacggtttggagaggtaaaaaagtagaacttaacccgactaaatgggattgggttaaaaataccggttataaaaaacctgctgcccgccatatgcagactttagatggggagatggcaggtgggaataaacctattaaatctttaccaaacagtgccgctgaaaaaagaaaacaaaattttgagaagtttaatagtaactggagttcagcaagttttgattcagtgcacaaaacactaactcccaatgcacctggtattttaagtcctgataaagttaaaactcgatacactagtttagatggaaaaattacaattataaaagataacgaaaacaactattttagaatccatgataattcacgaaaacagtatcttgattcaaatggtaatgctgtgaaaaccggtaatttacaaggtaagcaagcaaaagattatttacaacaacaaactcatatcaggaacttagacaaatgaatgaacacaacctgttaattttctgtttaaaagacaatgtttcaattagtgaatatactgaaatggttgattgggcttatgaaaacattcaatctgaaacagttgtagaaattacggaaaatcaaattattgaatatcaaaatcgtggattatgggggcttgtttctgaaattaccgataattggttatttggaccaagtgagggggattggctaatagataaggaaagtattttggctgtaaaagaaaaattacaaaattcagatttttctacagagcccttagtgaaaaatattattcatgtacttgaatatgctataaagaatgaaaaaacagtaatttttcatttttgaaactaatctaatttttagcagccgtaggtcggattctcgaatccgatattttccaacagcggcatttcggaaacgatagatgcgtcaaatatttttgtcggatacaaatatccgacctacatctctgcgcagcaaactttacaagatattaatgaattaggaaatttaagtccggaagcacaacttgctgccgcgagcctattacaggacagtgcttttgcggtaaaagacggcatcaattccgccagacaatgggctgatgcccatccgaatataacagcaacagcccaaactgcccttgccgtagcagaggccgcaactacggtttggggcggtaaaaaagtagaacttaacccgaccaaatgggattgggttaaaaataccggctataaaacacctgctgttcgcaccatgcatactttggatggggaaatggccggtgggaatagaccgcctaaatctataacgtccaacagcaaagcagatgcttccacacaaccgtctttacaagcgcaactaattggagaacaaattagtagtgggcatgcttataacaagcatgtcataagacaacaagaatttacggatttaaatatcaattcaccagcagattttgctcggcatattgaaaatattgttagccatccaacaaatatgaaagagttacctcgcggtagaactgcgtattgggatgataaaacagggacaatagttatccgagataaaaattctgacgatggaggtacagcatttagaccaacatcaggtaaaaaatattatgatgatttataggaaaaagccatgaatatactatccataaataatcaaaactcaactatttcactaactcaagatgaagtttttgttttacgagctatcttgaatgagatatatgcgggcgtatgtgtagattcaagagaatttgaaaatgtatctggtgttagaaaacatgaagtagataatttacaacaacagtttgctggaatttataaaaaaatgacaacttaacaacccaaatttttgtcagagcctagtgcaaattacaactatgattctattgtagccgaaatgaaagaaaaaaatcatgggttggcgacagggttgatgttgttaatatgcctgatggagcacctactagtatggataacacgcgtattatggcagcacgtgaagcaggagtaaaagtggaagcgaatgttcataattttaatgaccgattatcatcaaaagagagaatcaggtttaagcatgatggtattgagcctcaaacttggggagaagctatccagctacgaattagaaagcaagaaacacaaaaaggagttccagaagggtggagcaaaagatttcctaacggaagtatttatgatgtaaaggtacttaggaaatgataaaacaaaatagttttgttccgtatcctgaagcaatgcttcctaaaggatttaaatatccgcaaagttatttaaaattagctcaatccactcatgccattaactacgatgaacaatattcttttccttggtggtttgaaaatgcagaaagcaatatatcagaagtaattgacatttattttgaaataactggcattccaaacctattaccttttgctagaaaccaagagtgggctgcctgttttgatatttcagataaatcaggtaatcctaaaattatagtagttaatttagataatacaaaatattacgagacttttgaaaattttgatacttggctaaaagaagctgaaaatgatggttggtagcaaccgtaggtcggattctcgaatccgacatttttcaacagcggcatttcggaaacgatagacgcgtcaaatatttttgtcggatacaaatatccgacctacatctctgcgcagcaaactttacaagatattaatgaattaggaaatttaagtccggaagcacaacttgctgccgcgagcctattacaggacagtgcttttgcggtaaaagacggcattaattccgccagacaatgggctgatgcccatccgaatataactgcaacagcccaaactgccctttccgtagcagaagccgcaactacggtttggggcggtaaaaaagtaaaccttaacccgaccaaatgggattgggttaaaaataccggctataaaacacctgctgcccgccctatgcagactttagatggggagatggcaggtgggaataagccaccaaaaccaagtacgcagcaacaccctacacactctgataacaatatcggcttacctgcctcatatgttaaacctgatacatctatttctccgacaggaacaattcaagaccgcatcagatggacaaagtccaagtttcctactgagaaatctttaaatggacatttcaaagctcatggaaaagaatttggcgatataaccattgaagactaccaaaaaatggcgtctgatttgttatcaaaacagacatcggacaagatattaggttatcagacggaacatagacgagtgcgctatgatatcaataacaatatctatgttttggccaatccaaaaacattcaaaatcaaaacaatgtttaaaccaaacttaggaaagaagtattatgatggagaattcaaaaaagacatgggaaattgacggagaaatatggctacattgtcctgtttgcggaactgaagttatggactatgatatctgtgacgtttgtcagtggcaaaatacaggagaaactaatatagatggtggccctaatgaaatgacacttgcggaggcgaaagaagcttacgcaaaaggcttaccaatcagataaataagcacctagagaaatcaatgatgacggaatcccatggttacctatcaaataatttacctgttaaaatcataaatgatattatttatgcaacccagttagtcgaagatttggttttaggaaaaataaaaattgttgattttttaaaatcatataacaatttttattgttggcttggttttgatgagttgcctcaatctgagaaaataaaattcctaagctatcttaatatattaagtattcataaagaaatacaagatgaaactgtgaatagggtttataccgattgaaaaatagtagatagagattaacatgttaaatgaaatttttgaaatttattcgagacaaggggaatctttgataggaattggaattagagaagccgcattacccgtccctattgcaatagatatattaaatttatttatcaatgagagaatacttgtattggggggagatatttatatcaagaaagataattatttttatcaaacatatgataattggtattacgagggaagtaatttatttaacagtatcgacaaagcaatgcattatttatctcaaataaaattagagaatgcatacgtatcttttgtgttgaaatttatctaacaaaggaagcacaagaatagatttatagtaaaacatcaagatgttgaaaatgctgggttttaatccaacctacactgaccggctcagatacagccgctcagcagactctacaaggtattaatgatttaggaaatttaagtccggaagcacaacttgctgccgcgagcctattacaggacagtgcttttgcggtaaaaaacggcattaattccgccagacaatgggctgatgcccatccgaatataactgcaacagcccaaactgccctttccgtagcagaggccgcaggtacggtttggcgcggtaaaaaagtagaacttaacccgactaaatgggattgggttaaaaataccggctataaaaaacctgctgcccgccctatgcagactgtagacggggaaatggctgggggaaacaaatcattaaaaatagggacacaatctgttgaaaaatcaaccggtcgtacaatacctaataatttaaaggaacaattagcaatggaagaagttaaggcaaacccacagggcaaaactcctgcgagaatacctcctatgtccgatactaaaaatggttggttagcaaaagacggttgggttaagcgtgttcaaaacgtaaacaaaattgaaatacattacattgaaaactcaagaaccggtgagaaaacagattttaagtttaaggattagtcatgtttttagatgatgtaaatgtttttttagatgatttaaatgtttttttagatgatttaaatactaatccaatcactgacgaatggtatatgtccaattttgccgataaacatattaaaattttggaaagttacgaagcctttgatattctaaaacaatttgttgattacatgattgaagaatatgatgaaaaatcagaatatgaaatcatggaaatattgagacaattaaaatatcaagcagataccaacgaaaaattttatacaaatacacagaaacagaaaattgtagaattatataaacaagaaattagtcaggatattttaaatgaaatctttagataaactatcaatatagaaggaaatccttggaaaaaataaaatgataatcgaacacaatggaaatatacataaaatagccagaatgactggaaataaaaataattttttagaaataatcctatcagatattcatgaaaacataaaaatcaaaccattaactataaaagtaaaaggagagaatgttataaatatccttcctgaggaagttagtttttatgtaaaacaaggtgttgatttaatttatgaaaaatataaacggaaattctttatctccgaaatttctttttgccaatcagatagccggccttcaagtatctacgcttttcttacatttcacttgcttgaagatattattaaaaatgaatccccatccaactacacctgactggctaatagcaggtatgaaccgtgtattcatatcaatataagattaattacggcagaatttgatgaaattagacaaaaacttatcgtaagattttatttagacagagaagtaactgatgatggcaaagaagatatggaaacagcacgaacagaattacttccaggaggatatgcttcatctctggtagtttgacagatttgaccgcttcataaacttagaacattaattaatgatgataatgtttatatgattggttctaaggatagcaaaagcaaattcagaaggaacatgaatggctatttatgacttaaacgaaatagccgtaggtcggattctcgaatccgacattttccaacagcggcatttcggaaacgatagatgcgtcaaatatttttgtcggatacaaatatccgacctacatctctgcgcagcaaactttacaaggtattaatgatttaggaaatttaagtccgaaagcacaacttgctgccgcaagcgcattataggacagtacttttgcggtaaaagacggtatcaattccgccagacaatgggctgatgcccatccgaatataactgcaacagcccaaactgcccttgccgtagcagaggccgcaggtacggtttggagaggtaaaaaagtagaacttaacccgaccaaataggattgggttaaaaataacggctataaaacacctgctgcccgccctatgcagacgttggacggtgagatggcaggaggaaacaagccagttgttaaatctatcagaccaactacgcgagatgaattacgtcaagcattgcaagaacaaggttttagacgtactggttcagatgcggctcaatatgaaacatggaaaggtcctgatggcgtgaaaatagatattcgtccaaatggagaggttataagaacccaaagagtgccgcgaaccgatggtgtacagggaaaatatccgcaacgacaagattatgaaggcaatccattgccaaataatcatcatcattctggatattttgtcaaatgaaaaaaaatatttttcacaatgtaagcctttatgaaataatcttttccgataatggaaatacccttacattatcttttacagatacaattgaaggtaattatttcggatatatcaaatgcagtaatattttgaattttaaattagatacaaataatttcgtagattatgaggataaggaagatagcttgtttcccttgtttatacccgaaatagagctatataaataccaattttatagtgaaattattattgatgtagggattattataaaaatatctgctgaaacaattaattttgagccactgggaaaatagtaactgctttcccagcagccgtagcaactgtatttttacccgacggggtaaaaatacagttgctacatctctgcgcagcagactctacaaggtattaataattcaggaaaattaagcccggaagcacaacttgctgccgcgagcatattacaggacagtgcttttgcggtaaaagacggcatcaattccgccagacaatgggctgatgcccatccgaatataacagcaacagcccaaactgcccttgccgtagcagaggccgcaggtacggtttggagaggtaaaaaagtagaacttaacccgaccaaatgggattgggttaaaaataccggctataaaaaacctgctgttcgccatatgcagactaaggcgttaggtacggtagatgaaattggcgatacagtacagcaggttgggaaacaggctagcggacaaaaaaccagcggtggtaatcctgcgattgatagcgacccctatagcccgagtagtgtggcagctcgcatagaagccggtaaggcgcgcagtgatttacaaatcaaagacattttgagcaatactactcaaaggagtaaaacaaaaggtcccgctgttcagtatgataaagtgggggattacaatgacgcactaaatgattttaatagtctgaatgttcgaaatgtacaaacacgtcctaatggaacgataacgggcaatttacctgatgggcgtgcggttaatgctcgtaatgatagtagtggtggagaaccaacacttgaaataacaattagtaataaccgaaaaataaaaatcagatatggaaatacacgataaattatgaaattaaaaagcttagatttcccaactggctatttctattttgataatgcagcaataaactctgataaagtagaagttatagcagttggttatagaaatacggataaaaccataaaaatttttattgaagatgttattcattttagggttgttgatgaatcgtattttatagatacttttatggatttaatttcggaagatgcagatagagctttgcttcatgaaaatggtggtcaatctttttttgaacttcttgatgagtgttatgcggaatggatattgaaagaaagttattttcctttgaatagagaattctttaaatactatatttttatgtttgagcaaacattcatagaaataattggttctagtgcaacgtattcaattattgagggctagcgtaagatgagtaataagttgcctatctttctttcaggcagcctgaaaataaaactacccaagttgatggtgtacctgtatcagtgaagggaaattttgttgatggtaaatttcgcattggtacggcaacaatgaaatcattttaaattgagctagaaatgaacctagaaaattatgaaaacattttaataaaattacttttttatcataacaacttagtaaatgaatattcttattttattgaaaataaaaatttatttaaaatagtatctcgaacgaaaacgagtaagggcttttttttcactatagaaaaaccattaaattttctaagcaaaaaaacttattttgagtttaattttaaatatttacactcagggaaagaacgctttggttcgtttatgtgctggataaatactaatttaatggaatttgagggggttttttttaacgacctgctccctgataatatgataataaataacttttttgaaataaatgattaacgatacaccaataaaaattggtggggtaaccgtatggatgatattcgcggcatcatccaaggtgcggttaatcctttaatttacaaggtaagcaagcaaaagattatttacaacaacaaactcatatcaggaacttagacaaatgaatgaacacaacctgttaattttctgtttaaaagacaatgtttcaattagtgaatatactgaaatgattgattgggcttataaaaacattcaatctgaaacagttgtagaaattacggaaaatcaaattattgaatatcaaaatcgtggattatggagacttgtttctgaaattaccgataattggttatttggaccaagtgagggggattggctaatagataaggaaagtattttggctgtaaaagaaaaattacaaaattcagatttttctacagagcccttagtgaaaaatattattcatgtacttgaatatgctataaaaaatgaaaaaacagtaatttttcatttttgagactaatccaatttttagtaatattgatgcagagcaagcagcattagatgccgcaaacatggggagaagctattcaatttagaattaaaaaacaaattgaaaatgaactagcaccaccaaattggtctacccagtttcctaatggtagtatttatgatcctaaggtaacgaaatgattattcaaaatgaatttaatttatatcctagtaatatgcttcctgaaaggttttgttatcctgaaaagtatgttcgtatctctaacgatacatctttaataccttatattcagccacataattttcactggtggtttgagaattatggaacagaaggggcagaagtagcttatatatttagaaattctatcctgcctgatttaaatcttatcccattcgctagtaatggagaatgggaagcttattttgatggtaatgatgtaacaggaaattctagggttattgtcattaatttagataatatagaaaaccatgaattttttaatagttttgaagattggcttgaattagcaattaaggatacttggtaagcagctatctataaagagatgaggctgccctggacaactaggataaactcgattttactaattgttttaaaatggaacaagaacttttatttcactgttgttaaaacgccattcgcactcctttaaatacagctcaaaatgcgctttgggaatgccgttaaacttgcgtaaatgacgttttgcttgattccaaaagttctcagttccattaatatggttttgtcgttcggcaaaatgtgtgctgtgattgatacggaaatggctaaattcgcccgcatccaatacatcatagccacgataacaaaatgagtttattttgtttataccgtcttagacgactttctctcatagggataattctaacttaatttgaatttccctagtgatctagggcagcccctaaattaataaagcagcacaactccttttgccgatgttccggactgtcaaacgactgttcctcatgccacatctccatcaaggtacggataacccgctccgccttaccgttggtctgcggacaagcaaatcgggcaagcctccaaccaatcccattatcataacaagctgcaccgaaagcatgttggacggctctttatattacctatcattgtcagagtaaacgtactcaatcaggtacaagcaggggtcggacagatgttcggtcagaaacttggcagcactgtctgcggttttgtccggcaaaatggcagagtataaaaatcgtcaatagcgacaaacaggtaatctcgtttatcagcggccttctgtcctttgagcaacaacaaccgatcggtatcaggatgcacaaaacctcccggggacaacctgccttttacggctttaagtgcacggtaaatagtgacgcggctgacttagtggcagcatactggggaggtgagtgtttttgtgtatatttttattttggtattcccttagaaatactgtaaacaacgctaccggacggcctgcagggcttcgcgcacgcttgctttgagttctgcgccgaagcgtctgcccaagattctgccgaaatcgtccttcggagtgtaatccaccacatcgggggctttgaccacgtctcgcgccacgctgtaaatattgccgagtccgtccaccagcccgactttcagcgcatccgcgcctgtgtacacgcgaccgctgaacacgtcgggatattgtcggaatttgaggcggccgccgcgtccggttttgacggctttgatgaactcgccgtgtatgccggtcagcatttcttcccagatttttgactgttcgggcgtttcgggcgaaaacggatcgcccatgcctttgttgctgcctgcaattttaaccctgcgtttcacgccgattttttccatcaggccggtcgcgtcgaaactgctgccgataacgccgatgctgccgacgatgctggacgggtcggcatagattttgtccgccgccgccgcgatgtagtagcagccggacgcgcacatatcttccgccacgagataaacgggaatgccggggtgctgcgccttcagacggcgtatttcttcaaaagcggtgttggacacgacgggcgaaccgccggggctgttggcgcggatgacgatggcttttgcctgcgggtttttgtaggcggcctccataccgtctttgagttttttgacctggtcttctacaccgttgccgatttcgccgtacagattgacgactgcggtatgcggcgtgttgcccgccaactgcaatgcggcttcgtcttttcggaaaatgcctgcaatcagggcaaccagaatcagggtgctgacggcgcgccagatgtttttccacatccgctccctgcgcctgtcctgataggcggacaacagcacttcgcgcatgatgtcgcgctcccataaggtttcccccgcattttttgcttcgggtgcttcgttttctcttctgattcggtattgcatggttttccttaaatattgtccgatttgggcaaacggttttcagtttacccgatttttcagctctgctcccaatccgtccaagctgtgcaacacttccgcccacgccgcgtccaaaaggttgacggcttctccttcggctttgatgccgaactcaatgtgcggtttgacctgcgtgccgtctgaatgcgtccaaccgacgctgggcaggctgtacgaacgcacgccgggataagtttgctcgatatgctccataagcggcgtaatgcgcgattcgggctgctcaaacacatacacgctgcggctgccgcgttcggtttggttgaagcggtcggcgtaataagtttccaatacccattccgccatcgggtgcgccatcacaggaaagccggggaagaaataatgctcgcggatagaaaatccggcgatgttgttaaacggattgggcaccaattccgcgccttcgggaaaatctgccattttcaggcgttgggcgtgttccggcgaatcaagcggctcgccgcgtttctgggttatgccttcgataaacttggcggcttcagaatggcggacgacgggcaaatccaaagcagcggctgcggcttggcgggtgtggtcgtcgggcgtggcgccgataccgccggtaacgaaagttggcatgccgtctgaaaagctgcggcgcagttgcctgaccagcaaatcgggttcgtcgggcaggtattgcacctgattgagcttcagccctttggattcgagcagggatttgaaaaaggcgaaatgcttgtcttggctgctgccgtgtaagatttcgtcgccgatgatgatgaggttgaacgcgttcatagatggtttctttaccgatgccgtctgaaaatgtcgatggtgctgtgatttgttccctctcccgtgggagagggttagggagagggtcgagcttgcgtttttcaggcagcgtttgcttaaggcctgctgtctgtaccctctccccaaccctcccccgcaggggagggagtcaggttgaggatggcgtaaagaccgtctgaaaagattttcagcgaaacgggcaaagcttcttttcagacagccttaacggctgacaatgggttatatttataagataatgaactccttttttcaagtccgaaggatacccttatgagccaaaaccataccattctgcaatccctccccgtcggtcagaaagtcggcatcgccttctccggcggtcttgatacctctgccgcgctgttgtggatgaaactcaaaggcgcgctgccttatgcctacactgccaacctcggccagcccgacgaagacgactacaacgccattcccaaaaaagcgatggaatacggtgcggaaaacgcccgcttaatcgactgccgcgcgcagttggcacacgaaggcatcgccgccatccaatgcggcgcgtttcacgtttccaccggcggcatcgcctatttcaacaccacgcctctgggccgcgccgtaaccggcactatgcttgtttccgcaatgaaagaagacgatgtgaatatttggggcgacggcagcacctacaaaggcaacgacatcgagcgtttctaccgctacggtttgctcaccaatcccgcgctgaaaatctacaaaccctggctcgatcagcaatttatcgacgaactcggcggccgtcacgaaatgagcgaatttctgattgccaacggcttcaactacaaaatgtcggtggaaaaagcctactccaccgattccaatatgttgggtgccacccacgaagccaaagacttggaatttttgaactcgggcatcaaaatcgtcaaacccattatgggcgttgccttttgggacgaaaacgtcgaagtcagcccggaagaagtcagcgtacgctttgaagaaggcgtgccggttgcactaaacggcaaagaatacgccgatcccgtcgaactcttcctcgaagccaaccgcatcggcggccgccacggcttgggtatgagcgaccaaatcgaaaaccgcatcatcgaagccaaatcgcgcggcatctacgaagccccgggtatggcgttgttccacatcgcctacgagcgtttggtcaccggcatccacaacgaagacaccatcgaacaataccgcatcaacggcctgcgcctcggccgcctgctctaccaaggccgctggttcgacagccaagccctgatgttgcgcgaaaccgcacaacgctgggttgccaaagccgttaccggcgaagttaccctcgaactgcggcgcggcaacgactactcaattctgaacaccgaatcgcccaacctgacctaccaacctgaacgcctgagtatggaaaaagtcgaagacgctgcgttcactccgctcgaccgcatcggacagctcacgatgcgcaacctcgacatcaccgacacccgcgtcaaactgggtatctactcgcaaagcggtttgctctcgctgggcgaaggttcggtattgccgcagttgggcaataagcaataaggtttgctgttttacatcattagcaacttaaggggtcgtctgaaaagatgatcccttatgttaaaaggaatcctatgaaagaatacaaagtcatcatttatcaggaaagcctgttgtccagcctgtttttcggcgcggcaaaggtcaaccccatcaaattcagcgagttcctcaataaacaaacccccgaaggctggcgggttgtaacgatggaaaaagatttgcgccgtatgctgctgtttttcaaacgcgaggcctacgtcgtcattttggagcgggatcgtgtttaagctcggcgtttatacctgtctcggactgtttgccggctgggtgctgctgctgatcgtgcaactctggttttcttttctcgaagcggaattgttcttcaaaatcacactgactatggcggggctgtttgtcatcatcctcgccgccttactggtatgcggtcagtatttttccgaaaagaaaatgaaagacgacgggtttatcaactgatgcggacttgaaccggacccgcgacccaaacatcacaatgccgtctgaacgccctcgcttcagacggcatcaacatcaatcctgctcttttttgccggcaaacacgccgaatccgcccttttccgcatctgtcgggcgatagctgtattttcccgccacttcctcgccggccgggccgtaaaactttccggaaacatccccgctgccattttccgtccaagtccccttaaagccgtttccatcgatggcggctttgaatttttgcgtacccatatgcaaatcatcgccgctgtcgataatgccgtccacagatttgctgccgaaatcgacttttgcggcaaacctgcccctggtcgggtacggacggccgttttccgtatggaaatgcagtacttcgccgttgtacacggccgcgcccgcaagcatttcgccttttgccggttcgccttgaacacgaagggcatacgatccgccgggcaatttttccgccccgtaagtcagataccggtaattcccttcgggcgcgaagatattgccggaatgccccgtcaggctgaccgcttccccatcgacaatcagcgtatccgcctgattgacgggaatcagcggcatctcggccggaagcgaccgcctcgaccgtgcagaacgcctaaatcgcgcaaatgaagtgggtttaggtttataaaagataatatattgattgattcccttcatctgcacactatcggcaaccaaaccgacaaatttatcattcttcccatctttcttgtaattacttattttgtctgcatcacttaatttttcaaattctgattttagctgtacttcttcatccaagaaattattgccactacaagaatcgcctttacagtgggtcaacgttatattttgcgacggcccgtcaatcaaaacgccattagccaaatcaacccttccaaaattgctaccgccattcgcaggtgcagggtttgacgcggggatgggatctgaagaaccggcggcttgattgtttccggcttgatttgcaccttgggcagccgtattgccggcattttgcccgcctgccgacggatcgtccccctgcattccgtccgccgcatttgccatatccggttggtttgccggctgagacgattccccggcatccgttgcttgattttccatatttccggcaagcatattcggatccggggtgtgattcggtgtcgaactatctgtaccggcggcattttgcggcatatcattttgtgccacctcgtcttcatttttgggattatccgctgttaccgcaccgccattgcctgtattttcttccgaaaccgccgccatatcttgactgccttgtgcggatggcgcgccctgtccttgagaacctgcctgtggcgcatcttcctttgcctctgtctctttttcagaaacaacaggggcggcaggttttgacagcgtgtccgccgacttgacatcgggcgatccgccaccgccgcccccgcaggctgaaagggcaaaaatacaagccattgcgattacgctgcgtttaaacatcatcatctccttcatcgtatttcctttttggtttaaaccccgccacttggacatccgtccttcggggcggtggaatcagctttatttgggaagagcgcaacctttccaaatcagggcgacacatagggctgtgctttatgtgccgccctgtgtgttgaaacatattcaataaatattgtttccgccgtatgcctataaaattgtaaaaatatgccgtctgaacgccaaacgggcttcagacggcatagcttggtttattccgcccggttcctctgtcggcccaaatcggcggcagcggtaaacaaaacgtcggtcgaagagttcagcgcagtttccgccgaatcctgaatcacgccgataatgaagccgacggcaaccacctgcatggccacatcgttatcgataccgaacaggctgcacgccaaaggaatcagcagcaacgagccaccggccacaccggatgcaccgcacgcgctaacggtagccaccaggctcagcagcagggcagtggcgaagtcaaccgtaatgccttgcgtgtgcgccgcagccatcgccaaaacggtaatggtgattgccgcaccggccatattgatggttgcacccaatggaatggagatggagtaagtgtcttcgtgcaaacccagctttttcgccaatgccatgttcacagggatattggcggcggaagaacgggtaaagaaggcataaacgccactttcacgcaggcaggtaaacaccagcgggaaagggttgcggcggattttccaccacacgatggcgggattgaccgccagcgcgataaacgccatacagcccaacagcactgcaagcagcttcgcgtaccccgccagcgcgccgaaacccgtctccgcgattgtggacgacaccagcccgaaaatgcccaaaggggcaaaacggataatccatttcacgacggtggaaaccgcttccgccaaatcggcaacgacctgccgcgtaacgtccgaaccgtgattccgcaacgccgcgcccaaaaccaaagcccaagccaaaatgccgatatagttggcattggcaatcgcgttaatcgggttggcgaccaggttcatcagcagcgatttcaatacttccacaatgccggaaggcggcgcggcggacacatcgcccgcgcccgccaaaacaatgtgcgtcgggaaaaccataccggcgatgacggcggtcagggctgcggaaaacgtaccgatgaggtaaaggacgataatcggcctgatatgcgccttgttgcctttttggtgctgcgcgattgtggccgccaccaaaataaataccaaaaccggcgcgaccgctttgagcgcaccgacaaacaggctgccgaacaagcctgccgccaagcccagttgcggggaaaccgaaccgattacgatgcccaacgccaaaccggcggcaatctgcctgaccaggctgacgcggccgatcgcatgaaataaggatttgccgaacgccataattcttccttatgttgtgatatgttaaaaaatgttgtattttaaaagaaaactcattctctgtgtttttttttattttccggctgtattttatagtggattaacaaaaatcaggacaaggcgacgaagccgcagacagtacaaacagtacggaaccgattcacttggtgcttcagcaccttagagaatcgttctctttgagctaaggcgaggcaacgccgtactggtttttgttaatccactataaggttgcgttgatttgccctatgcagtagtgccggacaggctttgctttatcattcggcgcgacggtttaatttattgaacgaaaataaatttatttaatcctgcctattttccgacactattccgaaacgcagcctgttttccatatgcggattagaaacaaaataccttaaaacaagcagatacatttccggcgggccgcaacctccgaaataccggcggcagtatgccgtctgaagcgtcccgccccgtccgaacagtgttaaaatcgaaagccgccacaccgatgcacgacacccgtaccatgatgatcaaaccgaccgccctgctcctgccggctttatttttctttccgcacgcatacgcgcctgccgccgacctttccgaaaacaaggcggcgggtttcgcattgttcaaaaacaaaagccccgacaccgaatcagtcaaattaaaacccaaattccccgtcctcatcgacacgcaggacagtgaaatcaaagatatggtcgaagaacacctgccgctcatcacgcagcagcaggaagaagtattggacaaggaacagacgggcttcctcgccgaagaagcgccggacaacgttaaaacgatgctccgcagcaaaggctatttcagcagcaaagtcagcctgacggaaaaagacggagcttatacggtacacatcacaccgggcccgcgcaccaaaatcgccaacgtcggcgtcgccatcctcggcgacatcctttcagacggcaacctcgccgaatactaccgcaacgcgctggaaaactggcagcagccggtaggcagcgatttcgatcaggacagttgggaaaacagcaaaacttccgtcctcggcgcggtaacgcgcaaagcctacccgcttgccaagctcggcaatacgcaggcggccgtcaaccccgataccgccaccgccgatttgaacgtcgtcgtggacagcggccgccccatcgccttcggcgactttgaaatcaccggcacacagcgttaccccgaacaaatcgtctccggccttgcgcgtttccagcccggtatgccgtacgacctcgacctgctgctcgacttccaacaggcgctcgaacaaaacgggcattattccggcgcgtccgtacaagccgacttcgaccgcctccaaggcgaccgcgtccccgtcaaagtcagcgtaaccgaggtcaaacgccacaaactcgaaaccggcatccgcctcgattcggaatacggtttgggcggcaaaatcgcctacgactattacaacctcttcaacaaaggctatatcggttcggtcgtctgggatatggacaaatacgaaaccacgcttgccgccggcatcagccagccgcgcaactatcggggcaactactggacaagcaacgtttcctacaaccgttcgaccacccaaaacctcgaaaaacgcgccttctccggcggcgtctggtatgtgcgcgaccgcgcgggcatcgatgccaggctgggggcggaatttctcgcagaaggccggaaaatccccggctcggctgtcgatttgggcaacagccacgccacgatgctgaccgcctcttggaaacgccagctgctcaacaacgtgctgcatcccgaaaacggccattacctcgacggcaaaatcggtacgactttgggcacattcctgtcctccaccgcgctgatccgcacctctgcccgtgcaggttatttcttcacgcccgaaaacaaaaaactcggcacgttcatcatacgcggacaagcgggttacaccgttgcccgcgacaatgccgacgttccttcagggctgatgttccgcagcggcggcgcgtcttccgtgcgcggttacgaactcgacagcatcggacttgccggcccgaacggatcggtcctgcccgaacgcgccctcctggtgggcagcctggaataccaactgccgtttacgcgcaccctttccggcgcggtgttccacgatatgggcgatgccgccgccaatttcaaacgtatgaagctgaaacacggttcgggactgggcgtgcgctggttcagcccgcttgcgccgttttccttcgacatcgcctacgggcacagcgataagaaaatccgctggcacatcagcttgggaacgcgcttctaaaccgatatggccacttcagacggcattgcagcaaaccattttgaaacagacattatgaccgataccgcaccgacagataccgatccgaccgaaaacggcacgcgcaaaatgccgtctgaacaccgccctaccccgccggcaaaaaaacgccgcccgttgctgaagctgtcggcggcactgctgtctgtcctgattttggcagtatgtttcctcggctggctcgccggtacggaagcaggtttgcgcttcgggctgtaccaaatcccgtcttggttcggcgtaaacatttcctcccaaaacctcaaaggcacgctgctcgacggcttcgacggcgacaactggtcgatagaaaccgagggggcagaccttaaaatcagccgcttccgcttcgcgtggaaaccgtccgaactgatgcgccgcagcctgcacattaccgaaatttccgccggcgacatcgccatcgttaccaaaccgactccgcctaaagaagaacgcccgccgctcagccttcccgacagcatagacctgcctgccgccgtctatctcgaccgcttcgagacgggcaaaatcagcatgggcaaagcctttgacaaacaaaccgtctatctcgaacggctggatgcttcataccgttacgaccgcaaaggacaccgccttgacctgaaggccgccgacacgccgtggagcagttcgtcgggggcggcctcggtcggcttgaaaaaaccgtttgccctcgataccgccatttacaccaaaggcggactcgaaggcaaaaccatacacagtacggctcggctgagcggcagcctgaaggatgtgcgcgccgaactggcgatcgacggcggcaatatccgcctctcgggaaaatccgtcatccacccgtttgccgaatcattggataaaacattggaagaagtactggtcaaagggttcaacatcaatccggccgccttcgtgccttccctgcccgatgccggactgaatttcgacctgaccgccatcccgtcgttttcagacggcatcgcgctggaaggttcgctcgatttggaaaacaccaaagccggctttgccgaccgcaacggcatccccgtccgtcaggttttaggcggctttgtcatccggcaggacggcacggtgcatatcggcaatacgtccgccgccctgctcggacggggcggcatcaggctgtcgggcaaaatcgacaccgaaaaagacatcctcgatttaaatataggcatcaactccgtcggcgcggaagacgtactgcaaaccgcgttcaaaggcaggttggacggcagcatcggcatcggtggcacgaccgcctcgcccaaaatctcttggcaactcggcatcggcacggcgcgcacggacggcagcctcgccattgcaagcgacccagcaaacggacagcggaaactggtgctcgacaccgtcaacatcgccgccgggcaaggcagcctgaccgcgcaaggctatctcgagctgtttaaagaccgcctgctcaagctggacatccgttcccgcgcattcgacccttcgcgcatcgatccgcaacttccggcaggcaatatcaacggctcaataaaccttgccggcgaactggcaaaagagaaattcacaggcaaaatgcggtttttacccggcacgttcaacggcgtaccgattgccggcagtgccgacattgtttacgagtcccgccaccttccgcgtgccgccgtcgatttgcggctggggcggaacattattaaaacagacggcggcttcggcaaaaaaggcgaccggcttaacctcaatatcaccgcacccgatttatcccgtttcggtttcggactcgcggggtctttaaatgtacgcggacacctttccggtgatttggacggcggcatccgaacctttgaaaccgacctttccggcgcggcgcgcaacctgcacatcggcaaggcggcagacatccgttcgctcgatttcacgctcaaaggttcgcccgacacaagccgcccgatacgcgccgacatcaaaggcagccgcctttcgctgtcgggcggagcggcggttgtcgataccgccgacctgatgctggacggcacgggcgtgcagcaccgcatccgcacacacgccgccatgacgctggatggcaaaccgttcaaattcgatttggacgcttcaggcggcatcaacagggaacttacccgatggaaaggcagcatcggcatcctcgacatcggcggcgcattcaacctcaagctgcaaaaccgtatgacgctcgaagccggtgcggaacgcgtggcggcaagtgcggcaaattggcaggcaatgggcggcagcctcaacctgcaacacttttcttgggataaaaaaaccggcatatcggcaaaaggcggcgcacacggtctgcatatcgccgagttgcacaatttcttcaaaccgcccttcgaacacaatctggttttaaacggcgactgggatgtcgcctacgggcgcaacgcgcgcggctacctcaatatcagccggcaaagcggcgatgccgtattgcccggcgggcaggctttgggtttgaacgcattttccctgaaaacgcgctttcaaaacgaccgcatcggaatcctgcttgacggcggcgcgcgtttcgggcggattaacgccgatttgggcatcgccaacgccttcggcggcaatatggcaaatgcaccgctcggcggcaggattaccgcctcccttcccgacttgggcgcattgaagccctttctgcccgccgccgcgcaaaacattaccggcagcctgaatgccgccgcgcaaatcggcggacgggtaggctctccgtccgtcaatgccgccgtcaacggcagcagcaactacgggaaaatcaacggcaacatcaccgtcgggcaaagccgctctttcgataccgcgcctttgggcggcaggctcaacctgaccgttgccgatgccgaagtattccgcaacttcctaccggtcggacaaaccgtcaaaggcagcctgaatgccgccgtaaccctcggcggcagcatcgccgatccgcacttgggcggcagcatcaacggcgacaaactctattaccgcaaccaaacccaaggcatcatcttggacaacggctcgctgcgttcgcatatcgcgggcaggaaatgggtaatcgacagcctgaaattccggcacgaagggacggcggaactctccggtacggtcggtatggaaaacagcggacccgatgtcgatatcggcgcggtgttcgacaaataccgcatcctgtcccgccccaaccgccgcctgacggtttccggcaacacccgcctgcgctattcgccgcaaaaaggcatatccgttaccgggatgattaaaacggatcaggggctgttcggttcgcaaaaatcctcgatgccgtccgtcggcgacgatgtcgtcgtattaggcgaagtcaaaaaagaggcggcggcaccgctccccgtcaatatgaacctgactttagacctcaatgacggcatccgcttcgccggctacggcgcggacgttaccataggcggcaaactgaccctgaccgcccaatcgggcggaagcgtacggggcgtgggcacggtccgcgtcatcaaagggcgttataaggcatacgggcaggatttggacattaccaaaggcacggtctcctttgtcggcccgctcaacgatcccaacctcaacatccgcgccgaacgccgcctttcccccgtcggtgcgggcgtggaaatattgggcagcctcaacagcccgcgcattacgctgacggcaaacgaaccgatgagtgaaaaagacaagctctcttggctcatcctcaaccgcgccggcagcggcagcagcggcgacaatgccgccctgtctgcagccgcaggtgcgctgcttgccgggcaaatcaacgaccgcatcgggctggtggatgatttgggctttaccagcaagcgcagccgcaacgcgcaaaccggcgaactcaaccccgccgaacaggtgctgaccgtcggcaaacaactgaccggcaaactctacatcggctacgaatacagcatctccagcgcggaacagtccgtcaaactgatttaccggctgacccgcgccatacaggcggttgcccgtatcggcagccgttcgtcgggcggcgagctgacatacaccatacgtttcgaccgcttctccggttcggacaaaaaagactccgccggaaacggcaaaggaaaataagcggttttcagacggcgcgccgccaaaccggacatttgaaaacctgcttttccaccgtccgccgccgccgtccgcctgcaagggaacagaatcgatatagtgaattaacaaaaatcaggataaggcgacgaagccgcagacagtacaaatagtacggaaccgattcactcggtgcttgagcaccttagagaatcgttctctttgagccaaggcgaggcaacgccgtaccggtttttgttaatccgctatattccgccatctctaagatttacagcgatacacaggtaatttaaggaatgcccgaaccgtcattcccgccactttccgtcattcccgcgaaagcgggaatctaggacgcagggttaagaaaacctacatcccgtcattcccgcgaaagtgggaatctagaaatgaaaagcaacaggcatttatcggaaataactgaaaccgaacagactagattcccgcctgcgcgggaatgacggctgcagatgcccgacggtctttatagcggattaacaaaaatcaggataaggcgacgaagccgcagacagtacaaatagtacggaaccgattcactcggtgcttgagcaccttagagaatcgttctctttgagccaaggcgaggcaacgccgtaccggtttttgttaatccgctatattccgccatctctaagatttacagcgatacacaggtaatttaaggaatgcccgaaccgtcattcccgccactttccgtcattcccgcaaaagcgggaatctagaatctcggactttcagataatctttgaatattgctgttgttctaaggtctagattcccgcctgcgcgggaatgacgattcataagtttcccgaaattccaacataaccgaaacctgacagtaaccgtagcaactgaaccgtcattcccacgaaagtgggaatctagaaatgaaaagcaacaggcatttatcggaaataactgaaaccgaacagactagattcccgcctgcgcgggaatgacggctgcagatgcccgacggtctttatagcggattaacaaaaatcaggacaaggcggcgaagccgcagacagtacaaatagtacggaaccgattcactcggtgcttcagcaccttagagaatcgttctctttgagctaaggcgaggcaacgccgtactggtttttgttaatcctctataatgcgcccttcggcgtggcggatatataaggaagtgattttccatctaagtaaaaaccgccctatcggataagcccttaacagaaaaggctttacccgcgccgtatcggaacacatcctctaaaatacaatccgttgaattgaaaaaaatataaaaacatccgcccgcgaaaaacggcagcgcgtcgtttgacaaagaatgaaaatatcggttaaaaaccgattttcatacaaaaaacaccgctgccgtccgcatccgtttcagacggtattgagagaaaatcttttaggagaacctttatgtcccggcatcccgcccccaccggagaaaaaacattcttcggccaccccttccagctttccaccctcttccatatcgaattgtgggaacgtttttcattttacggaatgcagggcatcctgctgatttacctctactacaccgccgacaaaggcggcttgggcatagacaaaaccctcgccggcggcattgtcggcgcatacagcggcagcgtgtacctgtccaccattttgggggcgtggtttgccgaccgagtatggggtgcggaaaaaaccctcttcctctcgggcatcgtcgtgatgctcggacacatcgtccttgccgccgccccgggcctgtacggccttttaatcgggctgatattcatcgcattgggcagcggcggcgtgaaatctacggccagttctatggtgggcgcattatacgaacaggacgaaatgcgcccgctgcgcgatgcgggattttccattttctacatcgccatcaacatcggcggcttcctaggcccgctgctgaccggcctactgcaggaaaacatcggtttccattatggtttcggcgcggcggcggtcggtatggcattcggcttgtggcgttattccctgggacgtaaaaacctgccccaccccaccgtcccccatccgctttcaaaaggacagggcaaaactgcggccgccgtcggcatcgccctcatcgccgcacttgcaaccgccatcaaaaccgggcttgtcaacctcgacaatttctccggcatcctattatctaccgtcatccttgccgtcatcgcctatttcgcccgcctgctgaccaacccccgcgtcagttccgacaacaaacggcacatcatcgcctacatcccgcttttcctgaccatctgtatgttttgggccgtctggtttcagatttacaccgtggcaaccgtctatttcgacgaaaccgtcaaccgcaccatcggttcgtttaccgtgcccgtcgcttggaaagattctatgcaaagcctgtgggtcatcctgttttccggactgatggcggcaatgtggacaaaaatggggcgcaaacagcccaaaaccccgctgaaattcgctatggcggtatttgttaccggcgcgtcgtttttgggattcgtcccctttatttcctccggtacgccgatgcctattgcggttttcgcactgatcgtcctcgccatcacgataggcgaactgatgatttccccgattgcgctgtccatctccaccaaaatcgcaccgcctttattcaaaacccaaatggtcgcccttaatttccttgccttttcattaggcttcactttgggcggcgtattgtttgaaaaaggctatcaggcgggcgacgaaatcggcttctatcggctgctgttctacatcggcgcagccacaggcttcctgctgctcctgctcgtccccaaattgaacaaaatgctcgaaggcacagactaagtcccgccccgatgccgtctgaacccttcagacggcatttttccgcataatgaaaccaaaccgtttccacccgacaggacaggctcccgcccaaccggaaggcagcctgccgattgtcatttgaataacgcaagggaaagccgttgatttccgtttgtatggaaacagtttggtttcattggaaaaaggcattttgtccgactaaattagtgctgcatcaacgaaatatatagtggattaacaaaaatcaggacaaggcgacgaagccgcagacagtacaaatagtacggaaccgattcacttggtgcttgagcaccttagagaatcgttctctttgagctaaggcgaggcaacgccgtaccggtttttgttaatccactataaaaacacaacctaaataaaaatgccgtctgaaccatatttcaggtttcagacgacatttgcgtgtcggatgcacaccggacaggcggtaagccgggttctgtctcggacagtcattcctctaggcataccgttaccggtatgctcaagcaacctacccgaacgctcggcgggcagcgtcattgcgttctgtttggtcttgctccgaatggggtttggcctgccgcatattgttaccaaatgcgcggtgcgcccttaccgcaccttttcacccttacctgtgctgccaaagcagccatcggcggttttgctttctgttccactttccgtcgcgttaccgcgcccggccgttaaccggcattctaccctgcggagcccggactttcctccccgtatgccttacgcgatacgcggcgactgtctgcccgtcccgtgtgcggcgcggattataacacgaaacacaaaaatgccgtctgaaacggtacaggtttcagacggcatacagcctaaactacacgccctgtttcaggctggcttcgatgaagccgtccaagtcgccatccaatacggctttggtgttgccgacttcgtagcctgtacgcaagtctttgatacgtgaggaatccaaaacatacgaacggatttggctgccccaacctacatcggatttaccttcttccaacgcctgtttctcttcattgcgtttgcgcatttccaattcatacagtttggacttcaacatttccatcgcagcggctttgttggcgtgttgcgaacggtcgttttgacattgcaccacaatccccgtcggctcgtgggtaatgcgcacggcggagtcggttttattgatgtgctgaccgcccgcacccgatgcgcgataggtgtcgatgcgcaaatcggcggggttgatttcgatttcgatggaatcgtcgatttcagggtaaacgaacacggaggcaaacgaggtatggcgtttgttgttcgagtcaaacggcgagtaacgcaccaagcggtgaacgccggtttcggtacgcagcaaaccataagcgtattcgccttccacacggatggtggcgcggttgatgcctgcgatttcgccgtcgtcttcttcaaggatttcgattctgaagcctttgcgctcggcgtagcggctgtacatacggaacagcatacccgcccagtcttccgcttccgtaccgcccgcgcctgcggtgatgtcgataaagcagttgttcgggtcggcgggctggttgaacatccgtttgaactccaaatccgccatctgtttttccagccccgctacgtcttcctgcacggcggcaaaaccttcttcgtcgttttcttcgacggtcatttcaatcagcatgcggttgtcttcgatgcccgaagcgatgttgtcgagcgtcaacacgatgccttcgaggattttgcgctctttgccgatttcttgggcgcgtttcgggtcgttccaaagttcggggtcttcggaaagaccgataacttcttccaatcggtctttcttaccctgataatccatataaactcggatgtcttcgctgcgcttttccaaatcgttcagggtattgttgagctggttgattacttcggcttccatgattcttttgttctttcaaaattttaggggcgtattgtacgggattcgggtatttttttctatggataaagccttctggaaacacgttcagacggcatagcgtcaataacggtatgccgccagtttgcgtttgatttcaggcaatgcggcacgtgctgcctcctcacccaaccggatggcgcgttttttctgatcgaatccgccgactgcacccaaatccaaaacctgcggtttgataaccacatccgcctgccccaactcattttgcaacgcagaaacgctcattacgttcagcgtctgatcgagataagagaagaaaccttggctgatgtttttgcccggacgggcggaaatatcgacggcaatcacgaaattcgccccctgccgccgggcggcactgacgggcacgggctgcgacagaccgccgtcaacatatgtatgcctgccgatgataacgggttggaacacattgggaatggcggcggaagcgcgcacagcctgcccggcattcccctgattgaaagcgacggccttgccggtttcaaaatcagtagcaacggcggcaaatttgatgggaaactgctgaatctgcctgccgccgacttttcggttgatgtaattttgcagcttttcgcctttgataaaaccactggtggacaaggttaaatcgaccaaatcggttttgcctaaaatttcggcttccaattcgaggcggtcgggcgacatacccgatgcaaaaaggctgccgacaatcgaacctgccgatgtgccggtaaccaccttcacaggaataccgttttctttcaaaaccttaataatacctacatgggcaaatcctttagatgcgccgccaccgagtgccaaaccgaccactgcggcgggtttggcggtttgcaccggcttgcggacagcattatttcccgccgtgccgcaggcggcaagcaacgcggcggcggcgattgccaaaagcggtctgatttttgaaaacgttaccatattttccattcctttatatatcgcaccccgtcaaaaagagggattgcttttcttaacacccccctttgacagccaagcaaatgggggctttgttaagtcatcatcaaaattaatatttcttttttttttcctttacggaaattatatttgaaggcatactatccaaggcgggaattatctcacaacaccgccgttatccaaatatcccgcctttttccctttctttccatcaaaatactttctttttatattcattaacttgttaaatcattggctgccgggtgtcagtttttccgacaaaatccgtctaatggggtatcaacagaaccaaaacaggaacacttatgaaaatcggaacaacttggcagacggcatccgctatgctggttttgcgtctgtttgccgcatatgaatttttggaatcgggtttgcaaaaatggaacggggagaattggttttccgaaatcaacgatcagtttccattcccgttcaacttgctgccggacgcgttaaactggaatctcgccatgtatgcggagcttttgctgcccgtattgttgcttttgggtttggcaacgcgtctgtcggcattggggctgatggtcgttaccgccgtcgcttgggctgcggttcacgccggttcgggttacaatgtctgcgacaacggttataaaatggctttaatttatatcgtggtattaatcccgctgcttttccagggtgcgggcggatggtcgctggatacgctgctgaaaaaacggttttgcccccgatgccgtctgaaacaagattgattcagtcgtggaatctgactttaaacattccaaccttatctcgttaacttgatattttgaaaaggaaatgacatgaacaaaaacattgctgccgctctcgccggtgctttatccctgtctttggccgccggtgcagttgctgccaacaaaccggcaagcaacgcaacaggcgttcataaatccgcccatggctcttgcggcgcgtccaaatctgccgaaggttcgtgcggcgcggctggttctaaagcaggcgaaggcaaatgcggcgagggcaaatgcggtgcgaccgtaaaaaaaacccacaaacacaccaaagcatctaaagccaaggccaaatctgccgaaggcaaatgcggcgaaggcaaatgcggttctaaataatcccaccccttcaaaccaagccgcgtttttcagtaaaatgcggcttttttaacggcaaacaaagattttttaacaagcacatcattcttttgtgccatccgaaccgggtaaaaatatgattcaacacgcaggcttgggctaccgccgcgacttggcggaagactttctctcgctttccgaaaacagcccgatatgctttatcgaagccgcaccggaaaactggctgaaaatgggcggctgggcgcgcaaacagtttgaccgtgtggcggaacggctgccgctggcgttgcacggattgtctatgtcgctgggcgggcaagcaccgctggatactgatttgatagacggcatcaaagaaatgatgcgccgttacgattgcacgtttttctccgaccatttgagctactgccacgacggcggtcatctttacgatttgttgccgctgccctttaccgaggaaatggtgcatcatacggcgcggcgtatccgcgaagtgcaagaccgtttgggctgccgcatcgccgtggaaaacacgtcctactatctgcattccccgcttgccgagatgaacgaggtcgagttcctcaacgccgtcgcacgtgaggccgattgcggcattcatctggatgtgaacaatatctacgtcaacgccgtcaatcacggtctgctgtcgccggaggcttttttggaaaatgtggatgcagagcgcgtgtgctatatccatattgccggacatgacgtggaaacgccggaattgttgattgatacacatggcgcggcagttttgccgactgtttgggacttgctcgaacttgcctatgccaagctgccgacgattccgcccaccctgttggaacgcgattttaatttcccgcctttttccgaactcgaagccgaagtcgccaaaatcgccgattatcaaacgcgtgccggaaaggaatgccgccgtgcagcctgaaacctccgcccaataccagcaccgtttcgcccaagccatacgcgggggcgaagccgcagacggtctgccgcaagaccgactgaacgtctatatccgcctgatacgcaacaatatctacagctttatcgaccgttgttataccgaaacgctgcaatactttgaccgcgaagaatggggccgtctgaaagaaggtttcgtccgcgacgcgtgcgcccaaacgccctattttcaagaaatccccggcgagttcctccaatattgccaaagcctgccgcttttagacggcattttggcactgatggattttgaatatacccaattgctggcagaagttgctcaaattccggatattcccgacattcattattcaaatgacagcaaatacacaccttcccctgcggcctttatccggcaatatcgatatgatgttaccgatgatttgcatgaagcggaaacagccttgttaatatggcgaaacgccgaagatgatgtgatgtaccaaacattggacggcttcgatatgatgctgctagaaataatggggttctccgcgctttcgtttgacaccctcgcccaaacccttgtcgaatttatgcctgaggacgataattggaaaaatattttgcttgggaaatggtcaggctggactgaacaaaggattatcatcccctccttgtccgccatatccgaaaatatggaagacaattccccgggccaaaaccatctatccgcataaaattaccttgttcccgatactatgccgctacccgacctgaccgatgccgaattaatagagtcgcgtaaactgcttctgcattttgcgcggcttcagttgcccgaccaccctgatttggctgaagatttagtgcaggaaacattgctgtccgcatacagcgcaggcgacagttttcaaggcagggcacttgtcaacagctggctttttgccatattgaaaaacaaaattattgacgcattacgtcaaatcggaaggcagaggaaagtctttaccacactggatgacgagctactggatgaagcatttgaaagccatttttcccaaaacgggcattggacgcaggaagggcagccgcaacattggaacactccggaaaaatcattaaacaacaacgaattccaaaaaattctgcaaagctgcctatacaacctgcctgaaaacaccgcacgggtatttaccctgaaggaaatactcggtttttcatccgacgaaatacaacaaatgtgcggtatcagcacgtccaactaccacaccattatgcaccgcgcccgagaatcattgcgccaatgcctgcaaatcaaatggttcaaccaagaaaacccgaagtaaacgttatgaaaaaatgccgcgatatcgccctgcttctttccaaacatcaggaccgggaaaccaccccgggcgagaagatttccatatacacacacctgctgttctgtccgtattgccgtgaatataaaagacaacttcaaaccatcaaaagatcactggcaaaaacaaccagaacttcaaaataaatgccgtctgaaaaggcttcagacggcataagctgacggaaacaaatcaaaccgatttactgttatctgcagttcatccataatacacacttcaaaagcagcatatttccccatacggaatgtataaatacgcaaaatacgaaggctgcatcaatttgccatatttgctttatttgccttatttcacagacggcgctacccctcccgcccaacccgttctttctgaatgagcagatttcaatgattaaggaaaccctaatgcgcccaatcttcctatctttcgttttattccctattttgataaccgcctgcagcacaccggacaagtctgcccgatgggaaaatatcggcacaatctcaaacggcaatattcatacatatatcaataaagacagcgtgagaaaaaacggaaatctgatgattttccaagataaaaaagttgttaccaatctaaaacaagaacgttttgccaacacccccgcatacaagactgccattgccgagtgggaaatccactgcaacaacaaaacataccgcttaagttcgctacagttgtttgatacaaaaaacacggaaatttccacacaaaactacacagcctcttccctccgcccgatgagcatcctgtccgggacattaaccgaaaaacaatatgaaaccgtatgcggaaaaaaactctgattgcaacttatacacaaacttacccacaaaccttatcataaaaatgccgtctgaaatactgaaatatcagcatttcagacggcattttgccattccctgaaaattatccacaaagttatccacattattttttaaaaccggcttccatccgaaatatagtggattaacaaaaatcaggacaaggcgacgaagccgcagacagtacaaatagtacggcaaggcgaggcaacgccgtactggtttaaatttaatccactatataaactcgctatacaatttcactatccaaacgtaaattgttccattgatacacaaaactgcttacccccataattttgataaagcatttcttacattcccggctccgtcccgtaaccaacacagcggcggattcgcatttgaagtgcaactttccctaacagaaaaaggccagtatgcggtagcatacgacctttcctgcaagaaagattgccatgagctacacgcaactgacccagggcgaacgataccacatccaatacctgtcccgccactgcaccgtcaccgaaatcgccaaacagctgaaccgccacaaaagcaccatcagccgcgaaatcagacggcaccgcacccaagggcagcaatacagcgccgaaaaagcccagcggcaaagccagactatcaaacagcgtaagcgacaaccctataagctcgattcgcagctgattcagcacatcgacacccttatccgccgcaaactcagtcccgaacaagtatgcgcctacctgtgcaaacaccaccagatcacgctccaccacagcaccatttaccgctaccttcgccaagacaaaagcaacggcagcacgttgtggcaacatctcagaatatgcagcaaaccctaccgcaaacgctacggcagcacatggaccagaggcaaagtacccaaccgtgtcggcatagaaaaccgacccgctatcgtcgaccagaaatcccgtatcggcgattgggaagccgacaccattgtcggcaaaggacagaaaagcgcattattgaccttggtcgaacgcgttacccgctacaccatcatctgcaaattggatagcctcaaagccgaagacactgcccgggcagctgttagggcattaaaggcacataaagacagggtgcacaccatcaccatggataacggcaaagagttctaccaacacaccaaaataaccaaagcattgaaagcggagacttatttttgtcgcccttaccattcttgggagaaagggctgaatgagaacaccaacggactcatccggcaatacttccccaaacaaaccgatttccgtaacatcagtgatcgggagatacgcagggttcaagatgagttgaaccaccgaccaagaaaaacacttggctacgaaacgccaagtgttttattcttgaatctgttccaaccactaatacactagtgttgcacttgaaatccgaatccaagagcctctaaaaaataatcgcttgttttgacaccgatacactcatatagtggattaacaaaaatcaggacaaggcgacgaagccgcagacagtacaaatagtacggcaaggcgaggcaacgccgtactggtttaaatttaatccactatacaaatacagaaactcaagaaaataaccttgtgtattgaccatctcaagcaattcagaaaaatcaagaaattttctgaccgtaaacaaacgtttccctaaaaaaacgatgtcttcaaaaatatcgaacaaatagagacctttgcaaaaatagtctgttaacgaaatttgacgcataaaaatgcgccaaaaaattttcaattgcctaaaaccttcctaatattgagcaaaaagtaggaaaaatcagaaaagttttgcattttgaaaatgagattgagcataaaattttagtaacctatgttattgcaaaggtctcaaataatcatcttcggcgttttcatttttatggattaaaacaacacgggaaaaatctgttttcagatgcttgcccgcttgattgttcggattattgtccggaacgacaaaaccgtcctcaaaattaaagcagacgttgcgtccttctacctttatctctgtgcaataacaatcatgtagagaaatgctatccgaaaaattttttctttgtgtatgcaaaaaaagttttcattcaagtacccatatctaacgcaaacgtttacctgtttccccgtcaataatctgactcggcgatttctgcctgccgattctcccaccaacaatccacacatcgcgtccgaattgccttctgacttccctctccgtccgacacgcgcgtttgcctgcgcggttgcacgaagtcgagaccaaaggcgtttgcaaagcctgacacaagcggcgcgcacctacatgggcgggaaccctgaccgccaacttgctgcgctgtttcccgcgtaactcgggtaagacacaggatttggcggataataggaacgttttaggggcgggccattcttttctaagcatatcctgaagattttcagacggcatttgaagtaaaggctgcaattgttcaaattgattcccgatgacaatcatacccttgtgttgcggtctttttttcaaatgcgccaacttaccgagtgctttggctaatgtcggaagacaccccaagccataacaagattcggtcggataagcgaccaaaccaccttttttcaaataaacgcttaacttacgttgcgctgatgctgcgataattctcggaaataacataatataaaataccgtctgaagcacattagtcatacttggcttcagacggcatcatcctctttctaattaacggttaatcgctttatcggcaatgtctttacggtattgcatcccgtcgaaactgattttttccaacgcgccatatgccttagctttcgcttgcgccacattatcgcccaatcccacaacacacaatacgcgtccgccgttggtcaatacgtcacctttctcgtttgccgttgtacctgcatggaaaactttgccgatttggttggcagcatccagaccggaaataatatcgccttttttgggcgtttcggggtaattttgcgccgccagtaccacgcccacggcagtttgcgggctccattccgcggttacgctatcgagtttgccgtctattgccgcttcaaccaaatccgataagtcgctgttcagtcggctcataatcggctgggtttcaggatcgccgaaacggcagttaaactcaatcgtatagggtgcaccgctttgatcaatcatcaaacctgcgtacaggaaaccggtgaactcatgcccctccgctttcatccctgctacggtcggcaaaataatttcattcatcgcgcgttcgtacacaacaggcgttaccacaggcgcagggctgtacgcacccataccgcccgtattcagacctttgtcgccgtctaaaagacgcttgtggtcttggctggttgccataggcagtacattattgccatcaaccatgacgataaaactcgcttcttcgccttgcaggaaatcttcaattacaacacgcgcgccggcattgcccattttgttgtccagcagcatatcatcaatcgcagcatgcgcttcatccaaagtcatcgccacaatcacgcctttacctgccgccaaaccatcggctttgataacgataggcgcacctttctgattgacgtaatcatgtgcggcatcggcgttttcaaaggtttgatattgcgcggtcggaatattgtatttcgccataaatgctttggcgaaatctttggaactttccaactgcgccgcatattgtgtcggaccgaatatttttagtcctgcagcacggaaatcatccacaatacctgccgccaaaggcgcttcagggccgacgacggtaaaaacaatattttctttacgacagaattcaatcaaatcctgatgcgcagtcaagtcgatgttttgcaacttgggttcaatcgctgtaccggcattaccaggcgcaacaaatactgtttccactttaggcgactgcgccaatttccaagccagcgcgtgttcgcgaccgccattaccgataaccagcagtttcataccatctccttgacaaatatgtacttttaacgaaaactcgatacaaagggacttttatcccatctgaagaaattttagtagaatcaaacaaaagaccgcttcattccactctgcaacctattcaacttatccataaattaaaaaaggacaagcaaccatgcaaaaacgtattgatgaaatccaaagcaaataccgcgaatggtgtcatttactaccgcaactggaagaagacatccgccgttggaaacatgtcgtcactttaattcgcgacatggacaatttctatacccacgagtatcaggcgtgtcatcaggctattgaagacggggtagaactggatttgagtacggaaggcgaatacagcattatgagtgaagatgcgctatggaacgcgctgggcgaattccatcaattggcttggttatatttgcgctccagcgtcgatgccttagacaaatatacacaagaagattagtcagcgaagaggtcgtctgaaataccatcacaaagcatttcagacgacctttcattcaaaaggcttttccgtatttacttcaatctgccgagtattcttccaagccgcaacacaggcctcataatttaccaacgacaaactgaccgtcaatcggcaatccaactgcaaatcccgctccaatatatccgcctgatattgtttggcaatgcgtatcgcttcattcaaaaacggatattcacatttcagccaaacagttttttcaatattcttttcaactacttctgcaactgccaacgcttgagccgtcgcctctttgtacgcatgtatcagacctggaacacctaacaaagtaccaccgaaatagcggacgaccacaaccaaaacgtcggtaatacccaccgaatcaatctgtcccaaaattggtcgtccagcacttcctgatggctctccatcatcgttggcacgaaattgcacaccatccacacccaaacgataggcatagcaccagtgtcgtgctttatgatgctcttcctttaacggatcgaggtattttttcacatcagccaatgtccgaatcggataggcaaatgcaataaaacggctgcctttatctttaaactcagcctgcgtcaaggaagtaatggttttataagtcgtaatcatgctgaaatgttttcagacgacctcattaataacaaggtcgtctgaaagtttcacgtgaaacatcaatttttcaatacttctgttaattgtggaacgatttcaaataaatcgccaaccaatccgtaatcggctacattgaaaatcggcgcatcagcatctttattgattgcaacaatcaccttactgtcttgcataccggcaacgtgttgaattgcacctgaaataccgattgcaaaatagagttgcggcgcaaccactttaccggtttgtccgacttgagcatcgtttggcgcatattcggcatcaactgctgcacgggatgcaccgattgccgcacctaaaacatccgccaacggtgtcagcacttcattgaatttttccgcactacccaacgcacgaccaccggaaacaatcacttttgcctgagtcagttcaggacgatcggaatgggaaagctgacggttaacaaaacgactcaggttttgggcaggggttgcttcaacattaattacctcagcattaccaccttgcgccgccactgcgtcaaaaaccgtcgcacggaaggtcagcaccaatttttctgaatcagcttgcacggtttcaaatgcattacccgcataaatggggcgcacaaaagtcgtgttatccacaatttcggtcaaatcagaaatttgcggtacgtctaataaggctgctacgcggggcaaaaggtttttaccgaatgtggttgccgttgctgcaacatagcggtaatcggccgccaatttaacaaccagcggagccaactcttcagccaaaccttcggcataatgagcagcatctgcaaccaaaacttttttcacccccgctacttgcttcgcgaattccactacagcagatgcgccgtttccggcaaccaataaatcgactttgcccagtttggcggcagcggtaacagcatgcaaagtggtaggattcaactgtttgttgtcgtgttcgacaataatcaatacactcatttcagcctcctcaaatcactttggcttcgtttttcaatttttcaaccaattcggcaacgcttgctacttttacgcctgcctgacgcgccttaggttcggcaaatttcaccgttttcaaacgaggtgaaatgtcggcaaccaaatcgtcaggagtcagtttttccaaaggttttttctttgccgccataatattggggagtttgacaaagcgcggctcgttcaaacgcaaatccgcgctgataacagcaggcagtttcaatgcgatggtttcttcgccgccatcgatttcccgcacaatctgcacttcgtcgccttcaatttgtactttggacgcgaacgtaccttgcgccgcattcagcaaagctgccagcatttgcgccacttgattggcatcatcatcaatcgcttgtttgcccaaaaagaaaatttgcggattttctttgtccgcaacggctttcagcaacttagcaacggccagagactccagtttagtatcggtttcaacatgaatggcacggtcggcacccatcgccaaagctgtacgcaaggtttcttcgcattttttctcacccaaagaaaccgctacgatttcgcttacttttccggcttctttcaaacggacagcttcttccacagcgatttcgtcaaacggattcatcgacattttgacattgccgatatccacatccgaaccatcggcttttacacgaactttgacgttgtagtccactacgcgctttactgcgaccagtgctttcattgaaccctcctaaaaagaacgctgctttcaccatccagcgaaaccaaaccttcttccctataaaaccaaatccgttttccttaaaaacgaattcattcaaaaatctttcggataatgcttgccgattataccatttttaaagcatttactcagactagcggatatacattcctgtatctaataaattggaaaatatcatgccgccatatcagttttagacgaccctttagcctttatctgctgcaacacaatccatcagcgcttgataaaccaaatctgcggtcggaatctgcccgatattgcccaaattttttgcaattggcgaaacctgaacgcctgttttaatcggatcggtatcggtataaatgccgaccacaggtttttccaaggcatttgccaaatgcagcaaaccggtatccacgccgacaattccgaccgcgtatttcagcagatacgctgcctgcaataaatttattttgtcgcacacaatagcaaacggcagcccatctgcaatttgtttggcacgcgttttttcatcttcatttccccaaggcaggtaaatattgcattgctgttcttcattcaacttttgcagcaacgaccgccagttttccacaggccataacttactgtcccgactggtcgcatgcaaagccgcataatacggctgcgctaaatttttcagacggcctgcttcaggaacagtcaagccaaatacctgcgtttccggcattacatacccaaatacttgggcaaacagttcacggttgcgccaaacggcattttttcccttcggtacagcgtatgtttttacatacgccaaagcagcccatccctcgcgcgcactgtttttatccaaaccacaaatcggggattttgccattttagcgaaacacgcgcttttaatcagaccttgactgtccaatacgaaatcaaatacttcctgccgcaaagtctgtttcagatgacccatttcccgccaagtttcagcccgaaagagatgtttgcgccattgccgccatttcatcacatggattttttttacaaacggatgcaggcgcgcaatatctgcaaatccagcctcacatagccaatgcagttctacatcaggacattgtcgcgccaaatcttcgattgcgggcaaagtgtgaattaaatcgcccatactagacaagcggacaagcaaaattttcatatttaggaagggggtttcacgtgaaacaattttaacttattgattattaatatatttatttatttcatcagcgttttttaagatgattgccccagcagaatgcatttcctgccatgctgtttcgatggtttccggcgcaataccccgacaagccgcttcattgacgacaacctgccaacgaccgcctttgagtaactgcaaaaccgttgttttaacacaataatccgtagctaacccaccgataataaccgtatccgtattttgacaacgcagccattcaatcagccctgtgcttagtttttcctcaatatcgtgaaaacacgcgccgtaaggatgcaattcaggatcaacacctttccaaacgcaataatcgtattctttagcagaaggcagcccgtccaataattcatagccgcgcgtaccgaccatcgcatgagccacccaagtcaaatccgcatcaggcaaacctgtcggcttcaacatatcaacagggttatccacaagccatttcgctaccatatgatgcgcatctttcgtcatcacgcgcaaatccgccaaagcggcttgcgcattcaactcctcgacaatcaaatgcccctcgttcacgggcagttcgtcaggacacagtggcgtaaacgttttttgtgcatcaacatcaatggaaacaatcatctcattatttcaacgcgattaaaatgccctgtattataacaaattactgcccaaaagcggtaaaaccgattgtgataagataaggtttttccaaaaaacttatccacaaccttatgacttataccattacccccatcggcaccgcccgctcgccctacaaacagaaattcggcatcgcccgccagcccggtttggtctccgccgcaaaagcctgcatcgagctgaatcccaaattcaccgcagacagcgtgcgcgggctggaagatttcgattatgtgtggataagttttatttttcacggcgtattggatgaaggctgggcgcaaatggtgcgcccgccacggctcggcggcaaacaaaaaatgggcgtgttcgccacgcgcagcccccaccgccccaaccatctcggactctcgctcctgaaactcgaacgcatcgaaaccggcaaacccgtccgcctctattgcagcggcgcagacctgctggacggcacaccgattgtggacatcaaaccttatatcccctttgtcgaatccaaacccgatgccgcatccggtttcgtcagcggcaaacccgtagagttggaagtcgtttggcaggaaaacatcggcgcggaaaatttatctgcaaacaccaaaaaccttatcagccaaagcattgcccaagatccgcgccccgcctatcagaatattcccgaacggatttatgtgatgaatattgcagattacgaagtcagatttcaaatcgaggaaaaccgtgcaaccgttattgatctttccccaaccccgctttaaatcgggcaaaaatccggttttgccgcatagcagttgaacaaacggctgttgtttgttcgccataagccgcaatatcaagttatagcggattaaatttaaatcaggacaaggcaacgaagccgcagacagtacaaatagtacggcaaggcgagataacgccgtactggtttaaatttaatccactatacagataaacaatgccgtctgaacgcaatgtgttcagacggcatttacttatccacaggtttgttcaagccttagattttgcctgcgaagtattccaaagtgcggacgagttggcaggtgtaggacatttcgttgtcgtaccaggcaacggttttcaccaattgtttgccgcccacggtcatcacgcgggtttgggtcgcatcgaagagcgagccgtattcgatgccgacaacgtcggaagaaacgatttgatcttcgttgtagccgtaagattcgctggcggcggctttcatcgcggcgttgatttcttctttggttacagggcgttcgaggatggaaaccaattcggtcagcgagccgctggcaacagggacgcgttgggcggagccgtcgagtttgccgttcaattcggggataaccagaccgatggccttggcggcaccggtgctgttgggcacgatgttgagcgcggcggctcgggcgcggcgcaaatcgcctttgcggtgcggcgcgtcaagggtgttttggtcgccggtgtaggcgtggatggtggtcatcagaccttcgactacgccgaactctttttgcaggactgccgccatcggggcaaggcagttggtggtgcaggaagcggcggagataacggtttcgctgccgtccaaaatgtcttggtttacgccatatacgacggttttcacatcattgccgccgggtgcggaaatcacgactttgcgcgcgccggccctgatgtgtgcttcggctttggttttattggtaaagaagccggtacattcgaggatgacatccacacccaactcgccccaaggcaattcttcgggattcggattggcaaaaactttgatctctttgccgtttaccacgatggcatcgtcttttaattcggcagtaccttggaaacggccttgtgtgctgtcgtatttgaaaaggtgcagcagcatttcggcaggggtcaggtcgttgacggcgacgacttcgatgtcgtgggctttttcaatttgacgcaatgcgaggcggccgatgcggccgaaaccgttaatcgctactttaatgctcatgtatatactccaagctgtgaaacgaaatttcaatacctgtattgtattctgaaataaagttacattccactattacatctaactacttgccgcttatttgatatagatgaattttactgtttgcacagatttccaaaacttttaccatcaatatttgaatttaaaattttaatgatgattttgatgattgccaacctgcttgtgcgtaagtagcaaatatccaatattttcattacctttttgtcaaataagtttgagtttaagacttgctgtataagacagataagcgtggatgttttttgacttaataatatttctgtggataactttgctgttttcctagttgtctccacaaccttattgacaggcttacggtcagtctcattccgtcgaagacaaaaccttttgctacaataccgttttcctaatgataaggcagccccatgtccaaatccgccgtttccccaatgatgcagcaatacctcggcatcaaagcgcaacataccgacaaactggtgttttaccgtatgggcgatttttacgagatgtttttcgacgatgcggtagaagcggcaaaacttttggatattaccctgaccacgcgcggacaggtggatggcgagccggtcaaaatggcaggcgtgccgtttcacgccgccgaacaatatctggcgcgcctggtcaagttgggcaaaagcgtggcgatttgcgaacaggtcggcgaagtcggcgcgggcaaagggcctgtggagcgcaaagtcgtgcgcatcgtaacgcccggcacgctgaccgattccgcattgctggaagacaaggaaaccaaccgcatcgttgccgtgtcccccgacaaaaaatacatcggtttggcgtgggcatcgctgcaaagcggcgaattcaaaaccaagctgacaactgtggataaattggacgacgaactggcgcgcctgcaggcggcggaaattctgttgcctgacagtaaaaacgcaccgcaacttcagacggcatcgggtgttacgcgcctgaacgcgtggcagtttgccgccgacgcgggggaaaaactgctgacggaatatttcggctgccaggatttgcgcggcttcggtttggacggcaaagaacacgccgttgcgattggcgcggcaggtgcactgttgaactatatccgtctgacgcaaaacctgatgccgcaacatttggacggcctgtcgctcgaaaccgacagccaatatatcggtatggatgccgccacgcgccgcaatctcgaaatcacgcaaaccctctccggcaaaaaatcgccgaccctgatgtccacgctcgacctttgcgctacccatatgggcagccgcctcttggctctctggctgcaccaccctttacgcaaccgcgcccacatccgagcgcgccaagaagccgttgccgcgctggaaagccaatacaaacccctccagtgccgtctgaaaagcattgccgacatcgaacgcatcgccgcccgtattgccgtgggtaacgcccgcccgcgcgacctcgccgccctgcgcgacagcctgtttgccctgtccgaaatcgaattgtccgccgagtgcagcagtctcttaggaaccctcaaagccgttttcccggaaaacctatccacagccgaacagctccgccaagccattttgcccgaaccttccgtctggctgaaagacggcaatgtcatcaaccacggttttcatcccgaactggacgaattgcgccgcattcaaaaccatggcgacgaatttttgctggatttggaagccaaggaacgcgaacgtaccggtttgtccacacttaaagtcgagttcaaccgcgttcacggcttttacattgaattgtccaaaacccaagccgaacaagcacctgccgactaccaacgccggcaaacccttaaaaacgccgaacgcttcatcacgccggaactgaaagcctttgaagacaaagtgctgactgctcaagagcaagccctcgccttagaaaaacaactctttgacggcgtattgaaaaaccttcagacggcattgccgcagcttcaaaaagccgccaaagccgccgccgcgctggacgtgttgtccacattttcagccttggcaaaagagcggaacttcgtccgccccgagtttgccgactatccggttatccacatcgaaaacggccgccatcccgttgtcgaacagcaggtacgccacttcaccgccaaccacaccgaccttgaccacaaacaccgcctcatgctgctcaccggccccaatatgggcggcaaatccacctacatgcgccaagtcgcgctgattgttttattggcacacaccggctgttttgtgcctgccgatgccgccacaatcgggcccatcgatcaaatcttcacccgcatcggcgcatcggacgacctcgcctccaaccgctccactttcatggtcgaaatgagcgaaaccgcctacatcctgcatcacgccaccgaacaaagccttgttttaatggacgaagtcggacgtggtacttccactttcgacggcctcgccctcgcgcacgccgttgccgaacacctgctgcaaaaaaacaaatccttcagcctgtttgctacccactatttcgagctgacctacctgcccgaagcccacaccgccgccgtcaatatgcacctttccgcgctcgaacagggacaggacatcgttttcctgcaccaaatccaaccgggtcccgccggtaaaagctacggcattgccgtcgccaaactcgccggcctgcctgtacgcgcattgaaatccgcccaaaagcatttgaacggactggaaaaccaagccgccgcgaaccgtccccaactggatattttcagtaccatgccgtctgaaaaaggagatgaaccgaatgtgggcaactttgtggataaagcagaggaaaaacattttgaaggtatattggcagcagccttggaaaaactcgatcccgacagcctgaccccgcgcgaagcattgtcagaactgtaccgtctgaaagatttgtgcaaatccgtatcttaatttccgttgtcggaacagcatcaaaccatatggaaaaatctgtggataaacattatctgacaggaaatttccaaacataaaaaatgccgtccgaacagctcagacggcatccgtccattcggct
